(12) United States Patent
Fincher et al.

(10) Patent No.: US 7,557,201 B2
(45) Date of Patent: Jul. 7, 2009

(54) NUCLEIC ACID MOLECULES AND OTHER MOLECULES ASSOCIATED WITH PLANTS

(75) Inventors: Karen L. Fincher, Pacific, MO (US); Thomas J. La Rosa, Fenton, MO (US); Jinhua Xiao, Wildwood, MO (US)

(73) Assignee: Monsanto Technology LLC, St. Louis, MO (US)

( * ) Notice: Subject to any disclaimer, the term of this patent is extended or adjusted under 35 U.S.C. 154(b) by 372 days.

(21) Appl. No.: 11/331,032

(22) Filed: Jan. 13, 2006

(65) Prior Publication Data

US 2008/0127376 A1 May 29, 2008

Related U.S. Application Data

(63) Continuation of application No. 09/666,355, filed on Sep. 20, 2000, now abandoned.

(60) Provisional application No. 60/155,005, filed on Sep. 21, 1999.

(51) Int. Cl.
*C07H 21/04* (2006.01)
*C12N 15/05* (2006.01)
*C12N 15/82* (2006.01)
*A01H 5/00* (2006.01)

(52) U.S. Cl. ............ 536/23.6; 800/278; 800/295; 800/298; 800/314

(58) Field of Classification Search .......... 800/298
See application file for complete search history.

(56) References Cited

U.S. PATENT DOCUMENTS

| 4,784,949 | A |   | 11/1988 | Gelfand et al. |
|---|---|---|---|---|
| 4,956,282 | A |   | 9/1990 | Goodman et al. |
| 5,011,912 | A |   | 4/1991 | Hopp et al. |
| 6,093,545 | A |   | 7/2000 | Goodearl et al. |
| 2004/0181830 | A1 | * | 9/2004 | Kovalic et al. ............. 800/289 |

FOREIGN PATENT DOCUMENTS

WO      WO 00/18922      4/2000

OTHER PUBLICATIONS

Geneseq Result 1.*
U.S. Appl. No. 09/815,254, filed Mar. 23, 2001, Boukharov et al.
U.S. Appl. No. 10/425,114, filed Mar. 28, 2003, Liu et al.
U.S. Appl. No. 11/329,175, filed Jan. 11, 2006, CaJacob et al.
U.S. Appl. No. 11/329,160, filed Jan. 11, 2006, Bhat et al.
U.S. Appl. No. 11/329,388, filed Jan. 11, 2006, Andersen et al.
U.S. Appl. No. 11/330,082, filed Jan. 12, 2006, Buehler et al.
U.S. Appl. No. 11/330,083, filed Jan. 12, 2006, Byrum et al.
U.S. Appl. No. 11/330,364, filed Jan. 12, 2006, Abad et al.
U.S. Appl. No. 11/331,019, filed Jan. 13, 2006, Fincher et al.
U.S. Appl. No. 11/352,295, filed Feb. 13, 2006, Andersen et al.
U.S. Appl. No. 11/353,150, filed Feb. 14, 2006, Andersen et al.
U.S. Appl. No. 11/486,299, filed Jul. 14, 2006, Byrum.
U.S. Appl. No. 11/490,207, filed Jul. 21, 2006, Brown et al.
U.S. Appl. No. 11/491,125, filed Jul. 24, 2006, Boukharov et al.
U.S. Appl. No. 11/491,178, filed Jul. 24, 2006, Hinkle et al.
U.S. Appl. No. 11/491,371, filed Jul. 24, 2006, Byrum.
U.S. Appl. No. 11/497,489, filed Aug. 2, 2006, Byrum et al.
U.S. Appl. No. 11/503,243, filed Aug. 14, 2006, Kovalic et al.
U.S. Appl. No. 11/520,715, filed Sep. 14, 2006, Liu et al.
U.S. Appl. No. 11/521,349, filed Sep. 15, 2006, Byrum et al.
U.S. Appl. No. 11/595,983, filed Nov. 13, 2006, Boukharov et al.
AA501409, EST Database (Aug. 19, 1997).
Aach et al., "*ent*-Kaurene Biosynthesis in a Cell-Free System From Wheat (*Triticum aestivum* L.) Seedlings and the Localisation of *ent*-Kaurene Synthetase in Plastids of Three Species", *Planta* 197(2), 333-342 (1995).
Adams et al., "Complementary DNA Sequencing: Expressed Sequence Tags and Human Genome Project", *Science* 252(5013), 1651-1656 (1991).
Ait-Ali et al., "The *LS* Locus of Pea Encodes the Gibberellin Biosynthesis Enzyme *ent*-Kaurene Synthase A", *Plant J.* 11(3), 443-454 (1997).
Anaviev et al., "Oat-Maize Chromosome Addition Lines: A New System for Mapping the Maize Genome", *Proc. Natl. Acad. Sci. USA* 94, 3524-3529 (1997).
Anton et al., "Sequencing and Overexpression of the *Escherichia coli aroE* Gene Encoding Shikimate Dehydrogenase", *Biochem. J.* 249, 319-326 (1988).
Attwood, "The Babel of Bioinoformatics", *Science* 290(5491), 471-473 (2000).
Bensen et al., "Cloning and Characterization of the Maize An1 Gene", *Plant Cell* 7, 75-84.
Bentley, "The Shikimate Pathway—A Metabolic Tree with Many Branches," *Critical Rev. Biochem. Mol. Biol.* 25(5), 307-384 (1990).
Birkenbihl et al., "Cosmid-Derived Map of *E.coli* Strain BHE2600 in Comparison to the Map of Strain W3110", *Nucleic Acids Res.* 17(13), 5057-5069 (1989).
Bishop et al., "The Tomato *Dwarf* Gene Isolated by Heterologous Transposon Tagging Encodes the First Member of a New Cytochrome P450 Family", *Plant Cell* 8, 959-969 (1996).
Bonner et al., "Cloning of cDNA Encoding the Bifunctional Dehydroquinase-Shikimate Dehydrogenease of Aromatic-Amino-Acid Biosynthesis in *Nicotiana tabacum*", *Biochem. J.* 362, 11-14 (1994).

(Continued)

*Primary Examiner*—Wendy C. Haas
(74) *Attorney, Agent, or Firm*—Lawrence M. Lavin, Jr.; Matthew L. Madsen; Arnold & Porter LLP

(57) ABSTRACT

Expressed Sequence Tags (ESTs) isolated from cotton are disclosed. The ESTs provide a unique molecular tool for the targeting and isolation of novel genes for plant protection and improvement. The disclosed ESTs have utility in the development of new strategies for understanding critical plant developmental and metabolic pathways. The disclosed ESTs have particular utility in isolating genes and promoters, identifying and mapping the genes involved in developmental and metabolic pathways, and determining gene function. Sequence homology analyses using the ESTs provided in the present invention, will result in more efficient gene screening for desirable agronomic traits. An expanding database of these select pieces of the plant genomics puzzle will quickly expand the knowledge necessary for subsequent functional validation, a key limitation in current plant biotechnology efforts.

20 Claims, No Drawings

OTHER PUBLICATIONS

Bork, "Powers and Pitfalls in Sequence Analysis: The 70% Hurdle", *Genome Res.*, 10, 398-400 (2000).
Bougri et al., "Members of a Low-Copy Number Gene Family Encoding Glutamyl-tRNA Reductase are Differentially Expressed in Barley," *Plant J.* 9(6), 867-878 (1996).
Broun et al., "Catalytic Plasticity of Fatty Acid Modification Enzymes Underlying Chemical Diversity of Plant Lipids", *Science* 282, 1315-1317 (1998).
Bukanov et al., "Ordered Cosmid Library and High-Resolution Physical-Genetic Aap of *Helicobacter pylori* Strain NCTC11638", *Mol. Microbiol.* 11(3), 509-523 (1994).
Charles et al., "Isolation, Characterization and Nucleotide Sequences of the *aroC* Genes encoding Chorismate Synthase from *Salmonella typhi* and *Escherichia coli*", *J. Gen. Microbiol.* 136, 353-358 (1990).
Chen et al., "Microcolinearity in *sh2*-Homologous Regions of the Maize, Rice, and Sorghum Genomes", *Proc. Natl. Acad. Sci. USA* 94, 3431-3435 (1997).
Coulson et al., "Toward a Physical Map of the Genome of the Nematode *Caenorhabditis elegans*", *Proc. Natl. Acad. Sci. USA* 83, 7821-7825 (1986).
Day et al., "Cloning of the cDNA for Glutamyl-tRNA Synthetase from *Arabidopsis thaliana*", *Biochim. Biophys. Acta* 1399(2-3):219-224 (1998).
Duncan et al., "The Overexpression and Complete Amino Acid Sequence of *Escherichia coli* 3-Dehydroquinase", *Biochem. J.* 238, 475-483 (1986).
Eberhard et al., "Cloning and Expression in Yeast of a Higher Plant Chorismate Mutase", *FEBS Lett.* 334(2), 233-236 (1993).
Ebert et al., "Identification of an Essential Upstream Element in the Nopaline Synthase Promoter by Stable and Transient Assays", *Proc. Natl. Acad. Sci. USA* 84(16), 5745-5749 (1987).
Efstratiadis et al., "Enzymatic in Vitro Synthesis of Globin Genes", *Cell* 7, 279-288 (1976).
Eiglmeier et al., "Use of an Ordered Cosmid Library to Deduce the Genomic Organization of *Mycobacterium leprae*", *Mol. Microbiol.* 7(2), 197-206 (1993).
Evans et al., "Immunodetection of Recombinant Proteins Based on Antibodies Directed Against a Metal Binding Peptide Engineered for Purification by Immobilized Metal Affinity Chromatography," *J. Immunol. Meth.* 156(2), 231-238 (1992) (Abstract Only).
Entrez Accession No. M21071 J03227 (Sep. 15, 1989).
Entrez Accession No. 170374 (Sep. 15, 1989).
Entrez Accession No. M27715 (Jun. 15, 1990).
Entrez Accession No. 153878 (Jun. 15, 1990).
Entrez Accession No. X59509 S55160 (Jun. 30, 1993).
Entrez Accession No. 48906 (Jun. 30, 1993).
Entrez Accession No. Y00710 (Sep. 12, 1993).
Entrez Accession No. 40978 (Sep. 12, 1993).
Entrez Accession No. Z26519 (Dec. 2, 1993).
Entrez Accession No. 429153 (Dec. 2, 1993).
Entrez Accession No. 551666 (Jan. 25, 1995).
Entrez Accession No. X81413 (Jan. 25, 1995).
Entrez Accession No. M87280 M99707 (Apr. 12, 1995).
Entrez Accession No. 551855 (Apr. 12, 1995).
Entrez Accession No. 313150 (Jun. 13, 1995).
Entrez Accession No. X73535 (Jun. 13, 1995).
Entrez Accession No. X04306 (Jul. 12, 1995).
Entrez Accession No. 40973 (Jul. 12, 1995).
Entrez Accession No. D63474 D16312 (Jul. 27, 1995).
Entrez Accession No. 474964 (Jul. 27, 1995).
Entrez Accession No. 987267 (Jul. 31, 1995).
Entrez Accession No. U32579 (Sep. 16, 1995).
Entrez Accession No. X82831 (Mar. 1, 1996).
Entrez Accession No. 1213067 (Mar. 1, 1996).
Entrez Accession No. 1220402 (Mar. 5, 1996).
Entrez Accession No. M63245 (Mar. 11, 1996).
Entrez Accession No. W49458 (May 28, 1996).
Entrez Accession No. 1421741 (Oct. 17, 1996).
Entrez Accession No. U54770 (Oct. 18, 1996).
Entrez Accession No. X86101 (Nov. 8, 1996).
Entrez Accession No. 520943 (Feb. 26, 1997).
Entrez Accession No. 2160544 (Jun. 5, 1997).
Entrez Accession No. U63652 (Jun. 6, 1997).
Entrez Accession No. 2257714 (Jul. 15, 1997).
Entrez Accession No. U93215 (Jul. 15, 1997).
Entrez Accession No. 2224890 (Jul. 31, 1997).
Entrez Accession No. 2224892 (Jul. 31, 1997).
Entrez Accession No. U61385 (Aug. 1, 1997).
Entrez Accession No. U61386 (Aug. 1, 1997).
Entrez Accession No. 2316104 (Aug. 8, 1997).
Entrez Accession No. AF010169 (Aug. 9, 1997).
Entrez Accession No. 1524045 (Aug. 20, 1997).
Entrez Accession No. X96943 (Aug. 20, 1997).
Entrez Accession No. Y12809 (Dec. 2, 1997).
Entrez Accession No. D88382 (Mar. 17, 1998).
Entrez Accession No. 3068709 (Apr. 2, 1998).
Entrez Accession No. AF058763 (Aug. 16, 1998).
Entrez Accession No. 3420233 (Apr. 20, 1998).
Entrez Accession No. AF049236 (Apr. 22, 1998).
Entrez Accession No. AF038152 (May 7, 1998).
Entrez Accession No. 2708690 (May 7, 1998).
Entrez Accession No. AC003058 (May 16, 1998).
Entrez Accession No. 3135277 (May 16, 1998).
Entrez Accession No. 3288821 (Jul. 20, 1998).
Entrez Accession No. AF063901 (Jul. 21, 1998).
Entrez Accession No. 3435196 (Sep. 21, 1998).
Entrez Accession No. AF067773 (Sep. 22, 1998).
Entrez Accession No. 3694811 (Sep. 24, 1998).
Entrez Accession No. AJ225107 (Oct. 1, 1998).
Entrez Accession No. 3093410 (Oct. 1, 1998).
Entrez Accession No. AF060481 (Oct. 4, 1998).
Entrez Accession No. 3925407 (Nov. 24, 1998).
Entrez Accession No. AF083948 (Nov. 25, 1998).
Entrez Accession No. AB015492 (Dec. 11, 1998).
Entrez Accession No. 4001680 (Dec. 11, 1998).
Entrez Accession No. AF017431 (Jan. 2, 1999).
Entrez Accession No. 3080490 (Jan. 12, 1999).
Entrez Accession No. AL022602 (Jan. 12, 1999).
Entrez Accession No. AB011416 (Feb. 5, 1999).
Entrez Accession No. AAC17095 GI:315616 (Apr. 5, 1999).
Entrez Accession No. AP000836; GI:6539551 (Aug. 12, 2000).
Entrez Accession No. AY013245 (May 7, 2002).
Fiedler et al., "The Formation of Homogentisate in the Biosynthesis of Tocopherol and Plastoquinone in Spinach Chloroplasts", *Planta* 155, 511-515 (1982).
Garbe et al., "The *Mycobacterium tuberculosis* Shikimate Pathway Genes: Evolutionary Relationship Between Biosynthetic and Catabolic 3-Dehydroquinases", *Mol. Gen. Genet.* 228, 385-392 (1991).
Gasser et al., "Structure, Expression, and Evolution of the 5-Enolpyruvylshikimate-3-Phosphate Synthase Genes of Petunia and Tomato", *J. Biol. Chem.* 263, 4280-4289 (1988).
Gaubier et al., "A Chlorophyll Synthetase Gene from *Arabidopsis thaliana*", *Mol. Gen. Genet.* 249, 58-64 (1995).
GenBank Accession No. U03774 (Jun. 22, 1994).
GenBank Accession No. L37750 (Aug. 3, 1995).
GenBank Accession No. H30177 (Aug. 16, 1995).
GenBank Accession No. W21756 (May 6, 1996).
GenBank Accession No. X80265 (Feb. 26, 1997).
GenBank Accession No. E03435 (Sep. 29, 1997).
GenBank Accession No. AF015462 (Jul. 16, 1998).
Genbank Accession No. AC005922 (Nov. 14, 1998).
GenBank Accession No. X74737 (Jan. 21, 1999).
GenBank Accession No. AU033328 (Apr. 28, 1999).
GenBank Accession No. AQ402486 (Mar. 13, 1999).
GenBank Accession No. AI861202 (Jul. 19, 1999).
GenBank Accession No. AC018632 (Dec. 15, 1999).
GenBank Accession No. AI834598 (Feb. 2, 2000).
GenBank Accession No. AZ134591 (Jun. 2, 2000).
GenBank Accession No. BE428765 (Jul. 26, 2000).
GenBank Accession No. BF542512 (Dec. 11, 2000).
GenBank Accession No. AW871780 (Dec. 11, 2001).
GenBank Accession No. BQ603510 (Jun. 24, 2002).
GenBank Accession No. DR37H4T (Nov. 22, 2002).
GenBank Accession No. BX513761 (May 27, 2003).

GenEMBL Accession No. AF096555 (Jul. 22, 1999).
GenEMBL Accession No. AL096768 (Dec. 12, 1999).
GenSeq Accession No. AAZ35275 (Mar. 27, 2000).
Gerhold et al., "It's the genes! EST access to human genome content", *BioEssays* 18(2), 973-981 (1996).
Gibson et al., "The Bacteriochlorophyll Biosynthesis Gene, bchM, of *Rhodobacter sphaeroides* Encodes S-Adenosyl-l-Methionine: Mg Protoporphyrin IX Methyltransferase", *FEBS Lett.* 352, 127-130 (1994).
Goers et al., "The Differential Allosteric Regulation of Two Chorismate-Mutase Isoenzymes of *Nicotiana silvestris*", *Planta* 162, 117-124 (1984).
Goff, "Rice as a Model for Cereal Genomics", *Curr. Opin. Plant Biol.* 2, 86-89 (1999).
Hedden et al., "Gibberellin Biosynthesis: Enzymes, Genes and Their Regulation", *Annu. Rev. Plant Physiol. Plant Mol. Biol.* 48, 431-460 (1997).
Herrmann, "The Shikimate Pathway as an Entry to Aromatic Secondary Metabolism," *Plant Physiol.* 107, 7-12 (1995).
Hong, "A Rapid and Accurate Strategy for Rice Contig Map Construction by Combination of Fingerprinting and Hybridization", *Plant Mol. Biol.* 35,129-133 (1997).
Hundle et al., "Functional Assignment of *Erwinia herbicola* Eho10 Carotenoid Genes Expressed in *Escherichia coli*", *Mol. Gen. Genet.* 245, 406-416 (1994).
Ibba, "Biochemistry and Bioinformatics: When Worlds Collide," *Trends in Biochem. Sci.* 27(2), 64 (2000).
Iyer et al., "*Quod erat demonstrandum*? The Mystery of Experimental Validation of Apparently Erroneous Computational Analysis of Protein Aequences", *Genome Biol.* 2(12), 1-11 (2001).
Johnston et al., "Cloning and Characterization of Potato cDNAs Involved in Tetrapyrrole Biosynthesis: Ferrochelatase (Accession No. AJ005802), Chloroplatic Protoporphyrinogen IX Oxidase (Accession No. AJ225107), and Mitochondrial Protoporphyrinogen IX Oxidase (Accession No. AJ225108)", *Plant Physiol.* 118, 329-331 (1998).
Keon et al., "Isolation and Heterologous Expression of a Gene Encoding 4-Hydroxyphenylpyruvate Dioxygenase from the Wheat Leaf-Spot Pathogen, *Mycosphaerella graminicola*", *FEMS Microbiol. Lett.* 161, 337-343 (1998).
Kidwell et al., "Transposable Elements as Sources of Variation in Animals and Plants", *Proc. Natl. Acad. Sci. USA* 94, 7704-7711 (1997).
Kim et al., "Construction and Characterization of a Human Bacterial Artificial Chromosome Library", *Genomics* 34, 213-218 (1996).
Knott et al., "Randomly Picked Cosmid Clones Overlap the *pyr*B and *ori*C gap in the Physical Map of the *E.coli* Chromosome", *Nucleic Acids Res.* 16, 2601-2612 (1988).
Ko et al, "An 'Equalized cDNA' Library by the Reassociation of Short Double-Stranded cDNAs", *Nucleic Acids Res.* 18(19), 5705-5711 (1990).
Kyrpides et al., "Whole-Genome Sequence Annotation: 'Going Wrong With Confidence'", *Mol. Microbiol.* 32, 886-887 (1999).
Kurata et al., "A 300 Kilobase Interval Genetic Map of Rice Including 883 Expressed Sequences," *Nature Gen.* 8(4), 362-372 (1994).
Lange et al., "Cloning and Expression of a Gibberellin 2β,3β-Hydroxylase cDNA from Pumpkin Endosperm," *Plant Cell* 9(8), 1459-1467 (1997).
Lange "Cloning Gibberellin Dioxygenase Genes from Pumpkin Endosperm by Heterologous Expression of Enzyme Activities in *Escherichia coli*", *Proc. Natl. Acad. Sci. USA* 94(12), 6553-6558 (1997).
Lange et al., "Expression Cloning of a Gibberellin 20-Oxidase, a Multifunctional Enzyme Involved in Gibberellin Biosynthesis", *Proc. Natl. Acad. Sci. USA* 91(18), 8552-8556 (1994).
Liepman et al., "Sequence Analysis of a cDNA Encoding Alanine:Glyoxylate Amino Transferase from *Arabidopsis* (Accession No. AF063901)", *Plant Physiol.* 117, 1125-1127 (1998).
Lim et al., "Porphobilinogen Deaminase is Encoded by a Single Gene in *Arabidopsis thaliana* and Is Targeted to the Chloroplasts," *Plant Mol. Biol.* 26, 863-872 (1994).

Mahairas et al., "Sequence-Tagged Connectors: A Sequence Approach to Mapping and Scanning the Human Genome", *Proc. Natl. Acad. Sci. USA* 96, 9739-9744 (1999).
Martin et al., "MYB Transcription Factors in Plants", *Trends Genet.* 13(2), 67-73 (1997).
Martin et al., "Mendel's Dwarfing Gene: cDNAs from the *Le* Alleles and Function of the Expressed Proteins", *Proc. Natl. Acad. Sci. USA*, 94(16):8907-8911 (1997).
McCombie et al., "*Caenorhabditis elegans* Expressed Sequence Tags Identify Gene Families and Disease Gene Homologues," *Nature Gen.* 1, 124-131 (1992).
Meinkoth et al., "Hybridization of Nucleic Acids Immobilized on Solid Supports", *Anal. Biochem.* 138, 267-284 (1984).
Mende et al., "The Geranylgeranyl Diphosphate Synthase Gene of *Gibberella fujikuroi*: Isolation and Expression", *Mol. Gen. Genet.* 255(1), 96-105 (1997).
Mohan et al., "Genome Mapping, Molecular Markers and Marker-Assisted Selection Crop Plants", *Mol. Breed.* 3, 87-103 (1997).
Nakane et al., "Nucleotide Sequence of the Shikimate Kinase Gene (*arol*) of *Bacillus subtilis*", *J. Ferment. Bioeng.* 77, 312-314 (1994).
Nakayashiki et al., "Nucleotide Sequence of a cDNA Clone Encoding Glutamyl-tRNA Reductase from Rice (Accession No. AB011416)", *Plant Physiol.* 117, 332 (1998).
NCBI Accession No. S42508 (May 8, 1993).
NCBI Accession No. D23883 (Nov. 29, 1993).
NCBI Accession No. AAA34069, corresponding to gi:535771 (Sep. 11, 1994).
Norris et al., "Complementation of the *Arabidopsis pds 1* Mutation with the Gene Encoding *p*-Hydroxyphenylpuruvate Dioxygenase", *Plant Physiol.* 117, 1317-1323 (1998).
Oka et al., "Replication Origin of the *Escherichia coli* K-12 Chromosome: The Size and Structure of the Minimum DNA Segment Carrying the Information for Autonomous Replication", *Mol. Gen. Genet.* 178(1), 9-20 (1980).
Okubo et al., "Large Scale cDNA Sequencing for Analysis of Quantitative and Qualitative Aspects of Gene Expression", *Nature Gen.* 2, 173-179 (1992).
Phillips et al., "Isolation and Expression of Three Gibberellin 20-Oxidase cDNA Clones from *Arabidopsis*", *Plant Physiol.* 108(3), 1049-1057 (1995).
Porra, "Recent Progress in Porphyrin and Chlorophyll Biosynthesis", *Photochem. Photobiol.* 65(3), 492-516 (1997).
Russell et al., "Structural Features can be Unconserved in Proteins with Similar Folds. An Analysis of Side-Chain to Side-Chain Contacts Secondary Structure and Accessibility", *J. Mol. Biol.* 244, 332-350 (1994).
Sakamoto et al., "An Overview of Gibberellin Metabolism Enzyme Genes and Their Related Mutants in Rice", *Plant Physiol.* 134, 1642-1653 (2004).
Schmitz et al., "The Tomato *Blind* Gene Encodes a MYB Transcription Factor that Controls the Formation of Lateral Meristems", *Proc. Nat. Acad. Sci.* 99(2), 1064-1069 (2002).
Schünmann et al., "Identification of Three cDNA Clones Expressed in the Leaf Extension Zone and with Altered Patterns of Expression in the *Slender* Mutant of Barley: A Tonoplast Intrinsic Protein, a Putative Structural Protein and Protochlorophylide Oxidoreductase," *Plant Mol. Biol.* 31, 529-537 (1996).
Seffernick et al., "Melamine Deaminase and Atrazine Chlorohydrolase: 98 Percent Identical but Functionally Different", *J. Bacteriol.* 183(8), 2405-2410 (2001).
SIGMA Chemical Catalogue (Sigma Chemical Co.; P.O. Box 14508, St. Louis MO 63178) 1993, product Nos. 01256, 03628, 04375, pp. 736-737.
Smith et al., "Partial Purification and Characterization of the Gibberellin $A_{20}$ 3β-Hydroxylase from Seeds of *Phaseolus vulgaris*", *Plant Physiol.* 94:1390-1401 (1990).
Smith et al., "The First Step of Gibberellin Biosynthesis in Pumpkin is Catalyzed by at Least Two Copalyl Diphosphate Synthases Encoded by Differentially Regulated Genes", *Plant Physiol.* 118, 1411-1419 (1998).

Stammers et al., "Rapid Purification and Characterization of HIV-1 Reverse Transcriptase and RNaseH Engineered to Incorporate a C-terminal Tripeptide α-Tubulin Epitope", *FEBS Lett.* 283(2), 298-302 (1991).

Tanaka et al., "The Third Member of the *hemA* gene Family Encoding Glutamyl-tRNA Reductase is Primarily Expressed in Roots in *Hordeum vulgare*", *Photosynthesis Res.* 53, 161-171 (1997).

Tanksley et al., "Chromosome landing: a paradigm for map-based gene cloning in plants with large genomes", *Trends in Genet.* 11(2), 63-68 (1995).

Tikhonov et al., "Colinearity and its Exceptions in Orthologous *adh* Regions of Maize and Sorghum", *Proc. Natl. Acad. Sci. USA* 96, 7409-7414 (1999).

van de Loo et al., "An Oleate 12-Hydroxylase from *Ricirus communis* L. is a Fatty Acyl Desaturase Homolog", *Proc. Nat. Acad. Sci.* 92, 6743-6747 (1995).

Venter et al., "A New Strategy for Genome Sequencing", *Nature* 381, 364-366 (1996).

Venter et al., "The Sequence of the Human Genome" *Science* 291, 1304-1351 (2001).

Wang et al., "Construction of a Rice Bacterial Artificial Chromosome Library and Identification of Clones Linked to the Xa-21 Disease Resistance Locus", *Plant J.* 7(3), 525-533 (1995).

Wells et al., "The Chemokine Information Source: Identification and Characterization of Novel Chemokines Using the WorldWideWeb and Expressed Sequence Tag Databases", *J. Leukocyte Biol.* 61(5), 545-550 (1997).

Wendel et al., "New Isozyme Systems for Maize (*Zea mays* L.): Aconitate Hydratase, Adenylate Kinase, NADH Dehydrogenase, and Shikimate Dehydrogenase", *Biochem. Genet.* 26(5-6), 421-446 (1988) (Abstract Only).

Wenzel et al., "Physical mapping of the *Mycoplasma pneumoniae* genome", *Nucleic Acids Res.* 16(17), 8323-8336 (1988).

Winkler et al., "The Maize *Dwarf3* Gene Encodes a Cytochrome P450-Mediated Early Step in Gibberellin Biosynthesis", *Plant Cell* 7(8), 1307-1317 (1995).

Woese et al., "Conservation of Primary Structure in 16S Ribosomal RNA", *Nature* 254, 83-85 (1975).

Written Description Training Material, Example 7, pp. 30-32.

Yomo et al., "Histochemical Studies on Protease Formation in the Cotyledons of Germinating Bean Seeds," *Planta* 112(1), 35-43 (1973).

Zhang et al., "Physical Mapping of the Rice Genome with BACs", *Plant Mol. Biol.* 35, 115-127 (1997).

Zhang et al., "Construction and Characterization of Two Rice Bacterial Artificial Chromosome Libraries from the Parents of a Permanent Recombinant Inbred Mapping Population", *Mol. Breeding* 2, 11-24 (1996).

Zwick et al., "Physical Mapping of the *liguleless* Linkage Group in *Sorghum bicolor* Using Rice RFLP-Selected Sorghum BACs", *Genetics* 248, 1983-1992 (1998).

BLASTN Search of "Nucleotide collection (nr/nt)" database performed Nov. 19, 2008, (5 pages), herewith.

BLASTX Search of "Non-redundant protein sequences (nr)" database performed Nov. 19, 2008, (16 pages), herewith.

NCBI Record AAB16996 (gi:1619903) obtained Nov. 19, 2008 (1 page), herewith.

NCBI Record AAB62937 (gi:2253415) obtained Nov. 19, 2008 (2 pages), herewith.

NCBI Record AF007215 (gi:2253414) obtained Nov. 19, 2008 (2 pages), herewith.

NCBI Record CAA52403 (gi:516865) obtained Nov. 19, 2008 (2 pages), herewith.

NCBI Record EF530143 (gi:146215997) obtained Nov. 19, 2008 (2 pages), herewith.

NCBI Record NP_001105685 (gi:162459555) obtained Nov. 19, 2008 (2 pages), herewith.

* cited by examiner

NUCLEIC ACID MOLECULES AND OTHER MOLECULES ASSOCIATED WITH PLANTS

CROSS-REFERENCE TO RELATED APPLICATIONS

This application is a continuation of U.S. application Ser. No. 09/666,355 filed Sep. 20, 2000, now abandoned herein incorporated by reference in its entirety, which claims priority to U.S. Provisional Appln. No. 60/155,005, filed Sep. 21, 1999, herein incorporated by reference in its entirety.

INCORPORATION OF SEQUENCE LISTING

This application contains a sequence listing, which is contained on three identical CD-ROMs: two copies of a sequence listing (Copy 1 and Copy 2) and a sequence listing Computer Readable Form (CRF), all of which are herein incorporated by reference. All three CD-ROMs each contain one file called "51462C seq list.txt" which is 17,440,768 bytes in size (measured in Windows XP) and which was created on Jan. 13, 2006.

FIELD OF THE INVENTION

The present invention is in the field of plant biochemistry. More specifically the invention relates to nucleic acid molecules that encode proteins and fragments of proteins produced in plant cells, in particular, cotton plants. The invention also relates to proteins and fragments of proteins so encoded and antibodies capable of binding the proteins. The invention also relates to methods of using the nucleic acid molecules, proteins and fragments of proteins.

BACKGROUND OF THE INVENTION

I. Expressed Sequence Tag Nucleic Acid Molecules

Expressed sequence tags, or ESTs, are short sequences of randomly selected clones from a cDNA (or complementary DNA) library which are representative of the cDNA inserts of these randomly selected clones. McCombie, et al., *Nature Genetics,* 1:124-130 (1992); Kurata, et al., *Nature Genetics,* 8: 365-372 (1994); Okubo, et al., *Nature Genetics,* 2: 173-179 (1992), all of which references are incorporated herein in their entirety.

Using conventional methodologies, cDNA libraries can be constructed from the mRNA (messenger RNA) of a given tissue or organism using poly dT primers and reverse transcriptase (Efstratiadis, et al., *Cell* 7:279-288 (1976), the entirety of which is herein incorporated by reference; Higuchi, et al., *Proc. Natl. Acad. Sci. (U.S.A.)* 73:3146-3150 (1976), the entirety of which is herein incorporated by reference; Maniatis, et al., *Cell* 8:163 (1976) the entirety of which is herein incorporated by reference; Land, et al., *Nucleic Acids Res.* 9:2251-2266 (1981), the entirety of which is herein incorporated by reference; Okayama, et al., *Mol. Cell. Biol.* 2:161-170 (1982), the entirety of which is herein incorporated by reference; Gubler, et al., *Gene* 25:263 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land, et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, report a method for obtaining full length cDNA constructs. This method has been simplified by using synthetic primer-adapters that have both homopolymeric tails for priming the synthesis of the first and second strands and restriction sites for cloning into plasmids (Coleclough, et al., *Gene* 34:305-314 (1985), the entirety of which is herein incorporated by reference) and bacteriophage vectors (Krawinkel, et al., *Nucleic Acids Res.* 14:1913 (1986), the entirety of which is herein incorporated by reference; and Han, et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences. Davidson, *Gene Activity in Early Development,* 2nd ed., Academic Press, New York (1976). The number of clones required to achieve a given probability that a low-abundance mRNA will be present in a cDNA library is $N=(\ln(1-P))/(\ln(1-1/n))$ where N is the number of clones required, P is the probability desired, and 1/n is the fractional proportion of the total mRNA that is represented by a single rare mRNA. (Sambrook, et al., *Molecular Cloning: A Laboratory Manual,* 2nd ed., Cold Spring Harbor Laboratory Press (1989), the entirety of which is herein incorporated by reference.).

A method to enrich preparations of mRNA for sequences of interest is to fractionate by size. One such method is to fractionate by electrophoresis through an agarose gel (Pennica, et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest, et al., *Proc. Natl. Acad. Sci. (U.S.A)* 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali, S. R. et al., *Proc. Natl. Acad. Sci. (U.S.A.)* 88:1943-1947 (1991), the entirety of which is herein incorporated by reference). Typically, the cDNA population is normalized by subtractive hybridization. Schmid, et al., *J. Neurochem.* 48:307-312 (1987) the entirety of which is herein incorporated by reference; Fargnoli, et al., *Anal. Biochem.* 187:364-373 (1990) the entirety of which is herein incorporated by reference; Travis, et al., *Proc. Natl. Acad. Sci. (U.S.A.)* 85:1696-1700 (1988) the entirety of which is herein incorporated by reference; Kato, *Eur. J. Neurosci.* 2:704 (1990); and Schweinfest, et al., *Genet. Anal. Tech. Appl.* 7:64 (1990), the entirety of which is herein incorporated by reference). Subtraction represents another method for reducing the population of certain sequences in the cDNA library. Swaroop, et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci. (U.S.A)* 74: 5463-5467 (1977), the entirety of which is herein incorporated by reference and the chemical degradation method of Maxam and Gilbert, *Proc. Nat. Acad. Sci. (U.S.A.)* 74: 560-564 (1977), the entirety of which is herein incorporated by reference. Automation and advances in technology such as the replacement of radioisotopes with fluorescence-based sequencing have reduced the effort required to sequence DNA (Craxton, *Methods,* 2: 20-26 (1991), the entirety of which is herein incorporated by reference; Ju et al., *Proc. Natl. Acad. Sci. (U.S.A.)* 92: 4347-4351 (1995), the entirety of which is herein incorporated by reference; Tabor and Richardson, *Proc. Natl. Acad. Sci. (U.S.A.)* 92: 6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore Base Station).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 bases have been found to be useful for similarity searches and mapping. (Adams, et al., *Science* 252:1651-1656 (1991), herein incorporated by reference.) EST sequences normally range from 150-450 bases. This is the length of sequence information that is routinely and reliably generated using single run sequence data. Typically, only single run sequence data is obtained from the cDNA library, Adams, et al., *Science* 252:1651-1656 (1991). Automated single run sequencing typically results in an approximately 2-3% error or base ambiguity rate. (Boguski, et al., *Nature Genetics,* 4:332-333 (1993), the entirety of which is herein incorporated by reference).

EST databases have been constructed or partially constructed from, for example, *C. elegans* (McCombrie, et al., *Nature Genetics* 1:124-131 (1992), human liver cell line HepG2 (Okubo, et al., *Nature Genetics* 2:173-179 (1992)), human brain RNA (Adams, et al., *Science* 252:1651-1656 (1991); Adams, et al., *Nature* 355:632-635 (1992)), *Arabidopsis*, (Newman, et al., *Plant Physiol.* 106:1241-1255 (1994)); and rice (Kurata, et al., *Nature Genetics* 8:365-372 (1994).

II. Sequence Comparisons

A characteristic feature of a protein or DNA sequence is that it can be compared with other known protein or DNA sequences. Sequence comparisons can be undertaken by determining the similarity of the test or query sequence with sequences in publicly available or propriety databases ("similarity analysis") or by searching for certain motifs ("intrinsic sequence analysis") (e.g. cis elements) (Coulson, *Trends in Biotechnology,* 12: 76-80 (1994), the entirety of which is herein incorporated by reference; Birren, et al., *Genome Analysis,* 1: 543-559 (1997), the entirety of which is herein incorporated by reference).

Similarity analysis includes database search and alignment. Examples of public databases include the DNA Database of Japan (DDBJ) (available on the world wide web at ddbj.nig.ac.jp/); Genebank (available on the world wide web at ncbi.nlm.nih.gov/web/Genbank/Index.htlm); and the European Molecular Biology Laboratory Nucleic Acid Sequence Database (EMBL) (available on the world wide web at ebi.ac.uk/ebi_docs/embl_db.html). A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology,* 12: 76-80 (1994); Birren, et al., *Genome Analysis,* 1: 543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics,* 3: 266-272 (1993), the entirety of which is herein incorporated by reference). BLASTN and BLASTX may be used in concert for analyzing EST data (Coulson, *Trends in Biotechnology,* 12: 76-80 (1994); Birren, et al., *Genome Analysis,* 1: 543-559 (1997).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins,* 17: 49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36: 290-300 (1993), the entirety of which is herein incorporated by reference, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25: 351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available by ftp at: ebi-.ac.uk. Another program is MACAW (Schuler et al., *Proteins, Struct. Func. Genet,* 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research,* 22: 3583-3589 (1994), the entirety of which is herein incorporated by reference.) PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.,* 18:267-268 (1993), the entirety of which is herein incorporated by reference; Henikoff and Henikoff, *Nucleic Acid Research,* 19:6565-6572 (1991), the entirety of which is herein incorporated by reference; Henikoff and Henikoff, *Proteins,* 17: 49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs) (Krough et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al. *Proc. Natl. Acad. Sci.* 91: 12091-12095 (1994), the entirety of which is herein incorporated by reference.) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

SUMMARY OF THE INVENTION

The present invention provides a substantially purified nucleic acid molecule that encodes a cotton protein or fragment thereof comprising a nucleic acid sequence selected from the group consisting of SEQ ID NO: 1 through SEQ ID NO: 25978.

The present invention also provides one or more substantially purified nucleic acid molecules comprising a nucleic acid sequence selected from the group consisting of SEQ ID NO: 1 through SEQ ID NO:25978 or complements thereof.

The present invention also provides a substantially purified cotton protein or fragment thereof, wherein said cotton protein is encoded by a nucleic acid molecule that comprises a nucleic acid sequence selected from the group consisting of SEQ ID NO: 1 through SEQ ID NO: 25978.

The present invention further provides a substantially purified protein, peptide, or fragment thereof encoded by a nucleic acid sequence which specifically hybridizes to a nucleic acid molecule comprising a nucleic acid sequence selected from the group consisting of a complement of SEQ ID NO: 1 through SEQ ID NO:25978.

The present invention further provides a substantially purified antibody capable of specifically binding to a protein or fragment thereof encoded by a nucleic acid sequence which specifically hybridizes to a nucleic acid molecule having a nucleic acid sequence selected from the group consisting of a complement of SEQ ID NO:1 through SEQ ID NO:25978.

The present invention also provides a transformed plant transformed to contain a nucleic acid molecule which comprises: (A) an exogeneous promoter region which functions in plant cells to cause the production of an mRNA molecule; which is linked to (B) a structural nucleic acid molecule, wherein said structural nucleic acid molecule comprises a nucleic acid molecule that encodes a protein, peptide, or fragment thereof which hybridizes to a nucleic acid sequence selected from the group consisting of a complement of SEQ ID NO:1 through SEQ ID NO:25978 expressed in an effective amount to produce a desirable agronomic effect; which is linked to (C) a 3' non-translated sequence that functions in plant cells to cause the termination of transcription and the addition of polyadenylated ribonucleotides to the 3' end of the mRNA sequence.

The present invention also provides a transformed plant cell containing a nucleic acid molecule whose non-transcribed strand encodes a protein or fragment thereof, wherein the transcribed strand of said nucleic acid is complementary to a nucleic acid molecule that encodes a protein or fragment thereof. The present invention also provides bacterial, viral, microbial, and plant cells comprising a nucleic acid molecule of the present invention The present invention also provides a method of producing a plant containing one or more proteins encoded by sequences comprising SEQ ID NO:1 or complement thereof through SEQ ID NO:25978 or complements thereof, expressed in a sufficient amount and/or fashion to produce a desirable agronomic effect.

In accomplishing the foregoing, there is provided, in accordance with one aspect of the present invention, methods of producing genetically transformed plants, comprising the steps of:
  (a) inserting into the genome of a plant cell a recombinant, double-stranded DNA molecule comprising
    (i) a promoter which functions in plant cells to cause the production of an RNA sequence,
    (ii) a structural DNA sequence that causes the production of an RNA sequence which encodes a desired protein.
    (iii) a 3' non-translated DNA sequence which functions in plant cells to cause the addition of polyadenylated nucleotides to the 3' end of RNA sequence; where the promoter is homologous or heterologous with respect to the coding sequence and adapted to cause sufficient expression of a protein in desired plant tissues to enhance the agronomic utility of a plant transformed with said gene.
  (b) obtaining a transformed plant cell with said nucleic acid molecule that encodes one or more proteins, wherein said nucleic acid molecule is transcribed and results in expression of said protein(s); and
  (c) regenerating from the transformed plant cell a genetically transformed plant The present invention also encompasses differentiated plants, seeds, and progeny comprising said transformed plant cells and which exhibit novel properties of agronomic significance.

The present invention also provides a method of producing a plant containing reduced levels of a protein comprising: (A) transforming a plant cell with a nucleic acid molecule that encodes a protein, wherein said nucleic acid molecule is transcribed and results in co-suppression of endogenous protein synthesis activity, and (B) regenerating plants and producing subsequent progeny from the transformed plant.

The present invention also provides a method of determining an association between a polymorphism and a plant trait comprising: (A) hybridizing a nucleic acid molecule specific for a polymorphism to genetic material of a plant, wherein said nucleic acid molecule comprising a nucleic acid sequence selected from the group consisting of SEQ ID NO: 1 through SEQ ID NO:25978 or complements thereof; and (B) calculating the degree of association between the polymorphism and the plant trait.

The present invention also provides a method of isolating a genetic region, or nucleic acid that encodes a protein or fragment thereof comprising: (A) incubating under conditions permitting nucleic acid hybridization: a marker nucleic acid molecule, preferably an EST, with a complementary nucleic acid molecule obtained from a plant cell or plant tissue; (B) permitting hybridization between said marker nucleic acid molecule, preferably an EST, and said complementary nucleic acid molecule obtained from said plant cell or plant tissue; and (C) isolating said complementary nucleic acid molecule.

The present invention also provides a method for determining a level or pattern in a plant cell of a protein in a plant comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence selected from the group consisting of SEQ ID NO: 1 through SEQ ID NO: 25978 or complements thereof or fragments of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the protein.

The present invention also provides a method for determining the level or pattern of a protein in a plant cell or plant tissue comprising: (A) incubating under conditions permitting nucleic acid hybridization: a marker nucleic acid molecule, the marker nucleic acid molecule comprising a nucleotide sequence selected from the group consisting of SEQ ID NO: 1 through SEQ ID NO:25978 or complements thereof, with a complementary nucleic acid molecule obtained from a plant cell or plant tissue, wherein nucleic acid hybridization between the marker nucleic acid molecule, and the complementary nucleic acid molecule obtained from the plant cell or plant tissue permits the detection of said protein; (B) permitting hybridization between the marker nucleic acid molecule and the complementary nucleic acid molecule obtained from the plant cell or plant tissue; and (C) detecting the level or pattern of the complementary nucleic acid, wherein the detection of said complementary nucleic acid is predictive of the level or pattern of the protein synthesis.

The present invention also provides a method for determining a level or pattern of a protein in a plant cell or plant tissue which comprises assaying the concentration of a molecule, whose concentration is dependent upon the expression of a gene, the gene having a nucleic acid sequence which specifically hybridizes to a protein marker nucleic acid molecule, the molecule being present in a plant cell or plant tissue, in comparison to the concentration of that molecule present in a plant cell or plant tissue with a known level or pattern of said protein, wherein an assayed concentration of the molecule is compared to the assayed concentration of the molecule in a plant cell or plant tissue with a known level or pattern of said protein.

The present invention also provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule consisting of the nucleic acid sequence selected from the group consisting of SEQ ID NO: 1 through SEQ ID NO: 25978 or complements thereof or fragments of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of protein synthesis comprising the steps: (A) incubating under conditions permitting nucleic acid hybridization: a marker nucleic acid molecule, the marker nucleic acid molecule comprising a nucleic acid molecule that is linked to gene, the gene having a nucleic acid sequence which specifically hybridizes to a sequence selected from the group consisting of SEQ ID NO: 1 through SEQ ID NO:25978 and complements thereof, and a complementary nucleic acid molecule obtained from a plant tissue or plant cell of the plant, wherein nucleic acid hybridization between the marker nucleic acid molecule and the complementary nucleic acid molecule obtained from the plant permits the detection of a polymorphism whose presence is predictive of a mutation affecting said level or pattern of a protein synthesis in the plant; (B) permitting hybridization between said marker nucleic acid molecule and said complementary nucleic acid molecule obtained from said plant; and; (C) detecting the presence of the polymorphism, wherein the detection of the polymorphism is predictive of the mutation.

The present invention also provides a method for reducing expression of a protein in a plant cell, the method comprising: growing a transformed plant cell containing a nucleic acid molecule whose non-transcribed strand encodes a protein or fragment thereof, wherein the transcribed strand of said nucleic acid is complementary to a nucleic acid molecule that encodes the protein in said plant cell, and whereby the strand that is complementary to the nucleic acid molecule that encodes the protein reduces or depresses expression of the protein.

The present invention provides cotton nucleic acid molecules for use as molecular tags to isolate genetic regions (i.e. promoters and flanking sequences), isolate genes, map genes, and determine gene function. The present invention further provides cotton nucleic acid molecules for use in determining if genes are members of a particular gene family.

The present invention also provides a method of obtaining full length genes using cotton ESTs or complements thereof or fragments of either.

The present invention also provides a method of isolating promoters and flanking sequences using cotton ESTs or complements thereof or fragments of either.

The present invention also provides cotton ESTs or complements thereof or fragments of either for use in marker-assisted breeding programs.

The present invention also provides a method of identifying tissues comprising hybridizing nucleic acids from the tissue with cotton ESTs or complements thereof or fragments of either.

The present invention also provides a method for production of antibodies targeted against the proteins, peptides, or fragments produced by the disclosed or complements thereof or fragments of either.

The present invention also provides a method for the transformation and regeneration of plants comprising sequences hybridizable to the disclosed ESTs or complements thereof or fragments of either.

The present invention also provides a method of modifying plant protein expression by inserting in a chimeric gene sense or antisense constructs of the cotton ESTs.

DETAILED DESCRIPTION OF THE INVENTION

Agents
 (a) Nucleic Acid Molecules
Agents of the present invention include nucleic acid molecules and more specifically EST nucleic acid molecules or nucleic acid fragment molecules thereof. Fragment EST nucleic acid molecules may encode significant portion(s) of, or indeed most of, the EST nucleic acid molecule. Alternatively, the fragments may comprise smaller oligonucleotides (having from about 15 to about 250 nucleotide residues, and more preferably, about 15 to about 30 nucleotide residues).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

The term "substantially purified", as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels (Prober, et al., *Science* 238:336-340 (1987); Albarella et al., EP 144914, chemical labels (Sheldon et al., U.S. Pat. No. 4,582,789; Albarella et al., U.S. Pat. No. 4,563,417, modified bases (Miyoshi et al., EP 119448, all of which are hereby incorporated by reference in their entirety).

It is further understood, that the present invention provides bacterial, viral, microbial, and plant cells comprising the agents of the present invention.

Nucleic acid molecules or fragment thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook, et al., In: *Molecular Cloning, A Laboratory Manual, 2nd Edition, Cold Spring Harbor Press*, Cold Spring Harbor, N.Y. (1989), and by Haymes, et al. In: *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for an nucleic acid molecule or fragment of the present invention to serve as a primer or probe it need only be sufficiently complementary in sequence to be able to form a stable double-stranded structure under the particular solvent and salt concentrations employed.

Appropriate stringency conditions which promote DNA hybridization are, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 25978 or complements thereof under moderately stringent conditions, for example, at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO:1 through SEQ ID NO: 25978 or complements thereof under high stringency conditions.

In one aspect of the present invention, the nucleic acid molecules of the present invention have one or more of the nucleic acid sequences set forth in SEQ ID NO: 1 through SEQ ID NO:25978 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO:25978 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO:25978 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO:25978 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO:25978 or complements thereof. In a further, even more preferred aspect of the present invention, one or more of the nucleic acid molecules of the present invention exhibit 100% sequence identity with one or more nucleic acid molecules present within the cDNA libraries designated LIB3217, LIB3218, LIB3219, and LIB3272 (Monsanto Company, St. Louis, Mo., United States of America).

In a preferred embodiment of the present invention, a cotton protein or fragment thereof of the present invention is a homologue of another plant protein. In another preferred embodiment of the present invention, a cotton protein or fragment thereof of the present invention is a homologue of a fungal protein. In another preferred embodiment of the present invention, a cotton protein or fragment thereof of the present invention is a homologue of a mammalian protein. In another preferred embodiment of the present invention, a cotton protein or fragment thereof of the present invention is a homologue of a bacterial protein. In another preferred embodiment of the present invention, a cotton protein or fragment thereof of the present invention is a homologue of an algal protein. In another preferred embodiment of the present invention, a cotton protein or fragment thereof of the present invention is a homologue of a soybean protein. In another preferred embodiment of the present invention, a cotton protein or fragment thereof of the present invention is a homologue of a maize protein. In another preferred embodiment of the present invention, a cotton protein or fragment thereof of the present invention is a homologue of a wheat protein.

In a preferred embodiment of the present invention, the nucleic molecule of the present invention encodes a cotton protein or fragment thereof where a cotton protein or fragment thereof exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a cotton protein or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a cotton protein or fragment thereof exhibits a % identity with its homologue of 100%.

In a preferred embodiment of the present invention, the nucleic molecule of the present invention encodes a cotton protein or fragment thereof where the cotton protein exhibits a BLAST score of greater than 120, preferably a BLAST score of between about 1450 and about 120, even more preferably a BLAST score of greater than 1450 with its homologue.

Nucleic acid molecules of the present invention also include non-cotton homologues. Preferred non-cotton homologues are selected from the group consisting of alfalfa, *Arabidopsis*, barley, *Brassica*, broccoli, cabbage, citrus, garlic, oat, oilseed rape, onion, canola, flax, an ornamental plant, maize, pea, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a cotton protein or fragment thereof in SEQ ID NO: 1 through SEQ ID NO:

25978 due to the degeneracy in the genetic code in that they encode the same protein but differ in nucleic acid sequence.

In another further aspect of the present invention, nucleic acid molecules of the present invention can comprise sequences, which differ from those encoding a protein or fragment thereof in SEQ ID NO: 1 through SEQ ID NO: 25978 due to fact that the different nucleic acid sequence encodes a protein having one or more conservative amino acid changes. It is understood that codons capable of coding for such conservative amino acid substitutions are known in the art.

It is well known in the art that one or more amino acids in a native sequence can be substituted with another amino acid(s), the charge and polarity of which are similar to that of the native amino acid, i.e., a conservative amino acid substitution, resulting in a silent change. Conserved substitutes for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to, (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the native polypeptides sequence can be made by substituting one amino acid within one of these groups with another amino acid within the same group. Biologically functional equivalents of the proteins or fragments thereof of the present invention can have 10 or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigent-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982), herein incorporated by reference in its entirety). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, 1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred.

In a further aspect of the present invention, one or more of the nucleic acid molecules of the present invention differ in nucleic acid sequence from those encoding a cotton protein or fragment thereof set forth in SEQ ID NO: 1 through SEQ ID NO: 25978 or fragment thereof due to the fact that one or more codons encoding an amino acid has been substituted for a codon that encodes a nonessential substitution of the amino acid originally encoded.

One aspect of the present invention concerns markers that include nucleic acid molecules SEQ ID NO: 1 through SEQ ID NO: 25978 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (*U.S.A.*) 86:2757-2760 (1989), the entirety of which is herein incorporated by reference), ligase chain reaction (Barany, *Proc. Natl. Acad. Sci.* (*U.S.A.*) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits*, 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs, SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (available on the world wide web at genome.wi.mit.edu/cgi-bin/primer/primer3.cgi), STSPipeline (available on the world wide web at genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or peptide molecules encoded by SEQ ID NO: 1 through SEQ ID NO:25978 or one or more of the protein or fragment thereof or peptide molecules encoded by other nucleic acid agents of the present invention. As used herein, the term "protein molecule" or "peptide molecule" includes any molecule that comprises five or more amino acids. It is well know in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or fragment of peptide molecules may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition, Cold Spring Harbor Press*, Cold Spring Harbor, N.Y. (1989)), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecule of the present invention are preferably produced via recombinant means.

Another class of agents comprise protein or peptide molecules encoded by SEQ ID NO: 1 through SEQ ID NO:25978 or complements thereof or, fragments or fusions thereof in which non-essential, or not relevant, amino acid residues have been added, replaced, or deleted. An example of such a homologue is the homologue protein of all non-cotton plant species, including but not limited to alfalfa, *Arabidopsis*, barley, *Brassica*, broccoli, cabbage, citrus, garlic, oat, oilseed rape, onion, canola, flax, maize, an ornamental plant, pea, peanut, pepper, potato, rice, rye, sorghum, soybean, strawberry, sugarcane, sugarbeet, tomato, wheat, poplar, pine, fir, eucalyptus, apple, lettuce, peas, lentils, grape, banana, tea, turf grasses, etc. Particularly preferred non-cotton plants to utilize for the isolation of homologues would include alfalfa, *Arabidopsis*, barley, oat, oilseed rape, rice, canola, maize, ornamentals, soybean, sugarcane, sugarbeet, tomato, potato, wheat, and turf grasses. Such a homologue can be obtained by any of a variety of methods. Most preferably, as indicated above, one or more of the disclosed sequences (SEQ ID NO: 1 through SEQ ID NO:25978 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), F(ab')$_2$) fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified a suitable adjuvant (such as TiterMax adjuvant (Vaxcel, Norcross, Ga.)). Immunization is preferably conducted at two intramuscular sites, one intraperitoneal site, and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later, and are then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs), preferably by direct ELISA.

In one embodiment, anti-protein or peptide monoclonal antibodies are isolated using a fusion of a protein, protein fragment, or peptide of the present invention, or conjugate of a protein, protein fragment, or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted, and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96-well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbors. Desirably, the fusion plates are screened several times since the rates of hybridoma growth vary. In a preferred sub-embodiment, a different antigenic form of immunogen may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

The nucleic acid molecules and fragments thereof of the present invention from the cDNA library LIB3217 are isolated from young roots, which are harvested from *Gossypium hirsutum* variety Nucotton33B plants 15 days after planting. Roots play a critical role in major vegetative organs which supply water, minerals, and substances essential for plant growth and development, therefore, the ESTs of the present invention will find great use in the isolation of a variety of agronomically significant genes, including but not limited to genes that are necessary for absorption, anchorage, storage, transport, and propagation. Such genes are associated with plant growth, yield, and fiber quality, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments thereof of the present invention from the cDNA library LIB3218 and LIB3219 are isolated from cotton floral buds from medium stage to open flowers, which are harvested from cotton plants about 2 months after planting. The ESTs of the present invention can enable the acquisition of, including but not limited to, genes involved in floral and square development, reproduction, female production and development (ovary/ovule development, stigma development and style development), pollen production and development, seed production, fiber production and development, boll development, and pollination, therefore, the ESTs of the present invention will find great use in the isolation of a variety of agronomically significant genes, including but not limited to, non-regulatory genes and genes that regulate microsporogenesis, meiosis, cell cycle, signal transduction, cell-cell communication, carotenoids, floral biogenesis, embryogenesis, fibers, proteins, amino acids, sterols, oils, minerals, isoflavones, saponins, vitamins, tocopherols, antinutrient components, carbohydrates, starch metabolism, and seed composition and function. Such genes are associated with plant growth, yield and fiber quality, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments thereof of the present invention from the cDNA library LIB3272 are isolated from non-embryogenic callus derived from hypocotyls from *Gossypium hirsutum* Coker 312 seedlings. The ESTs of the present invention will find great use in the isolation of a variety of agronomically significant genes, including but not limited to, genes that regulate the synthesis and activity of proteins, amino acids, sterols, oils, minerals, vitamins, tocopherols, antinutrient components, carbohydrates, and starch metabolism. Such genes are associated with plant growth, fiber quality and yield, and could also serve as links in metabolic and catabolic pathways. The ESTs of the present invention will also find great use in the identification of genes important in plant regeneration, including but not limited to, genes encoding transcription factors and components of signal transduction including receptors and ion transporters and channels. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

Nucleic acid molecules and fragments thereof of the present invention may be employed to obtain other nucleic acid molecules. Such molecules include the nucleic acid molecules of other plants or other organisms (e.g., alfalfa, rice, potato, soybean, oat, rye, barley, maize, wheat, *Arabidopsis, Brassica*, etc.) including the nucleic acid molecules that encode, in whole or in part, protein homologues of other plant species or other organisms, and sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO:1 through SEQ ID NO:25978 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (*U.S.A.*) 83:4143-4146

(1986); Goodchild et al., *Proc. Natl. Acad. Sci. (U.S.A)* 85:5507-5511 (1988); Wickstrom et al., *Proc. Natl. Acad. Sci. (U.S.A.)* 85:1028-1032 (1988); Holt, et al., *Molec. Cell. Biol.* 8:963-973 (1988); Gerwirtz, et al., *Science* 242:1303-1306 (1988); Anfossi, et al., *Proc. Natl. Acad. Sci. (U.S.A.)* 86:3379-3383 (1989); Becker, et al., *EMBO J.* 8:3685-3691 (1989); all of which are herein incorporated by reference in their entirety). Automated nucleic acid synthesizers may be employed for this purpose. In lieu of such synthesis, the disclosed nucleic acid molecules may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194, all of which are herein incorporated by reference in their entirety) to amplify and obtain any desired nucleic acid molecule or fragment.

Promoter sequence(s) and other genetic elements including but not limited to transcriptional regulatory elements associated with one or more of the disclosed nucleic acid sequences can also be obtained using the disclosed nucleic acid sequences provided herein.

In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman, et al., *Proc. Natl. Acad. Sci. (U.S.A)* 85:8998-9002 (1988); Ohara, et al., *Proc. Natl. Acad. Sci. (U.S.A.)* 86: 5673-5677 (1989); Pang et al., *Biotechniques,* 22(6); 1046-1048 (1977); Huang et al., *Methods Mol. Biol.* 69: 89-96 (1977); Hartl et al., *Methods Mol. Biol.* 58: 293-301 (1996), all of which are hereby incorporated by reference in their entirety). In one embodiment, the disclosed nucleic acid molecules are used to identify cDNAs whose analogous genes contain promoters with desirable expression patterns. The nucleic acid molecules isolated from the library of the present invention are used to isolate promoters of tissue-enhanced, tissue-specific, developmentally- or environmentally-regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See for example Birren et al., *Genome Analysis: Analyzing DNA,* 1, (1997), Cold Spring Harbor Laboratory Press, Cold Spring Harbor, N.Y., the entirety of which is herein incorporated by reference).

Promoters obtained utilizing the nucleic acid molecules of the present invention could also be modified to affect their control characteristics. Examples of such modifications would include but are not limited to enhancer sequences as reported by Kay et al., *Science* 236:1299 (1987), herein incorporated by reference in its entirety. Such genetic elements could be used to enhance gene expression of new and existing traits for crop improvements.

The nucleic acid molecules of the present invention may be used to isolate promoters of tissue enhanced. tissue specific, cell-specific, cell-type, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et. al., *Genome Analysis: Analyzing DNA,* 1, Cold Spring Harbor Laboratory Press, Cold Spring Harbor, N.Y. (1997), herein incorporated by reference in its entirety). Promoters obtained utilizing the nucleic acid molecules of the present invention could also be modified to affect their control characteristics. Examples of such modifications would include but are not limited to enhancer sequences as reported by Kay, et al *Science* 236: 1299 (1987), herein incorporated reference in its entirety. Such genetic elements could be used to enhance gene expression of new and existing traits for crop improvements.

In an aspect of the present invention, one or more of the nucleic molecules of the present invention are used to determine whether a plant (preferably cotton) has a mutation affecting the level (i.e., the concentration of mRNA in a sample, etc.) or pattern (i.e., the kinetics of expression, rate of decomposition, stability profile, etc.) of the expression encoded in part or whole by one or more of the nucleic acid molecules of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance, male sterility, yield, quality improvements, etc.). A change in genotype or phenotype may be transient or permanent. Also as used herein, a tissue sample is any sample that comprises more than one cell. In a preferred aspect, a tissue sample comprises cells that share a common characteristic (e.g. derived from leaf, root, or pollen etc).

In one sub-aspect, such an analysis is conducted by determining the presence and/or identity of polymorphism(s) by one or more of the nucleic acid molecules of the present invention and more specifically, one or more of the EST nucleic acid molecules or fragments thereof which are associated with phenotype, or a predisposition to phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist, and the polymorphism is thus said to be di-allelic. In other cases, the species' population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour, et al., *FEBS Lett.* 307:113-115 (1992); Jones, et al., *Eur. J. Haematol.* 39:144-147 (1987); Horn, et al., PCT Application WO91/14003; Jeffreys, European Patent Application 370,719; Jeffreys, U.S. Pat. No. 5,699,082; Jeffreys. et al., *Amer. J. Hum. Genet.* 39:11-24 (1986); Jeffreys. et al., *Nature* 316:76-79 (1985); Gray, et al., *Proc. R. Acad. Soc. Lond.* 243:241-253 (1991); Moore, et al., *Genomics* 10:654-660 (1991); Jeffreys, et al., *Anim. Genet.* 18:1-15 (1987); Hillel, et al., *Anim. Genet.* 20:145-155 (1989); Hillel, et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis, et al., *Cold Spring Harbor Symp. Quant. Biol.* 51:263-273 (1986); Erlich, et al., European Patent Appln. 50,424; European Patent Appln. 84,796, European Patent Application 258, 017, European Patent Appln. 237,362; Mullis, European Patent Appln. 201,184; Mullis, et al., U.S. Pat. No. 4,683,202; Erlich., U.S. Pat. No. 4,582,788; and Saiki, et al., U.S. Pat. No. 4,683,194, all of which are herein incorporated by reference), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci. (U.S.A)* 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren, et al., *Science* 241:1077-1080 (1988), herein incorporated by reference in its entirety). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson, et al. have described a nucleic acid detection assay that combines attributes of PCR and OLA (Nickerson, et al., *Proc. Natl. Acad. Sci. (U.S.A.)* 87:8923-8927 (1990), the entirety of which is herein incorporated by reference). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu, et al., *Genomics* 4:560 (1989), the entirety of which is herein incorporated by reference), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek, et al., U.S. Pat. No. 5,130,238; Davey, et al., European Patent Application 329,822; Schuster et al., U.S. Pat. No. 5,169,766; Miller, et al., PCT Application WO 89/06700; Kwoh, et al., *Proc. Natl. Acad. Sci. (U.S.A.)* 86:1173-1177 (1989); Gingeras, et al., PCT Application WO 88/10315; Walker, et al., *Proc. Natl. Acad. Sci. (U.S.A)* 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick, et al., *Cytogen. Cell Genet.* 32:58-67 (1982); Botstein, et al., *Ann. J. Hum. Genet.* 32:314-331 (1980); Fischer, et al. (PCT Application WO90/13668); Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996); Orita et al., *Genomics* 5: 874-879 (1989), both of which are herein incorporated by reference in their entirety). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205: 289-293 (1992), herein incorporated by reference in its entirety; Suzuki et al., *Anal. Biochem.* 192: 82-84 (1991), herein incorporated by reference in its entirety; Lo et al., *Nucleic Acids Research* 20: 1005-1009 (1992), herein incorporated by reference in its entirety, Sarkar et al., *Genomics* 13: 441-443 (1992), herein incorporated by reference in its entirety). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos, et al., *Nucleic Acids Res.* 23:4407-4414 (1995), the entirety of which is herein incorporated by reference. This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann, et al., *Mol. Ecol.* 6:989-993 (1997), the entirety of which is herein incorporated by reference); *Acinetobacter* (Janssen, et al., *Int. J. Syst. Bacteriol* 47:1179-1187 (1997), the entirety of which is herein incorporated by reference), *Aeromonas popoffi* (Huys, et al., *Int. J. Syst. Bacteriol.* 47:1165-1171 (1997), the entirety of which is herein incorporated by reference), rice (McCouch, et al., *Plant Mol. Biol.* 35:89-99 (1997), the entirety of which is herein incorporated by reference); Nandi, et al., *Mol. Gen. Genet.* 255:1-8 (1997); Cho, et al., *Genome* 39:373-378 (1996), herein incorporated by reference), barley (*Hordeum vulgare*) (Simons, et al., *Genomics* 44:61-70 (1997), the entirety of which is herein incorporated by reference; Waugh, et al., *Mol. Gen. Genet.* 255:311-321 (1997), the entirety of which is herein incorporated by reference; Qi, et al., *Mol. Gen. Genet.* 254:330-336 (1997), the entirety of which is herein incorporated by reference; Becker, et al., *Mol. Gen. Genet.* 249:65-73 (1995), the entirety of which is herein incorporated by reference), potato (Van der Voort, et al., *Mol. Gen. Genet.* 255:438-447 (1997), the entirety of which is herein incorporated by reference; Meksem, et al., *Mol. Gen. Genet.* 249:74-81 (1995), the entirety of which is herein incorporated by reference), *Phytophthora infestans* (Van der Lee, et al., *Fungal Genet. Biol.* 21:278-291 (1997), the entirety of which is herein incorporated by reference), *Bacillus anthracis* (Keim, et al., *J. Bacteriol.* 179:818-824 (1997)), *Astragalus cremnophylax* (Travis, et al., *Mol. Ecol.* 5:735-745 (1996), the entirety of which is herein incorporated by reference), *Arabidopsis* (Cnops, et al., *Mol. Gen. Genet.* 253:32-41 (1996), the entirety of which is herein incorporated by reference), *Escherichia coli* (Lin, et al., *Nucleic Acids Res.* 24:3649-3650 (1996), the entirety of which is herein incorporated by reference), *Aeromonas* (Huys, et al., *Int. J. Syst. Bacteriol.* 46:572-580 (1996), the entirety of which is herein incorporated by reference), nematode (Folkertsma, et al., *Mol. Plant Microbe Interact.* 9:47-54 (1996), the entirety of which is herein incorporated by reference), tomato (Thomas, et al., *Plant J.* 8:785-794 (1995), the entirety of which is herein incorporated by reference), and human (Latorra, et al., *PCR Methods Appl.* 3:351-358 (1994)). AFLP analysis has also been used for fingerprinting mRNA (Money, et al., *Nucleic Acids Res.* 24:2616-2617 (1996), the entirety of which is herein incorporated by reference; Bachem, et al., *Plant J.* 9:745-753 (1996), the entirety of which is herein incorporated by reference). It is understood that one or more of the nucleic acids of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res.* 18: 6531-6535 (1990), the entirety of which is herein incorporated by reference) and cleaveable amplified polymorphic sequences (CAPS) (Lyamichev et al., *Science* 260: 778-783 (1993), the entirety of which is herein incorporated by reference). It is understood that one or more of the nucleic acids of the present invention, may be utilized as markers or probes to detect polymorphisms by RAPD or CAPS analysis.

Polymorphisms are useful, through linkage analysis, to define the genetic distances or physical distances between polymorphic traits. A physical map or ordered array of genomic DNA fragments in the desired region containing the gene may be used to characterize and isolate genes corresponding to desirable traits. For this purpose, yeast artificial chromosomes (YACs), bacterial artificial chromosomes (BACs), and cosmids are appropriate vectors for cloning large segments of DNA molecules. Although fewer clones are needed to make a contig for a specific genomic region by using YACs (Agyare et al., *Genome Res.* 7: 1-9 (1997), the entirety of which is herein incorporated by reference; James et al., *Genomics* 32: 425-430 (1996), the entirety of which is herein incorporated by reference), chimerism in the inserted DNA fragment can arise. Cosmids are convenient for handling smaller-size DNA molecules and may be used for transformation in developing transgenic plants. BACs also carry DNA fragments and are less prone to chimerism.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use of non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which are herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), herein incorporated by reference in its entirety and Zeng, *Genetics* 136:1457-1468 (1994) herein incorporated by reference in its entirety. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), herein incorporated by reference in its entirety), thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping population is important to map construction. The choice of an appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), herein incorporated by reference in its entirety). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually $>F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.* (*U.S.A.*) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (*U.S.A.*) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (*U.S.A.*) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plant cells or tissues. Any source of nucleic acid may be used. Preferably, the nucleic acid is genomic DNA. The nucleic acid is subjected to restriction endonuclease digestion. For example, one or more EST nucleic acid molecule or fragment thereof can be used as a probe in accordance with the above-described polymorphic methods. The polymorphism obtained in this approach can then be cloned to identify the mutation at the coding region which alters the protein's structure or regulatory region of the gene which affects its expression level.

In one aspect of the present invention, an evaluation can be conducted to determine whether a particular mRNA molecule is present. One or more of the nucleic acid molecules of the present invention, preferably one or more of the EST nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101: 477-484 (1984); Angerer et al., *Dev. Biol.* 112: 157-166 (1985); Dixon et al., *EMBO J.* 10: 1317-1324 (1991), all of which are herein incorporated by reference in their entirety). In situ hybridization may be used to measure the steady-state level of RNA accumulation. It is a sensitive technique and RNA sequences present in as few as 5-10 copies per cell can be detected (Hardin et al., *J. Mol. Biol.* 202: 417-431.(1989), herein incorporated by reference in its entirety). A number of protocols have been devised for in situ hybridization, each with tissue preparation, hybridization, and washing conditions (Meyerowitz, *Plant Mol. Biol. Rep.* 5: 242-250 (1987); Cox and Goldberg, In: *Plant Molecular Biology: A Practical Approach* (ed. C. H. Shaw), pp. 1-35. IRL Press, Oxford (1988); Raikhel et al., *In situ RNA hybridization in plant tissues*. In *Plant Molecular Biology Manual*, vol. B9: 1-32. Kluwer Academic Publisher, Dordrecht, Belgium (1989), all of which are herein incorporated by reference in their entirety).

In situ hybridization also allows for the localization of proteins within a tissue or cell (Wilkinson, *In Situ Hybridization*, Oxford University Press, Oxford (1992); Langdale, *In Situ Hybridization* 165-179 In: *The Maize Handbook*, eds. Freeling and Walbot, Springer-Verlag, New York (1994), both of which are herein incorporated by reference in their entirety). It is understood that one or more of the molecules of the present invention, preferably one or more of the EST nucleic acid molecules of the present invention or one or more of the antibodies of the present invention may be utilized to detect the level or pattern of a protein or fragment thereof by in situ hybridization.

Fluorescent in situ hybridization also enables the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17: 101-109 (1991); Gustafson et al., *Proc. Nat'l. Acad. Sci.* (*U.S.A*). 87: 1899-1902 (1990); Mukai and Gill, *Genome* 34: 448-452. (1991); Schwarzacher and Heslop-Harrison, *Genome* 34: 317-323 (1991); Wang et al., *Jpn. J. Genet.* 66: 313-316 (1991); Parra and Windle, *Nature Genetics,* 5: 17-21 (1993), all of which are herein incorporated by reference in their entirety). It is understood that the nucleic acid molecules of the present invention may be used as probes or markers to localize sequences along a chromosome.

It is also understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of an organ is pressed gently onto nitrocellulose paper, nylon membrane or polyvinylidene difluoride membrane. Such membranes are commercially available (e.g. Millipore, Bedford, Mass.). The contents of the cut cell transfer onto the membrane, and the molecules are immobilized to the membrane. The immobilized molecules form a latent print that can be visualized with appropriate probes. When a plant tissue print is made on nitrocellulose paper, the cell walls leave a physical print that makes the anatomy visible without further treatment (Varner and Taylor, *Plant Physiol.* 91: 31-33 (1989), the entirety of which is herein incorporated by reference).

Tissue printing on substrate films is described by Daoust, *Exp. Cell Res.* 12: 203-211 (1957), herein incorporated by reference in its entirety, who detected amylase, protease, ribonuclease, and deoxyribonuclease in animal tissues using starch, gelatin, and agar films. These techniques can be applied to plant tissues (Yomo and Taylor, *Planta* 112:35-43 (1973); Harris and Chrispeels, *Plant Physiol.* 56: 292-299 (1975), both of which are herein incorporated by reference in their entirety). Advances in membrane technology have increased the range of applications of Daoust's tissue-printing techniques allowing (Cassab and Varner, *J. Cell. Biol.* 105: 2581-2588 (1987), the entirety of which is herein incorporated by reference; the histochemical localization of various plant enzymes and deoxyribonuclease on nitrocellulose paper and nylon (Spruce et al., *Phytochemistry,* 26: 2901-2903 (1987); Barres et al. *Neuron* 5: 527-544 (1990); Reid and Pont-Lezica, *Tissue Printing: Tools for the Study of Anatomy, Histochemistry, and Gene Expression*, Academic Press, New York, N.Y. (1992); Reid et al. *Plant Physiol.* 93: 160-165 (1990); Ye et al. *Plant J.* 1: 175-183 (1991), all of which are herein incorporated by reference in their entirety).

It is understood that one or more of the molecules of the present invention, preferably one or more of the EST nucleic acid molecules of the present invention or one or more of the antibodies of the present invention may be utilized to detect the presence or quantity of a protein by tissue printing.

Further, it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) or a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270: 467-470 (1995); Shalon, Ph.D. Thesis. Stanford University (1996), both of which are herein incorporated by reference in their entirety). Every nucleotide in a large sequence can be queried at the same time. Hybridization can be used to efficiently analyze large amounts of nucleotide sequence.

Several microarray methods have been described. One method compares the sequences to be analyzed by hybridization to a set of oligonucleotides representing all possible subsequences (Bains and Smith, *J. Theor. Biol.* 135: 303 (1989), the entirety of which is herein incorporated by reference). A second method hybridizes the sample to an array of oligonucleotide probes. An array consisting of oligonucleotides complementary to subsequences of a target sequence can be used to determine the identity of a target sequence, measure its amount, and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. Nos. 5,445,934; 5,143,854; 5,079,600; 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. Implementation of these techniques rely on recently developed combinatorial technologies to generate any ordered array of a large number of oligonucleotide probes (Fodor et al., *Science* 251:767-773 (1991), the entirety of which is herein incorporated by reference).

It is understood that one or more of the molecules of the present invention, preferably one or more of the nucleic acid molecules or protein molecules or fragments thereof of the present invention may be utilized in a microarray based method.

In a preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules that specifically hybridize to one or more nucleic acid molecule having a nucleic acid sequence selected from the group of SEQ ID NO: 1 through SEQ ID NO: 25978 or complement thereof or fragments of either.

A particular preferred microarray embodiment of the present invention is a microarray comprising nucleic acid molecules encoding genes or fragments thereof that are homologues of known genes or nucleic acid molecules that comprise genes or fragment thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34:315-23 (1985), the entirety of which is herein incorporated by reference), primer extension (Gilliam et al., *Gene* 12:129-137 (1980), the entirety of which is herein incorporated by reference); Zoller and Smith, *Methods Enzymol.* 100:468-500 (1983), the entirety of which is herein incorporated by reference; and Dalbadie-McFarland et al., *Proc. Natl. Acad. Sci. (U.S.A.)* 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site-directed mutagenesis approaches are also described in European Patent 0 385 962, the entirety of which is herein incorporated by reference, European Patent 0 359 472, the entirety of which is herein incorporated by reference, and PCT Patent Application WO 93/07278, the entirety of which is herein incorporated by reference.

Site-directed mutagenesis strategies have been applied to plants for both in vitro as well as in vivo site-directed mutagenesis (Lanz et al., *J. Biol. Chem.* 266:9971-6 (1991); Kovgan and Zhdanov, *Biotekhnologiya* 5:148-154; No. 207160n, Chemical Abstracts 110:225 (1989); Ge et al., *Proc. Natl. Acad. Sci. (U.S.A.)* 86:4037-4041 (1989); Zhu et al., *J. Biol. Chem.* 271:18494-18498 (1996); Chu et al., *Biochemistry* 33:6150-6157 (1994); Small et al., *EMBO J.* 11:1291-1296 (1992); Cho et al., *Mol. Biotechnol.* 8:13-16 (1997); Kita et al., *J. Biol. Chem.* 271:26529-26535 (1996); Jin et al., *Mol. Microbiol.* 7:555-562 (1993); Hatfield and Vierstra, *J. Biol. Chem.* 267:14799-14803 (1992); Zhao et al., *Biochemistry* 31:5093-5099 (1992), all of which are herein incorporated by reference in their entirety).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), herein incorporated by reference in its entirety) and molecular biochemical approaches, including the screening of recombinant cDNA libraries with antibodies (Landschulz et al., *Genes Dev.* 2: 786-800 (1988), herein incorporated by reference in its entirety) or DNA probes (Bodner et al., *Cell* 55: 505-518 (1988), herein incorporated by reference in its entirety). In addition, an in situ screening procedure has been used and has facilitated the isolation of sequence-specific DNA-binding proteins from various plant species (Gilmartin et al., *Plant Cell* 4: 839-849 (1992); Schindler et al., *EMBO J.* 11: 1261-1273 (1992) both of which are herein incorporated by reference in their entirety). An in situ screening protocol does not require the purification of the protein of interest (Vinson et al., *Genes Dev.* 2: 801-806 (1988); Singh et al., *Cell* 52: 415-423 (1988), both of which are herein incorporated by reference in their entirety).

Steps may be employed to characterize DNA-protein interactions. The first is to identify promoter fragments that interact with DNA-binding proteins, to titrate binding activity, to determine the specificity of binding, and to determine whether a given DNA-binding activity can interact with related DNA sequences (Sambrook et al., *Molecular Cloning: A Laboratory Manual*, $2^{nd}$ edition. Cold Spring Harbor Laboratory Press, Cold Spring Harbor, N.Y. (1989). Electrophoretic mobility-shift assay is a widely used assay. The assay provides a simple, rapid, and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9: 6505-6525 (1981), herein incorporated by reference in its entirety). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65: 499-560 (1980); Wissman and Hillen, *Methods Enzymol.* 208: 365-379 (1991), both of which are herein incorporated by reference in their entirety) and footprinting techniques employing DNase I (Galas and Schmitz, *Nucleic Acids Res.* 5: 3157-3170 (1978), herein incorporated by reference in its entirety), 1,10-phenanthroline-copper ion methods (Sigman et al., *Methods Enzymol.* 208: 365-379 (1991), herein incorporated by reference in its entirety) or hydroxyl radical methods (Dixon et al., *Methods Enzymol.* 208: 380-413 (1991), herein incorporated by reference in its entirety). It is understood that one or more of the nucleic acid molecules of the present invention, preferably one or more of the EST nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

The two-hybrid system is based on the fact that many cellular functions are carried out by proteins that interact (physically) with one another. Two-hybrid systems have been used to probe the function of new proteins (Chien et al., *Proc. Natl. Acad. Sci. (U.S.A.)* 88: 9578-9582 (1991); Durfee et al., *Genes Dev.* 7: 555-569 (1993); Choi et al., *Cell* 78: 499-512 (1994); Kranz et al., *Genes Dev.* 8: 313-327 (1994), all of which are herein incorporated by reference in their entirety).

Interaction mating techniques have facilitated a number of two-hybrid studies of protein-protein interaction. Interaction mating has been used to examine interactions between small sets of tens of proteins (Finley and Brent, *Proc. Natl. Acad. Sci. (U.S.A.)* 91: 12098-12984 (1994), herein incorporated by reference in its entirety), larger sets of hundreds of proteins, (Bendixen et al., *Nucl. Acids Res.* 22: 1778-1779 (1994), herein incorporated by reference in its entirety) and to comprehensively map proteins encoded by a small genome (Bartel et al., *Nature Genetics* 12: 72-77 (1996), herein incorporated by reference in its entirety). This technique utilizes proteins fused to the DNA-binding domain and proteins fused to the activation domain. They are expressed in two different haploid yeast strains of opposite mating type, and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. The primary advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

*Synechocystis* 6803 is a photosynthetic Cyanobacterium capable of oxygenic photosynthesis as well as heterotrophic growth in the absence of light. The entire genome has been sequenced, and it is reported to have a circular genome size of 3.57 Mbp containing 3168 potential open reading frames. Open reading frames (ORFs) were identified based upon their homology to other reported ORFs and by using ORF identification computer programs. Sixteen hundred potential ORFs were assigned based on their homology to previously identified ORFs. Of these 1600 ORFs, 145 were identical to reported ORFs (Kaneko et al., *DNA Research* 3:109-36 (1996), herein incorporated by reference in its entirety).

Several prokaryote promoters have been used in *Synechocystis* to express heterologous genes including the tac, lac, and lambda phage promoters (Bryant (ed.), *The Molecular Biology of Cyanobacteria*, Kluwer Academic Publishers, (1994); Ferino and Chauvat, *Gene* 84:257-266 (1989), both of which are herein incorporated by reference in their entirety). Several bacterial origins of replication such as RSF1010 and ACYC are reported to replicate in *Synechocystis* (Mermet-Bouvier and Chauvat, *Current Microbiology* 28:145-148 (1994); Kuhlemeier et al., *Mol. Gen. Genet.* 184:249-254 (1981), both of which are herein incorporated by reference in their entirety).

*Synechocystis* has been used to study gene regulation by gene replacement through homologous recombination or by gene disruption using antibiotic resistance markers (Pakrasi et al., *EMBO* 7:325-332 (1988), herein incorporated by reference in its entirety). In such gene regulation studies, double reciprocal homologous regions of the host genome flanking the gene of interest recombine to stably integrate the gene of interest into the genome. The gene of interest can be expressed once that gene has been stably integrated into the genome. Biochemical analysis can be performed to study the effect of the replaced or deleted gene.

It is understood that the agents of the present invention may be employed in a *Synechocystis* system.

Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including but not limited to the crops, maize and soybean (See specifically, Chistou, *Particle Bombardment for Genetic Engineering of Plants*, pp 63-69 (maize), pp 50-60 (soybean), Biotechnology Intelligence Unit. Academic Press, San Diego, Calif. (1996), the entirety of which is herein incorporated by reference and generally Chistou, *Particle Bombardment for Genetic Engineering of Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material.

Exogenous genetic material may be transferred into a plant cell by the use of a DNA vector or construct designed for such a purpose. Design of such a vector is generally within the skill of the art (See, Plant Molecular Biology: A Laboratory Manual eds. Clark, Springer, New York (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci.* (*U.S.A.*) 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.* (*U.S.A.*) 84:6624-6628 (1987), the entirety of which is herein incorporated by reference), the sucrose synthase promoter (Yang et al., *Proc. Natl. Acad. Sci.* (*U.S.A.*) 87:4144-4148 (1990), the entirety of which is herein incorporated by reference), the R gene complex promoter (Chandler et al., *The Plant Cell* 1:1175-1183 (1989), the entirety of which is herein incorporated by reference), and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of a protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci.* (*U.S.A.*) 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci.* (*U.S.A.*) 90: 9586-9590 (1993), herein incorporated by reference in its entirety), the promoter for the tobacco Lhcb1*2 gene (Cerdan et al., *Plant Mol. Biol.* 33: 245-255. (1997), herein incorporated by reference in its entirety), the *Arabidopsis thaliana* SUC2 sucrose-H+ symporter promoter (Truernit et al., *Planta.* 196: 564-570 (1995), herein incorporated by reference in its entirety), and the promoter for the thylacoid membrane proteins from spinach (psaD, psaF, psaE, PC, FNR, atpC, atpD, cab, rbcS). Other promoters for the chlorophyl a/b-binding proteins may also be utilized in the present invention, such as the promoters for LhcB gene and PsbP gene from white mustard (*Sinapis alba*; Kretsch et al., *Plant Mol. Biol.* 28: 219-229 (1995), the entirety of which is herein incorporated by reference).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8: 1899-1906 (1986); Jefferson et al., *Plant Mol. Biol.* 14: 995-1006 (1990), both of which are herein incorporated by reference in its entirety), the promoter for the potato tuber ADPGPP genes, both the large and small subunits, the sucrose synthase promoter (Salanoubat and Belliard, *Gene.* 60: 47-56 (1987), Salanoubat and Belliard, *Gene.* 84: 181-185 (1989), both of which are incorporated by reference in their entirety), the promoter for the major tuber proteins including the 22 kd protein complexes and proteinase inhibitors (Hannapel, *Plant Physiol.* 101: 703-704 (1993), herein incorporated by reference in its entirety), the promoter for the granule bound starch synthase gene (GBSS) (Visser et al., *Plant Mol. Biol.* 17: 691-699 (1991), herein incorporated by reference in its entirety), and other class I and II patatins promoters (Koster-Topfer et al., *Mol Gen Genet.* 219: 390-396 (1989); Mignery et al., *Gene.* 62: 27-44 (1988), both of which are herein incorporated by reference in their entirety).

Other promoters can also be used to express a fructose 1,6 bisphosphate aldolase gene in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29: 1015-1026 (1982), herein incorporated by reference in its entierty), and the promoters from these clones, including the 15 kD, 16 kD, 19 kD, 22 kD, 27 kD, and gamma genes, could also be used. Other promoters known to function, for example, in maize, include the promoters for the following genes: waxy, Brittle, Shrunken 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell. Biol.* 13: 5829-5842 (1993), herein incorporated by reference in its entirety). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant Mol. Biol.* 25: 587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. (U.S.A.)* 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619, 5,391,725, 5,428, 147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., Plant Physiol. 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5: 387-405 (1987), the entirety of which is herein incorporated by reference; Jefferson et al., *EMBO J.* 6: 3901-3907 (1987), the entirety of which is herein incorporated by reference); an R-locus gene, which encodes a product that regulates the production of anthocyanin pigments (red color) in plant tissues ((Dellaporta et al., Stadler Symposium 11:263-282 (1988), the entirety of which is herein incorporated by reference); a β-lactamase gene (Sutcliffe et al., *Proc. Natl. Acad. Sci.* (*U.S.A.*) 75: 3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234: 856-859 (1986), the entirety of which is herein incorporated by reference) a xy1E gene (Zukowsky et al., *Proc. Natl. Acad. Sci.* (*U.S.A.*) 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a scriptable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR—S). Other possible selectable and/or screenable marker genes will be apparent to those of skill in the art.

Methods and compositions for transforming a bacteria and other microorganisms are known in the art (see for example Sambrook et al., *Molecular Cloning: A Laboratory Manual*, Second Edition, Cold Spring Harbor Laboratory Press, Cold Spring Harbor, N.Y., (1989), the entirety of which is herein incorporated by reference).

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Pottykus, *Ann. Rev. Plant Physiol. Plant Mol. Biol.* 42:205-225 (1991), the entirety of which is herein incorporated by reference; Vasil, *Plant Mol. Biol.* 25: 925-937 (1994), the entirety of which is herein incorporated by reference. For example, electroporation has been used to transform maize protoplasts (Fromm et al., *Nature* 312:791-793 (1986), the entirety of which is herein incorporated by reference).

Other vector systems suitable for introducing transforming DNA into a host plant cell includes but is not limited to binary artificial chromosome (BIBAC) vectors (Hamilton et al., *Gene* 200:107-116, (1997), the entirety of which is herein incorporated by reference, and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference.

Technology for introduction of DNA into cells is well known to those of skill in the art. Four general methods for delivering a gene into cells have been described: (1) chemical methods (Graham and van der Eb, *Virology*, 54:536-539 (1973), the entirety of which is herein incorporated by reference); (2) physical methods such as microinjection (Capecchi, *Cell* 22:479-488 (1980), electroporation (Wong and Neumann, *Biochem. Biophys. Res. Commun.*, 107:584-587 (1982); Fromm et al., *Proc. Natl. Acad. Sci. USA*, 82:5824-5828 (1985); U.S. Pat. No. 5,384,253; and the gene gun (Johnston and Tang, *Methods Cell Biol.* 43:353-365 (1994), all of which the entirety is herein incorporated by reference; (3) viral vectors (Clapp, *Clin. Perinatol.*, 20:155-168 (1993); Lu et al., *J. Exp. Med.*, 178:2089-2096 (1993); Eglitis and Anderson, *Biotechniques*, 6:608-614 (1988), all of which the entirety is herein incorporated by reference); and (4) receptor-mediated mechanisms (Curiel et al., *Hum. Gen. Ther.*, 3:147-154 (1992); Wagner et al., *Proc. Natl. Acad. Sci. USA*, 89:6099-6103 (1992), all of which the entirety is herein incorporated by reference).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988), the entirety of which is herein incorporated by reference) nor the susceptibility of *Agrobacterium* infection is required. An illustrative embodiment of a method for delivering DNA into maize cells by acceleration is a biolistics g-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2: 603-618 (1990), the entirety of which is herein incorporated by reference). The screen disperses the tungsten nucleic acid particles so that they are not delivered to the recipient cells in large aggregates.

A particle delivery system suitable for use with the present invention is the helium acceleration PDS-1000/He gun which is available from Bio-Rad Laboratories (Bio-Rad, Hercules, Calif.) (Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos. In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (*U.S.A*) 87:8526-8530 (1990); Svab and Maliga, *Proc. Natl. Acad. Sci.* (*U.S.A.*) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described (Fraley et al., *Biotechnology* 3:629-635 (1985); Rogers et al., *Meth. In Enzymol,* 153:253-277 (1987), both of which are herein incorporated by reference in their entirety. Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.,* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., *In: Plant DNA Infectious Agents*, T. Hohn and J. Schell, eds., Springer-Verlag, New York, pp. 179-203 (1985), the entirety of which is herein incorporated by reference. Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multilinker regions flanked by a promoter and a polyadenylation site for direct expression of inserted polypeptide coding genes and are suitable for present purposes (Rogers et al., *Meth. In Enzymol.,* 153:253-277 (1987), the entirety of which is herein incorporated by reference). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and outcrossing with a non-transgenic plant are also contemplated, as is vegetative propagation.

Transformation of plant protoplasts can be achieved using methods based on calcium phosphate precipitation, polyethylene glycol treatment, electroporation, and combinations of these treatments. See for example (Potrykus et al., *Mol. Gen. Genet.,* 205:193-200 (1986); Lorz et al., *Mol. Gen. Genet.,* 199:178, (1985); Fromm et al., *Nature,* 319:791, (1986); Uchimiya et al., *Mol. Gen. Genet.:*204:204, (1986); Callis et al., *Genes and Development,* 1183, (1987); Marcotte et al., *Nature,* 335:454, (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., *Plant Tissue Culture Letters,* 2:74, (1985); Toriyama et al., *Theor Appl. Genet.* 205:34. (1986); Yamada et al., *Plant Cell*

*Rep.,* 4:85, (1986); Abdullah et al., *Biotechnology,* 4:1087, (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology,* 6:397, (1988), the entirety of which is herein incorporated by reference). In addition, "particle gun" or high-velocity microprojectile technology can be utilized (Vasil et al., *Bio/Technology* 10:667, (1992), the entirety of which is herein incorporated by reference).

Using the latter technology, DNA is carried through the cell wall and into the cytoplasm on the surface of small metal particles as described (Klein et al., *Nature,* 328:70, (1987); Klein et al., *Proc. Natl. Acad. Sci. USA,* 85:8502-8505, (1988); McCabe et al., *Biotechnology,* 6:923, (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.,* 107:367, (1987); Luo et al., *Plant Mol Biol. Reporter,* 6:165, (1988), all of which are herein incorporated by reference in their entirety), by direct injection of DNA into reproductive organs of a plant (Pena et al., Nature, 325:274, (1987), the entirety of which is herein incorporated by reference), or by direct injection of DNA into the cells of immature embryos followed by the rehydration of dessicated embryos (Neuhaus et al., *Theor. Appl. Genet.,* 75:30, (1987), the entirety of which is herein incorporated by reference).

The regeneration, development, and cultivation of plants from single plant protoplast transformants or from various transformed explants is well known in the art (Weissbach and Weissbach, *In: Methods for Plant Molecular Biology,* (Eds.), Academic Press, Inc. San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. Nos. 5,004,863, 5,159,135, 5,518,908, all of which the entirety is herein incorporated by reference); soybean (U.S. Pat. Nos. 5,569,834, 5,416,011, McCabe et al., *Biotechnology* 6:923, (1988), Christou et al., *Plant Physiol.,* 87:671-674 (1988), all of which are herein incorporated by reference in their entirety); *Brassica* (U.S. Pat. No. 5,463,174, the entirety of which is herein incorporated by reference); peanut (Cheng et al., *Plant Cell Rep.* 15: 653-657 (1996), McKently et al., *Plant Cell Rep.* 14:699-703 (1995), all of which are herein incorporated by reference in their entirety); papaya (Yang et al., (1996), the entirety of which is herein incorporated by reference); pea (Grant et al., *Plant Cell Rep.* 15:254-258, (1995), the entirety of which is herein incorporated by reference).

Transformation of monocotyledons using electroporation, particle bombardment, and *Agrobacterium* have also been reported. Transformation and plant regeneration have been achieved in asparagus (Bytebier et al., *Proc. Natl. Acad. Sci. USA* 84:5345, (1987), the entirety of which is herein incorporated by reference); barley (Wan and Lemaux, *Plant Physiol* 104:37, (1994), the entirety of which is herein incorporated by reference); maize (Rhodes et al., *Science* 240: 204, (1988), Gordon-Kamm et al., *Plant Cell,* 2:603, (1990), Fromm et al., *Bio/Technology* 8:833, (1990), Koziel et al., *Bio/Technology* 11:194, (1993), Armstrong et al., *Crop Science* 35:550-557, (1995), all of which the entirety is herein incorporated by reference); oat (Somers et al., *Bio/Technology,* 10:1589, (1992), the entirety of which is herein incorporated by reference); orchardgrass (Horn et al., *Plant Cell Rep.* 7:469, (1988), the entirety of which is herein incorporated by reference); rice (Toriyama et al., *Theor Appl. Genet.* 205:34, (1986); Park et al., *Plant Mol. Biol.,* 32: 1135-1148, (1996); Abedinia et al., *Aust. J. Plant Physiol.*24:133-141, (1997); Zhang and Wu, *Theor. Appl. Genet.* 76:835, (1988); Zhang et al. *Plant Cell Rep.* 7:379, (1988); Battraw and Hall, *Plant Sci.* 86:191-202, (1992); Christou et al., *Bio/Technology* 9:957, (1991), all of which are herein incorporated by reference in its entirety); sugarcane (Bower and Birch, Plant J. 2:409, (1992), the entirety of which is herein incorporated by reference); tall fescue (Wang et al., Bio/Technology 10:691, (1992), the entirety of which is herein incorporated by reference), and wheat (Vasil et al., Bio/Technology 10:667, (1992); U.S. Pat. No. 5,631,152, both of which are herein incorporated by reference in their entirety).

Assays for gene expression based on the transient expression of cloned nucleic acid constructs have been developed by introducing the nucleic acid molecules into plant cells by polyethylene glycol treatment, electroporation, or particle bombardment (Marcotte, et al., *Nature,* 335: 454-457 (1988); Marcotte, et al., *Plant Cell,* 1: 523-532 (1989); McCarty, et al., *Cell* 66: 895-905 (1991); Hattori, et al., *Genes Dev.* 6: 609-618 (1992); Goff, et al., *EMBO J.* 9: 2517-2522 (1990), all of which are herein incorporated by reference in their entirety). Transient expression systems may be used to functionally dissect gene constructs (See generally, Mailga et al., *Methods in Plant Molecular Biology,* Cold Spring Harbor Press (1995)).

Any of the nucleic acid molecules of the present invention may be introduced into a plant cell in a permanent or transient manner in combination with other genetic elements such as vectors, promoters enhancers etc. Further any of the nucleic acid molecules of the present invention may be introduced into a plant cell in a manner that allows for over expression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2: 279-289 (1990); van der Krol et al., *Plant Cell* 2: 291-299 (1990), both of which are herein incorporated by reference in their entirety). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244: 325-330 (1994), the entirety of which is herein incorporated by reference). Genes, even though different, linked to homologous promoters may result in the cosuppression of the linked genes (Vaucheret, *C.R. Acad. Sci. III* 316: 1471-1483 (1993), the entirety of which is herein incorporated by reference).

This technique has, for example been applied to generate white flowers from red petunia and tomatoes that do not ripen on the vine. Up to 50% of petunia transformants that contained a sense copy of the chalcone synthase (CHS) gene produced white flowers or floral sectors; this was as a result of the post-transcriptional loss of mRNA encoding CHS (Flavell, *Proc. Natl. Acad. Sci. (U.S.A.)* 91:3490-3496 (1994)), the entirety of which is herein incorporated by reference). Cosuppression may require the coordinate transcription of the transgene and the endogenous gene, and can be reset by a developmental control mechanism (Jorgensen, *Trends Biotechnol,* 8:340344 (1990); Meins and Kunz, In: *Gene Inactivation and Homologous Recombination in Plants* (Paszkowski, J., ed.), pp. 335-348. Kluwer Academic, Netherlands (1994), both of which are herein incorporated by reference in their entirety).

It is understood that one or more of the nucleic acids of the present invention including those comprising SEQ ID NO:1 through SEQ ID NO:25978 or complement thereof or fragments of either or other nucleic acid molecules of the present invention may be introduced into a plant cell and transcribed using an appropriate promoter with such transcription resulting in the co-suppression of an endogenous protein.

Antisense approaches are a way of preventing or reducing gene function by targeting the genetic material (Mol et al., *FEBS Lett.* 268: 427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., *In Genetic Engineering,* Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55: 569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25: 155-184 (1990), the entirety of which is herein incorporated by reference). An antisense vector is constructed by standard procedures and introduced into cells by transformation, transfection, electroporation, microinjection, or by infection, etc. The type of transformation and choice of vector will determine whether expression is transient or stable. The promoter used for the antisense gene may influence the level, timing, tissue, specificity, or inducibility of the antisense inhibition.

It is understood that protein synthesis activity in a plant cell may be reduced or depressed by growing a transformed plant cell containing a nucleic acid molecule whose non-transcribed strand encodes a protein or fragment thereof.

Antibodies have been expressed in plants (Hiatt et al., *Nature* 342:76-78 (1989); Conrad and Fielder, *Plant Mol. Biol.* 26: 1023-1030 (1994), both of which are herein incorporated by reference in their entirety). Cytoplamic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16: 4489-4496 (1997); Marion-Poll, *Trends in Plant Science* 2: 447-448 (1997), all of which are herein incorporated by reference in their entirety). For example, expressed anti-abscisic antibodies reportedly result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997); Baca et al., *Ann. Rev. Biophys. Biomol. Struct.* 26:461-493 (1997), both of which are herein incorporated by reference in their entirety). The catalytic abilities of abzymes may be enhanced by site directed mutagensis. Examples of abzymes are, for example, set forth in U.S. Pat. Nos. 5,658,753; 5,632,990; 5,631,137; 5,602,015; 5,559,538; 5,576,174; 5,500,358; 5,318,897; 5,298,409; 5,258,289 and 5,194,585, all of which are herein incorporated in their entirety.

It is understood that any of the antibodies of the present invention may be expressed in plants and that such expression can result in a physiological effect. It is also understood that any of the expressed antibodies may be catalytic.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual,* Cold Spring Harbor Press (1989); Mailga et al., *Methods in Plant Molecular Biology,* Cold Spring Harbor Press (1995); Birren et al., *Genome Analysis: Analyzing DNA,* 1, Cold Spring Harbor, N.Y., all of which are herein incorporated by reference in their entirety).

The nucleotide sequence provided in SEQ ID NO:1, through SEQ ID NO:25978 or fragment thereof, or complement thereof, or a nucleotide sequence at least 90% identical, preferably 95%, identical even more preferably 99% or 100% identical to the sequence provided in SEQ ID NO:1 through SEQ ID NO:25978 or fragment thereof, or complement thereof, can be "provided" in a variety of mediums to facilitate use fragment thereof. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences or sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention. Having now generally described the invention, the same will be more readily understood through reference to the following examples which are provided by way of illustration, and are not intended to be limiting of the present invention, unless specified.

EXAMPLE 1

The LIB3217 cDNA library is generated from root tissue harvested from cotton plants 15 days after planting. The *Gossypium hirsutum* variety Nucotton33B is used for collection. Seeds are planted in trays containing Metromix 350 potting soil premixed with fertilizers. Plants are grown in a greenhouse in 16 hr day/8 hr night cycles with an average relative humidity of ca. 50%. Daytime and night time temperature are 90° F. and 74° F. respectively. Daytime light levels are measured at 600-1000 µEinsteins/m$^2$. Plants are watered daily in the morning and as needed in the afternoon. Plants receive 1 or 2 applications of Pix to control excessive growth. Roots are harvested from plants 15 days after planting. Plants are unpotted, soil is rinsed off, roots are briefly blotted and entire root systems are collected. The harvested root tissue is immediately frozen in liquid nitrogen and then stored at −80° C. until total RNA preparation. The RNA is prepared from the stored tissue and the cDNA library is constructed as described in Example 2.

The LIB3218 cDNA library is generated from floral bud-flower tissue harvested from cotton plants 2 months after planting. The *Gossypium hirsutum* variety Maxxa is used for collection. Seeds are planted in trays containing Metromix 350 potting soil premixed with fertilizers. Plants are grown in a greenhouse in 16 hr day/8 hr night cycles with an average relative humidity of ca. 50%. Daytime and night time temperature are 90° F. and 74° F. respectively. Daytime light levels are measured at 600-1000 µEinsteins/m$^2$. Plants are watered daily in the morning and as needed in the afternoon. Plants receive 1 or 2 applications of Pix to control excessive growth. Floral buds from medium stage to open flower are removed from plants about 2 months after planting. Bracts are removed and floral bud-flower tissue is immediately frozen in liquid nitrogen and then stored at −80° C. until total RNA preparation. The RNA is prepared from the stored tissue and the cDNA library is constructed as described in Example 2.

The LIB3219 cDNA library is generated from floral bud-flower tissue harvested from cotton plants 2 months after planting. The *Gossypium hirsutum* variety Nucotton33B is used for collection. Seeds are planted in trays containing Metromix 350 potting soil premixed with fertilizers. Plants are grown in a greenhouse in 16 hr day/8 hr night cycles with an average relative humidity of ca. 50%. Daytime and night time temperature are 90° F. and 74° F. respectively. Daytime light levels are measured at 600-1000 µEinsteins/m$^2$. Plants are watered daily in the morning and as needed in the afternoon. Plants receive 1 or 2 applications of Pix to control excessive growth. Floral buds from medium stage to open flowers are removed from plants about 2 months after planting. Bracts are removed and floral bud-flower tissue is immediately frozen in liquid nitrogen and then stored at −80° C. until total RNA preparation. The RNA is prepared from the stored tissue and the cDNA library is constructed as described in Example 2.

The LIB3272 cDNA library is generated from non-embryogenic callus. The Callus is derived from hypocotyls from Coker 312 seedlings and generated on standard agar medium using 0.1 mg/l 2,4-D plus 0.5 mg/l kinetin. At about 6-7 weeks, callus is removed from plates and immediately frozen in liquid nitrogen. The harvested tissue is stored at −80° C. until total RNA preparation. The RNA is prepared from the stored tissue and the cDNA library is constructed as described in Example 2.

EXAMPLE 2

For RNA preparation, the stored cotton tissue is grounded thoroughly in liquid nitrogen and then incubated with a high SDS solution (about 2.5% SDS by weight, 0.1 M Tris-HCl (pH7.5), 2.5 M sodium perchlorate, 0.1% β-mercaptoethanol by volume) and insoluble PVPP (about 8.5% by weight) for about 30 minutes at the room temperature. Nucleic acids are then precipitated after filtration. The total RNA is isolated from the precipitate using Trizol TRIZOL® (phenol—guanidine isothiocyanate) reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer ((DYNABEADS®, Dynal Corporation, Lake Success, N.Y. U.S.A.).

Construction of plant cDNA libraries is well-known in the art and a number of cloning strategies exist. A number of cDNA library construction kits are commercially available. The SUPERSCRIPT™ Plasmid System for cDNA synthesis and Plasmid Cloning (Gibco BRL, Life Technologies, Gaithersburg, Md. U.S.A.) is used, following the conditions suggested by the manufacturer.

EXAMPLE 3

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

The template plasmid DNA clones are used for subsequent sequencing. For sequencing the cDNA libraries LIB3217, LIB3218, LIB3219, and LIB3272, a commercially available sequencing kit, such as the ABI PRISM® dRhodamine Terminator Cycle Sequencing Ready Reaction Kit with AMPLI-TAQ® DNA Polymerase, FS, is used under the conditions recommended by the manufacturer (PE Applied Biosystems, Foster City, Calif.). The ESTs of the present invention are generated by sequencing initiated from the 5' end of each cDNA clone.

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City,

SEQUENCE LISTING (25978 sequences)

SEQ ID NO: 1 - DNA, 759 bp, Gossypium hirsutum
  Clone ID: uc-gsronu33B046C09_FLI
gtggaaactccaattcctcaagctcctcgcagcttcagaactctgggtctgaagaggacctgcaccagcagaatatgatggaccaaagaaaaagaaagagaaaggaatctaacagggaatcggcaagaagatccaggatgaggaaacagcagcacttggatgaattagtggcccaagtggctcagctcagcaaagaaaacaaccaaatcctgaacagcatcaacttcaccacccaccactatctcaacattcaggctgagaactcggttctgagggctcagatgatggaactgagtcaaagactcgactatctgaatcaaatcctcagttatctcaacaccatgagcgccagtgagttggtgtacgaaactgatcagtgctttgaaacaagtacttgtgaccacggtttcaccaagcctttccatctaccttaccttaaccaacccatcatggcctctccagacatgttccagtactactgatccataataatcctcaccaccatcatccctcattttcttataaaacgagggtattaatataatattattgttatggttaattaatttaatgaaatattagtgttattggcagctataggtctaggaagatgatgtaagggatgatgattgtgagagaattggcaagtagcaagtgaaagctgcttggcatgggatgcaattttttattatcaattttcttcttgtaaatggggatttgagatataaaatagggtttgatgtttgacgggttttctgg

SEQ ID NO: 2 - DNA, 431 bp, Gossypium hirsutum
  Clone ID: uC-gsronu33B002a01b1
cttttcccatgaaggagatggtccaactaccgtgactgggaacctttctggtcttaaggccggactccatggcttccatgttcatgcccttggggacataactaacgggtgcatgtcaactggaccccattttaatcctgctggcaaagagcatggtgctcccgaagatgagaaccgccatgctggtgatctaggaaatgtcactgttggtgatgatggctgtgctagcttctccatcaccgacaaacagattccactcacaggcccaaactccattatcggaagagctgtagttgtccatgcagatcccgatgaccttggcaagggcggccatgagctcagcaaaagcacaggaaatgctggcggcagagtagcttgcggtattattggtctgcaaggctaaaatccgagcccaatgcgtttgaaggatg

SEQ ID NO: 3 - DNA, 163 bp, Gossypium hirsutum
  Clone ID: uC-gsronu33B002a02b1
catatgacataagaaggtagcatttgtcaggaatggtctgtatggattacaaaatctcaaaagtacatacttccccatgtccatcttcttgtacctcaaagtcgcatttgcatagaaatttctgcaatctatcaagaatagtaaagcaattcaagtttttatt

SEQ ID NO: 4 - DNA, 249 bp, Gossypium hirsutum
  Clone ID: uC-gsronu33B002a07b1
gtttcggcttaaagaggccggatctgctccacggggacggtgtaaattacaaagctctaaaaggccatacagagaccagggcatctgcctgcagcacatgagggggagacagcatatgaaatgggctgacctctatcagagcggggaaggtacaccaagggagccattcaaagtaacaagcactggcaccaccagcagggaagttcctcagaagcagattgaggttgtgaaggaaaccgagctaaaacc

SEQ ID NO: 5 - DNA, 550 bp, Gossypium hirsutum
  Clone ID: uC-gsronu33B002a10b1
tcgccctcgcgtccgcccacgcgtccgccgaccctgtgaccgtcttcgacatcaaatactacagccgcgatcaacgcaggaaccgccctccgatccgccgtaccatcttgaagaaagatgacgtggtgaagatgatgaaagagaaaacctttgatgtcaacgattttccaaaggtctacttgactgctaaagttgaagaggatgagaatgcagttgggggaggctaccagaaataggtattgtagcatagcaatttcttgagacacttgaagtcaaaaggggttgcagtttcggggtttccgacattaataaggggttgctgtccacattttgtttatttgtttggtttttctttttcagttaatcagcatgcttgtattaatccagatgcaacagtagttggatgatgaatgatataattgactcgttcaagcttctgatggtttttgaaccgtgaacaataagaaatgaatcagatatgttgatgaagaattgacatgtggtttctatgggatttctctgacattaataatgaatcattgtcattcat

SEQ ID NO: 6 - DNA, 482 bp, Gossypium hirsutum
  unsure (1)..(482): unsure at all n locations
  Clone ID: uC-gsronu33B002a11b1
gatacagcagctgtcgattgagggttttctttggtggaaaaagcaaagccatggcgatgaacggtggtcttagatcggcttcgaagtttctgacttcgtcctctcaatcacttctccacaagtctggcaatagagggtttcattcaactggagtgaagagaatggggggagggcatgggcatgatgaaccgtattacctccatgctaaacatatgtacaacttggataggatgaaaaatcagaagctgacaatgtctcttggagttttgacagccttcacattggtgtgtttgttcctatctatgctgtcattttccagcagaaaaagactgcatctggctgatttttattttttatgcttgccttctggcatggtttggctgcctgcaataatggaagcaactgnctctgtgaattgntatcttcggctctctgaactgatgcagtttgatgattatgatgatactgcaggattttagatt

SEQ ID NO: 7 - DNA, 313 bp, Gossypium hirsutum
  Clone ID: uC-gsronu33B002a12b1
tttccgcccacgcgtccgcccacgcgtccgatcggcatgcccaccgacaccatctcatcccaccactcaccacgtccttcaagccctgttagcctcctcacgtcccttccttcgtggcgagcttcaacatgtcgacaaaaacttgcctaatttggtcgccgtcttgcgttccgctggtgccggcgagtgttggcacaggcacggcagctttttaaagcatcttggccaatatctatcggctttctaaaaatatggagggggcaggactccgttggcctttccggcctttcccactttgctaactccaacttta

SEQ ID NO: 8 - DNA, 393 bp, Gossypium hirsutum
  Clone ID: uC-gsronu33B002b01b1
gttgtcggtttcagttcccgaccatcataaggacccctgatgaacatgaggtgcccagagtgccatcgcgtcatggagagatacacatcattcatctgttgccatgatgaccaaggcattccaggctcgctattttaagctgggatcaggtttcatcactgtttttccatctactgttctcactaaataaagatgttcctatgggactcaaattaaaaaaatttcttctaaattcactttggctgctaaggatttgtggttgacatgtattgccggtgggcgctttgaggcctaagttggagtagtttaatagttaaacgtaaaataatgatgtttggtttcaacattattgtcaagtatattatgttacaaactgaaaacttcatttgacta

SEQ ID NO: 9 - DNA, 463 bp, Gossypium hirsutum
  unsure (1)..(463): unsure at all n locations
  Clone ID: uC-gsronu33B002b06b1
attttgggttacccatggttnaggaccacatctacaaccgggacatactgatcagcacgttccaagctctcaccaatgggtctctgagttgagaaacaaggaccaaaccttatgcgaagaaaaaggacaactgccaaaactctatctacaaggagttgtgaagggccattactctcctctctgagaacaatcctctcactggtagcaagggcgagatcaggaagcaatgcaatcttgcaaacaagcttcactaaaatgcctcggcaaagagaaagccgagagtggccgaataaaacggcagtttacttgcatctttaccaagagacaagttggttaatgtgcagtgagtaatggtgcaatggtactagtttgatacgatcgacccattgcatttttttttagcataagccaggttgccttctcttgatgttggtcatgggcgtagtggatgtagggatggatg

SEQ ID NO: 10 - DNA, 550 bp, Gossypium hirsutum
  Clone ID: uC-gsronu33B002b09b1
tttcgctttaaaaaaaaaaaaaaccccaaacagacaatagcctaggacaggaggatctctcagggtttaggcgatggcttcaaagcggatcttgaaggagctcaaggatctccagaaagatcctcctacctcttgcagcgcaggccctgttgctgaagacatgtttcattggcaagcaactattatgggtcctcctgacagtccttatgctggtggagtgtttctagtcaccattcatttccctccggactatccatttaaaccaccaaaggttgcattcaggacaaaggtctttcacccaaatattaacagcaacggtagcatttgccttgatattttgaaggagcagtggagccctgccctcaccatatccaaggtattgctatctatctgctcactattgacggatccgaatcctgatgacccattggtgccggagattgcccacatgtacaagactgacatgagcaagtatgagacaacggctcgaagctggacccacaagtatgcgatgggttaacttgctactacgcatgtaaaaaggagggct

SEQ ID NO: 11 - DNA, 442 bp, Gossypium hirsutum
  unsure (1)..(442): unsure at all n locations
  Clone ID: uC-gsronu33B002b11b1
cccacgcgtccgaaaacttttcctggaaaacacaagcaaagttctagctctggggttcgacgagaagttcatgaggacatgggaatactatttcgattactgcgctgccggttttaagacaggaactcttatagattaccaggttgtattttcaagggccggaaatttcggtacactcggagatccatacaaaggtttcccttctgcatattccttcatggatgattgaacaaagtgtggttgaacattgatccaaagaagcaaacaaaattatcaccacatgccagtgttaagaacaacctatctccctagtccctacttttgtttattatggctatgtttgcaatgcaagaataagcaaacattgtcaatgttaataaagtttgcacttttgtagactggtgngatgttatagatgaagtacctagnttataagtattaa

SEQ ID NO: 12 - DNA, 504 bp, Gossypium hirsutum
  Clone ID: uC-gsronu33B002c03b1
cttacgcgttctaaaaaataaacgaaatcctctgaaagaggattcgtgggctgattccggtgctgttgaacctccgttcaggagttttctcacgcgctcactcgccaccacgcacggcggtcggagggtcaaaaccttcccccttttcagcgaaagtcaggtaatctcttttccttttcactatttgtaatatatgttaaaatattcagctttgtattagattggctactggtattgtgagtcgatcttactgcactctgtcgaatttgtttgtatatttctctcttcgtaaatcgcgtgtatattattgcctttgtaaaaatcgggatcccttttacaatgaaggtattcgggctttatagccactgtttacagtgtatgtacatctttattttatttccttgccatatttgttggttctgctccctcttatttccttttacaggcgatcgaagagaagaaagggcacctggtctcggcggtgatttgcgtcttaacaagata

SEQ ID NO: 13 - DNA, 358 bp, Gossypium hirsutum
  Clone ID: uC-gsronu33B002c04b1
tttatgatttctcggaccccatgcacgaagagggacactgtttaattgaaaaacgttatcgtctccgaacacgccaagggagatgcacatcaaattaaactttacagagatggggatcgagctgaagcttaaggctgatgattaactccatccccttggggctgacttcactgggcatagagcctgcagggcaggccgatcggcggagtcaaaaacttgtgggcaatcggcaacttcaaatcgtgtgcatgctctgcgtccacagtgttgaacacaaagatggctgccgcttggagacaacaccatgggtccctactcacccaacctacattgaacattaccaagctctgctctggcc

SEQ ID NO: 14 - DNA, 462 bp, Gossypium hirsutum
  Clone ID: uC-gsronu33B002c06b1
cctttttgttttttatcttgctgttggtctggagatctgtgcactctctctttttgcttccaagccttgctgctaacagtatatctttgaaagtcagttgatattacaattattcccttcccaaaccttgcatcatcaatcatggttcctttcatttatgttgttcttttcttagccatgtctggccattcaagtgccaactattgcttatgtaaagatggagtgaatgagcaaacacttcagaaaaccctggattatgcttgcggagcaggagctgattgtactccaattaatcaaaatggtccttgttataatcccaacactgtgaaagatcactgcaattatgcagtcaatagctatttccaaaagaaaggtcaagctcaaggaagctgtgatttttcaggcactgctactgttagcgttaatcctccttcaaatatttcctctacttgcagtttttct

SEQ ID NO: 15 - DNA, 64 bp, Gossypium hirsutum
  Clone ID: uC-gsronu33B002c08b1
ccaatacccccgccgacccaccctacccaataaaaaaaaaaaacaccaaacacaggaacagggg

SEQ ID NO: 16 - DNA, 497 bp, Gossypium hirsutum
  Clone ID: uC-gsronu33B002c10b1
attttaacaaaacatgaagaaaattctaaaacccctgaaggaattctgagggagatcttctgtcttggagtagctctggcttttgggatggatcgtctggcttccttaaagtaattcttggcaaagtgttcttttccttctgggtcatcctccatctttatccattcctcaaaggtcttatgggacggcaaaacaggacaccaaccattgttgtcctttggtcagtgttgttggcttctgtcttttctcttgtttgggttcggatcaacccgtttgtcagcaccgccgatagcaccaccgtgtcacagagctgcatttccattgattgttgatatattttgtgtttcttagaattgaaatcattgcaagttgactgaaacatgtctattgactaagttttgaacggtttgtacccattttattcttagcagtgtgtaattctcctaaacaatgctatgaactatacatatttcattgaaatttacattaaatgaaac

SEQ ID NO: 17 - DNA, 591 bp, Gossypium hirsutum
  unsure (1)..(591): unsure at all n locations
  Clone ID: uC-gsronu33B002d01b1
cttcaatcttttctttttggagtttcatcacaccagatattacaatgggttcaatcggtgaaactcaaatgacacccacccaagtctcagatgatgaagccaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtaccttccctggtggcaaagtggaaagactctatggccttggccctgtctgcaaattcttgaccaagaacgaagatggtgtcactctttccgcncttagtctcatgaatcaagacaaggtccttatggagagctggtactacttgacagatgctgtgctggatggtggaatttcattcaacaggcctatggtatgactgcatttgagtaccatgcactgatcctagattcaacaaggttttcaacggggaatgtctgatcact

SEQ ID NO: 18 - DNA, 454 bp, Gossypium hirsutum
  Clone ID: uC-gsronu33B002d10b1
tctttcgatttaatccttttggaaatattggagcggaccatttctgctcccctgagcaccagattctagcacttgaagctgctcgtaatggcattgtccttttaaagaacgatgctaaacttcttccacttccaaaatctaccatgtcgcttgctgtaataggtccaaatgccaattcgccacaaacacttatcggaaactatgcaggccctccatgcaagtctgttactcctttgcaagctttggagagctacgttaagaacaccgtgtaccaccccggttgtgatacagtttcttgttctactggtgcaattgacaaagcagttgacattgcaaaacgggcagattatgcagtgttgataatgggattagatcaaactgaagaaagagaggcgctcgatcgggttgatttgtttcttcctgggaggcagcaagaactcatcgtcagcgttgc

SEQ ID NO: 19 - DNA, 544 bp, Gossypium hirsutum
  Clone ID: uC-gsronu33B002d11b1
tttcgctttcgcgtccgcggacgcgtgggttttaaggcttactattgtaataaaaagaggcttatatatcatatcatatacccaccataccattatcaccagtaagtcactacctctacccaccgtcgtaccgctttcttttctttttttttttctcttaatattctgactagaactctccattttctcttgcgctgcctttggtttctctttatttttcctctctaaatctctgcatcatcatcgatcatgtctcttttaatctccctactcatgttcttagccatgactggccattcaagtgctacttattgcttatgtagagatgggttaggggatcaagctcttcaaaagaccctggattatgcttgtggagctggagctgattgttctgcaattctacataaaggtggatgctataaccccaacactgtgaaagatcactgcaactatgctgtccatagttatttccaaaagaaaggtcaagcacaaggaagctgtgatttttcaggcactgctactgttagtgccgatcctccttcaa

SEQ ID NO: 20 - DNA, 377 bp, Gossypium hirsutum
  Clone ID: uC-gsronu33B002e01b1
ggctgcttctgcttctatttactattttctcactctcctactcctttgtgccatcccttttaccttctccgagctcgttaaagagcagcctctggtgttgaagtaccacaatgggccactcttgaaggggaagatcaccgttaatctcatctggtacgggaagttctccccaacccagcgctccataatcgtcgatttcatcaactctttgagctctgccgtcaaacccaagattccgtcggcgtcgttttggtggaaaacgacggagaaatacaagtccggttcctccacttggtcgtgggcaaacaaatcctcctcgaaaattacccgctcggtaaaatccttaagaacccacacttgccagcgttggccgggaa

SEQ ID NO: 21 - DNA, 335 bp, Gossypium hirsutum
  Clone ID: uC-gsronu33B002e02b1
gttcgcgttcctgagagagcgagagagccaggcgcctttttcttaacgcaacactttcatcctggaccaaggagggtgctgaggaggctttagcagcggagtcccacaagggtgcactcgccgagggggagagccacgtcgatcgcaaggggatcgaaaagttgctaaagacatactgctgcatagtcacaactgtgaagagcggggcaagagctctccagaaactcgagatggaggaagaaaaaggctgtcggaaaaccactgggaagaacgtgaaccgtataatgacggtggactcgaggccacgaatgactggatataaacaccctgatgag

SEQ ID NO: 22 - DNA, 580 bp, Gossypium hirsutum
  unsure (1)..(580): unsure at all n locations
  Clone ID: uC-gsronu33B002e12b1
atttcttaagaaagtgatagatactgaagaaaagagaaagtatggacggaattcaacacaaaacggtgattgtcaatggcatcaacatgcacatagccgagaaaggggaaggtccattgattctcttccttcatggcttccctgagctctggtactcgtggcgcaaccagatcaacggtttagccgccctcggctaccgtgctttggcgcccgacctccgcggttacggcggaacagatgcaccagattccgtcgccgattacacttgctgccacgtggtgggagacctcatcgcgcttctggacacagtggcgccgtcggagaaggaggataaggtgtcttgtcgttgggcacgattggggtgccatcattgcttggtacttgtgcttgtttagaccggaccgggttaaagctttgttcaattgagtgtgccgtttattccttatgatccttggtttaaaccggtcgagacttgcaaagctttctatggaaaggatcattacatcgttccgtttcaggaacctgnagtaatagaagcagagtttgcaaagattggtgtangacgagcagttttggagct

SEQ ID NO: 23 - DNA, 419 bp, Gossypium hirsutum
  Clone ID: uC-gsronu33B002f09b1
ggttgcttctgtttctacacactatcaccccagggggcgagtgacattgtgccagccccttacacctcctccgagcccgctaaagagcagcctctggtgtcgaagcaccacattgggccactcttgaaggggaagatcaccgataaactcacaatggacgggacagactccccaacccaacgctccataatcggggattacatcaacatgttagagctctgccgaccaacccaagatcccggcggcgcccacctcggtggaaaacgacggagaaacacaagtccggctcctccactttggccgtggccaaacaaatgcttctcgaaaattacccgctcggtaaaacacctaaaaacccacacttgccagtgggggccggaaaattcaacgtacaacccccggttagcgccatcctcacg

SEQ ID NO: 24 - DNA, 391 bp, Gossypium hirsutum
  Clone ID: uC-gsronu33B002f11b1
tttcgctttaatgaataaactaaagaagatggctttactggtaatagctgaacgtctttctccggaggagattgctggtttaagagaaatgcttacgtctatggatactgataacagtggtgcaatcacatttgatgaactcaaagctggtttgcgaagatacggctctaccttgaaagatacagagataagggaccttatggatgcagctgatgtcgataatagcgggaccattgattatggcgaattcatagctgcaacagttcaccttaataaactagagcgcgaggagcatctcgttgctgcattccgatactttgataaggatggaagtggggatattacagttgatgagcttcaacacgcttgtgctgagcataacatgacagat

SEQ ID NO: 25 - DNA, 401 bp, Gossypium hirsutum
  Clone ID: uC-gsronu33B002g02b1
atttttgttttttagaaattctaggggtctttggtttccttatctaagaaagacgaggaagaatcaagcttggttttctctcaggatgtcagaggcaccattcagacctagggaaaagcttatcgagtatcagaaatattttcaaggcatccacaaacacacttacttgaaaggtccttacgatcagatcacatctgtcgccattcctgccgctctagctgcaagttccttgcttttaatcggacgagggatctataacatgtctcatgggattggaaaaaaggattgagagctctcactcgtggttagaagacatgttcttctttatctgggtttcattttagcatgaaattgcctgtttatttgctctaataattgattggtttttatgccaaatggag

SEQ ID NO: 26 - DNA, 591 bp, Gossypium hirsutum
  Clone ID: uC-gsronu33B002g04b1
ccttcgcgtttttttaaggagaaaattaatgttatttaccgggccatatagtcgacggaagataattctgagaagctgcagagggcagcgagggagagagttgagcggtcaaatgcaactccgataaataatgaagatcagcacagtgctattgagctggaggaaaacccaaggtccataacattccaggagaagaagatggaggaattcgaggcagagagggagaagctaatgaaaagccatcaagaccgaaggttggcaatcacacagcggtactgggaagagctgattgagcttgaggaagggtttgaaaaagaattgaccctgcttatgggaaagtacaaccccgatcgcctcgaggaagagactactgacagccttgaaggacgagacaagagagaagcacgagataatgaaacagaatagacaacactgaccctatttgtcgagggttagaagcagcatattttgttttgggtcaaggtatacaccagttttattaccaaagatacttcagctttggttatacagggcaaaaggtgaagcctttctggatcgtaccaacattggaaactgaaaccttcggagctt

SEQ ID NO: 27 - DNA, 61 bp, Gossypium hirsutum
  Clone ID: uC-gsronu33B002g07b1
acgccaaggggcaccggtccccaattcccgattccagtccacgctccacgcttcttacttt

SEQ ID NO: 28 - DNA, 377 bp, Gossypium hirsutum
  Clone ID: uC-gsronu33B002g08b1
gatggctacactcaaaccccccatctggggctggattaatataatttccctccacgcttctatggctgagatcatttgagaagatttgcccaaagacgcgtgcgcgcaaacaatagcctcatcggggaaaaggtgtgtgttggaaacggcggcggacaaaggcggcgacgcctagcatcaatgccggacatcggaggtcgtggcggagaggatggcggattatatatagagagatgaatgcgttgctgcctgcggcgtcaatagaaacgccatcgggatatcatcggattcaccttcttgatcaacaattcacggtcaagctttgtgcaccagcttggcaccaaaactggcccaacagttatcgaccttttacttca

SEQ ID NO: 29 - DNA, 410 bp, Gossypium hirsutum
  Clone ID: uC-gsronu33B002g09b1
tttcgcctactcgtccgcccacgcgtccgcccacgcgtccgctcaatttgattctttgctgatttgaggattttatttcagatatggaaatttaaagctctaatcttttaattttctgtttcgtttcggatccgattgtttagggttttcgtaggagtttctcgtgacttggcaactcaatcttggtccgcgcgcaaccccgtatcttttggtatcagattttgggcattttgggtgttcttggttgatttctaaactgatctcaatattttaaagcaaaaacagctgctttacccagaataatatttcaaaaaaaatttatttgagtgggtaaacgttgtcaaattgatctgaaattttacatacatatttttgacactgtgattgaatataaaaaaattattcccccc

SEQ ID NO: 30 - DNA, 472 bp, Gossypium hirsutum
  unsure (1)..(472): unsure at all n locations
  Clone ID: uC-gsronu33B002g11b1
attttcatcaatcttggtgatcatcttgagatactgtccattgggaagtacaagagtcatatacatcaagtgatcctagataacaacgaagtgaatagaatttctatggctacacttcatggcccttcattagacacatttgtagccccagcatcaaggttcatcgatgagtctcacccaccagcctaccgagggatgacctacaaggaatccttggagtttaatggttctgatgaaattgatgtgcagtcatccctttctctgcttcgaattccattctctctctaatttcatgagctcagatactattggtagttcatcctccatgtgtcgtatattactatacactctccgtgttaacgaaataaaaataaataaagcgccatgattattgttgttgtctaggtgtttgtgggatggaattactttgtatgtgcttttcccaattaattntaataatttgttgggtcgg

SEQ ID NO: 31 - DNA, 387 bp, Gossypium hirsutum
  unsure (1)..(387): unsure at all n locations
  Clone ID: uC-gsronu33B002h02b1
atttgttctttttagaagaaaactncatcacagggggggggaactttaagtaaagcaattgagagaagatgtccgggcaagcggctgtcaatgatcactgtgtcagtgacttcggagacaaccatctctctgccgtcgatatattggacacgacggcagcgtttgggcccatagcgtccaatctgccctcacttcaagccagaagaaatcactggcatcatgaatgactttgctgaacctggatcgcttgctccgactggattgtaccttggtggcacaaaatacatggtgatccaaggcgaacccggagctgatattcgagggaaaaagggccccggaggtggtactggtcaaaagaccaacctgggcttgatcattgggatctat

SEQ ID NO: 32 - DNA, 463 bp, Gossypium hirsutum
  Clone ID: uC-gsronu33B002h03b1
acgcctggcgcctgggggccccggtcccgagttccgcccacgccccacggcctccggttttgactcgctcagccggcaaaactgggggtttggcaatctatctcgcaaactgaggtttctgaagaccagcacacagcccatgatagctgaggttttgtatccctcttatctgtgtttcatgaggatcagtctcatcattttccgagctttcaatttcacctatgactcaatggcgacaagcgatgaatgttggtcagcacaactacttgatggagatggctcattcaatgctactgctatcgaaaggtttatcaaggaagtgaaacttcatgaatgcaggttgccatatgccgcggtttccatcatgggaccgcaaaggagcgaaataccgggttcacacactaagacttccgggtaccacaacaacaacaacccctgcaaatcaatcaagctttgttttggg

SEQ ID NO: 33 - DNA, 592 bp, Gossypium hirsutum
  Clone ID: uC-gsronu33B002h04b1
cttatgcgttcgactggcttcacaaacggagaaggggattgggacaattggtgattttatgaacatacaagcgcacgcatgtattggaggcaaaagtgtgggtgaagatataagaaagctagaaaatggagttcatgtagtgtcgggaactcctggtcgagtttgtgatatgatcaaacgaagaaccctacgtacaagggctattaaactattgattcttgatgaatctgatgagatgttgagccgagggttcaaagatcaaatttatgatgtttaccgacatcttgcaccagaacttcagggttgattgatatatgctacccttcctgatgaaatattggaaatgacgagcgaatttatgactgatcctataaggatccttgtgaagcgtgatgaattgactctggagggaaataagcagttttttgtagcatttgaaagggaagagtggaagattgatacactatgtgatctttacgacacggtgacaatcactcaagctgttattttttggaatacacaacgaaaggccgtttgcttactgagagatgcgtcgaataactttacgggatcctgaatgcatggagatatg

SEQ ID NO: 34 - DNA, 489 bp, Gossypium hirsutum
  Clone ID: uC-gsronu33B002h05b1
cttatgcgttcttccacgcgtccggggtgaaggggtgagggccttattaaaaattgttgatgtttccagcacatcctcaaagttgaacacaaccatcaatggaccaagagggtcacggattgttggtgaccggggatctagagaaggttcatctgttgctcaatggccacatggggaggaagcaccttattggcttgggcagcaggctcttgaaactgaaagtgctcccagagacaagcagtggtcatcacaactgtcacccaatttggactcaaagcatctctgcaggacatcctcataccccgagcagcagcaaaaccaacatttttctagtgaaccaattctagtttttgattttgatcttctactacttttcttgtgtttgattttgatcggggaggtaggagtaggggcatcgggtatgatgttaatacttctgtttttttccacttgttaactttaatataaaccgcttgagtattatctcct

SEQ ID NO: 35 - DNA, 515 bp, Gossypium hirsutum
  Clone ID: uC-gsronu33B002h06b1
gttttgctctatcttatctagaggaggccagagggactcgggaaaactacaagccatcattggaggagtacaaggctaatgcattgccaacttgtggatatgccatgcttgctataacatatttcgttggcatgggagatattgtaacaccagatacctttaaatgggcaggcaatgaccctaagataattcaagcttccacaattatttgtaggtttatggatgatgttgctgaacacacgttcaaacataggagagaagacgattgctcagcaattgagtgttacatggaagaatatggtgtaacagcacaagaggcatatgatgtattcaacaagcatgttgagagtgcttggaaggatgtgaatcaagagtttctgaaaccaacagaaatgccaacagaagttttgaatcggcactcaaaccttgcaagggtgatggatgtactctacagagaatgtgatggctacacatatgttggaaacgcggtaaaggtggaatcacttcattactca

SEQ ID NO: 36 - DNA, 463 bp, Gossypium hirsutum
  Clone ID: uC-gsronu33B002h07b1
cctgcgggcccggtccccaagttccgggcccgacccacgcgttcggctttggaaggagaaatcttcttcacagggacagtgagctccgagtctggcataaccaagaggatggctggccaggcggcattgataactggcggtgccagtggcttaggagagtgtacagccaaactattcgtcaaaaacggagccgaggttttgatcgctgatattcaagacgaactgggccactccgtttgccaagagcttggcactgaaaacattagctatgtccactgtgatgtaacatgcgaatctgacgtcgaaaatgccggaaacttggctgtctccaagcatggaaagctcgatatcatgttcaacaatgcaggcattcctggtgacaatgaggtaagagtgacacatgccggtactgaggacttaagagagtgttcgatgtcaatgtattgggtggcttcttgggtgc

SEQ ID NO: 37 - DNA, 401 bp, Gossypium hirsutum
  Clone ID: uC-gsronu33B002h08b1
tttcggttttacttgctagcttcttgaactccgttttcgaccaaactagctccaaaatgaggaaatcaaagtccaccacacagtccatgaaagatgaagaagagagccctggtggaagaaggaaaaggaggatcagcattagccatttccgtagctccatcacggccgataccaagtcggtttattcgtcttcgaattcgggttccaggacgcccccggcttatgcacacacgcctgccaaaagctacaaggattttagaagctatttagaccataaacagcatctggcagcatcatctcaaacatagaacaatattggacaaacaaaatcaacagctttacaacatgatacaacaaaagactattcttggttggatgagaaactcaagttccttgatgac

SEQ ID NO: 38 - DNA, 436 bp, Gossypium hirsutum
  Clone ID: uC-gsronu33B002h09b1
tcgtttttaacctggcatatgtagagttagaactgggaaatcctttgaaggcgctctctgcagcacgagctctcttagaactgccaggttgttcaagaatttactcctgtctaggccatgtctatttggcggaggctttatgtttgctgaacaaacctaaggaagctgcagagcacttgtccatttatttatctggggaaagtaacattgaattaccgtttggtctagaggactgtgagcagtggcgagtgaaaaagcatattgattgtgaagaagcaaatgttggagcagcagctgccaagaactcttcccccgagggcttagaggatttcatgcttctcaagcctgatgaggcacgtggaacactttacgcaaaccttgctgcagtgtctgcaatacaagggtgaccttgagcgagctcaccatttcgtgacac

SEQ ID NO: 39 - DNA, 483 bp, Gossypium hirsutum
  Clone ID: uC-gsronu33B002h11b1
ccttcgcgtccgcccacgcgtccgcggtgcccgaaataacttttcggcacttaacggaaaatgacgaatttgttgtcttggctacagatgggatatgggatgtcctttcaaatgaagaagcagtagagattatagcatctgccccagctcgttcctctgcggctcgagcattagttgaggtagcaatccgagcttggagatataaatacccaacttcaaaagtcgatgattgtgctgttgtttgcctcttcctcgattctaattcgaaccatttgtcgaccgcttctaacggcaataccgaagtgcagccaacttcgaaggaccaactcgacaatgacatcgaggaaaacaataatctcgatgtattgacccctctcaaccagtgccgggatcaccagaacagaagaagaaacatccctagaagggaacgaagatccctcgatgctggagaatatgaattcggacatgggaatatattggtct

SEQ ID NO: 40 - DNA, 214 bp, Gossypium hirsutum
  Clone ID: uC-gsronu33B002h12b1
catacttattaagctttatgtgaacttgtttatgaaggtatttgaagggggtaattttcagtttttcccctctgaatatcatatttgactgatttgaatggttcttgttctgcaatcaattataaccaagaaattagaaagctggaaaaaaaaaaaaaaaaaaaaacaaaaaaaaaaaaaaaaaaaaaaaaaaaaaaaaaaaaaaaaaacaccg

SEQ ID NO: 41 - DNA, 281 bp, Gossypium hirsutum
  Clone ID: uC-gsronu33B004a01b1
cccactcgtccgataacagatctggttttctttttggcttccaagctcctgaaaaccattcctcaggcagctgccacgacttgttacgtcgccgcgcatccaagactgctaaatataagtgggaaatactttgctgactgcaacgaagcatggacatccaaactgggttcgaattccaaccaaacttgcaaagctttgggctgcctttgaaatcatggtttccaaacacgctaaagcagtgtttgatccgcttagtgccttcgattatcaccatatgtaat

SEQ ID NO: 42 - DNA, 551 bp, Gossypium hirsutum
  Clone ID: uC-gsronu33B004a02b1
cccatgcgtccggttgatatccaactatcaatctttaggtttattgcattaaatagatcatgaaatctttcctttctttttttgcattcctctcacttctcctgtttgtagacaccattgcagcagctaggaaagatgctggagagtactggggagctgtaacgaaagatcagcctatgcctgaggcactccaagagctttcggattgaggctgccgttgtcagccccgatgagaaaaccaagtgccatacatcaggtaatattgagcttaaggaagagaagattattgttaatgaggagttcgaaccaaggccaaacgtttcagcttatggtgatgacgctaatctaaaaggagataaatcatcatcttttgctgaagattttgaaccgagacctaacgtttcggcttacgggggcgatgatgctggtcttaaaggacagaaagaatcattcactaaggatttcgatcccgagccaatgtcttccgttacaaaacttattaaaagcttaaccaaagttcccagtggctaaaccccatcttccataatttc

SEQ ID NO: 43 - DNA, 391 bp, Gossypium hirsutum
  unsure (1)..(391): unsure at all n locations
  Clone ID: uC-gsronu33B004a04b1
cttccacaagctccgcaacaagttttactgccccattgtcaacatcgacaagctctggtctctcgtcccacaagacgtgaaggcaaaagccaacaaggacgctgcgccgatgatcgacgtgacccagttcgggtactttaaggtccttggaaagggtgttttgcccgaggaccaaccgatcgtggttaaggctaagttggtgtccaagacagctgaaaagaagattaaggaggctggtggtgctgttgtgctcaccgcctaggttagcttttctgtttttgtggtttttggatttgaatgacatttctgttatattattatcttatgttgtttggagttgatcttgaaatgagattttcaatttattttggttnaaacactaaaaaacacc

SEQ ID NO: 44 - DNA, 536 bp, Gossypium hirsutum
  Clone ID: uC-gsronu33B004a06b1
cggtttctttttcagacgcgtgcgccgtattgttgggtgcgctaagttaaagaatgctggggggtatacttatccttcttgtggatccgtcaccagcactggtttggtggtctcgtcaaagttaccaagattctctgatctttatacacttacgatagcaagtgcagattccaagtcgatatttgcagggaaaccggttgagttgaccaaaagtgttactcaatggttcactaaggaccggattttttgttttgggcttattttgtgaatgtttttgaatctctaataaatgtttatgctgtcaggaaccaaagaaaaagaagtgattgttgatagtaagccttaccttgttaggttattggttagacccggaaattttttcgttgttgctacctggtttagagtatgttaacaccaatcttgggttgaagattttaactaaaaccagaaatgaactttgcccagggtttttttattattttattattataatacatcgtttttttgttattgaaaagatttgtttttttagttta

SEQ ID NO: 45 - DNA, 585 bp, Gossypium hirsutum
  Clone ID: uC-gsronu33B004a07b1
gtgttagataatcatttccttagagcataaaagaaaggtaagaacatggctggtgatgctgaaattgagctcccaaccattgagttccgttcatcggattctgaagcgaggaaccgaagggtggaaccgtttgtgcaagagggttcgagaggcttgtgagactttcggttgtttagatgtggagtacaaaaggatatcaacagatattcgagaggatgcatttgaattgttgaaagaactagttgaggtcccagtggagaggaaacagaagaacactagtcccttgccttaccatggttgggttggaccatgcgagcaggtttctgtgttgtatgaaggcttaggagtcggagatgcctgcaactatgactctgttaaaagcttagtttaacttatgtggcctaaaggtcacctagccttactgagaccataccttccctaacaacgcaattgtatgagctgaacaagtcatttgggttatgttaacttatatttacggattactggaggatcactgaaattgacttctctcttggtgctgttattaatacttgcctctcccaggtgaatcgatgaggatctttc

SEQ ID NO: 46 - DNA, 570 bp, Gossypium hirsutum
  unsure (1)..(570): unsure at all n locations
  Clone ID: uC-gsronu33B004a08b1
gattttatttataacattgcatcagctaataggcctaaaatgggtcatattagaagggtttttgatttttgggataagaacaatatgagttgagctaatttgactgacctccatttctccattaaggaggtgtaggcagaaagcaaccacctcatctcctataaagtgctaacatttctggtaaaaaagagcaggaaatccatcttcgccaggtgccttcgtgggatgcatttcaaataaggtctctctcacttcttttgtataatgcgctcttgcttatccaattcctccttctcatttgcgttgcttgactgtgaaaaagctaggttggaatcatccctttcggcttcaatcaatgctgatagtttggctaaattctccagacgccatcccccataaatgtttagcttcatcgaaaaatgagtcttccatgatccactaggcttcaaatttgaattgatttgctnttttccgttggtcttcctattttgtgtgacgaaaatgggacaatgatcagaatangagactaccaagtgttcaactcttgctttaagaaacatggaaatccac

SEQ ID NO: 47 - DNA, 387 bp, Gossypium hirsutum
  Clone ID: uC-gsronu33B004a09b1
cccacgcgttcgcccacgcgtccgcccacgcgtccgcccacgcgtccggtcaaagagtgcttgaaattgtcgggaggtcgttttggttgtaaacaatctgctgagaaaggatgcaatgatcctatccgatgctatggctaagttgccactttttctgtatgaacttctgcttttgtctatggaattttaatgccttgtgttatctatgttgttactgaaggtggtggacttgtaattattcataattccaaggcagaccgatatctatgttatgtatatctacagtgataggataggacatgatgtttgaactttcaaatatggcgatcatgtattaatattgaaatattacatacctttatggtggaggatgtttccttttcttcc

SEQ ID NO: 48 - DNA, 504 bp, Gossypium hirsutum
  Clone ID: uC-gsronu33B004a10b1
cttatcttggttgcccactaaccctaaccccaaccctttgctttccctattcctaccccgccccccccctctctctctctaatgctagtggctctctttctcagctctccctttggttggccactagtccaagccctacctttttttctcaaatgctagtggttcattcatttctctctttacaaccccccactgagcctttcttttgagcttcaacttctttgatgggtgtgaatacataatgttaacagctaaactataactaaagagtttgttttttgcttagtatggggagagatggaaaaagaaactaaccaagaaaacccatctctcctctcaaataataacatctccatcactaaagaagactcctcccctaaaaaacaccctggaaacaccgctgcggctggtggcggagataggctgaaacgtgatgaatggagtgaaggagctgtttcaagcttgcttgaggcttacgaaaacaaatgggtgcttaggaataga

SEQ ID NO: 49 - DNA, 84 bp, Gossypium hirsutum
  Clone ID: uC-gsronu33B004b01b1
ggggttagtaaatgttagggttgtacttttgtatacatggggtaatttaaaaaaatattggcgtataaataataaaataaataa

SEQ ID NO: 50 - DNA, 598 bp, Gossypium hirsutum
  Clone ID: uC-gsronu33B004b03b1
gtatacgtgttgttcaagaaccagcactataccaagacaccagaggaagcagcagccaaagttattttggcagggttggatctgaactgtgggtcatttcttgggcaacacactgaggctgcagtaaaagcagggcttttgaatgaatcggccattgacaaggccgtgacgaacaacttcgccactttaatgcgactgggattcttcgatggtgatcccagcaagcaaccttacggtaaacttggccccaaagatgtatgtacacgagagcaccaagaattggcccgtgaagctgcaagacaagggattgtgttgctcaaaaacagccccgggttcgttgcctctatctccgactgcaatcaaaaccttagccgtaattggacccaacgccaatgtcacaaaaaccatgatcggaaactatgaaggcattccatgcaaatatacgacgccattgcgggtttaacgacctcgtggcaacaactacgtgcctgctgcccaatgtggcttgtgcacttgccagtagacgatgcttaaaagtagctgcctagctgatgcaactgtactgttattggcatgatcagagtcaagaaagggaagc

SEQ ID NO: 51 - DNA, 429 bp, Gossypium hirsutum
  Clone ID: uC-gsronu33B004b07b1
ttaactttatggccagatgcattttgtccaatcctaaagctcaggctttgacaccagaagaactgcagaaaactctgcttaaatcattgggaggcgtcagcaaattggagaaagttttgggcatttggcatgctggaaagttgttctatgcgttgtcaacctggggacttgcactggttgggttatatagagcccgtagtgtggtaaaagttgctgcaatgggcatccacacgaccagcaaagttgtaatgagggctctatgaatttattgctccaatatcagataaaaagataaggtctgtttgaactgtattattctttcaattctcggttggtttgtttaaaatccttcttgttgctgtaaaatgtacatgttgtaaatatatttgaaatactcttttaatgaatcaattgtattgcttcagaatg

SEQ ID NO: 52 - DNA, 592 bp, Gossypium hirsutum
  unsure (1)..(592): unsure at all n locations
  Clone ID: uC-gsronu33B004c01b1
cagaaggagcttttcgttgccgccgagggtatgtggactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagcttccatctggttcgaagaagattgttccaagtggttgtcgtgccatgattgggcaggttgctggaggtggtaggactgagaaacctctgcttaaggctggtaatgctttccacaagtatagagtgaagaggaactgctggcctaaggttcgtggtgtggctatgaacccagttgagcatcccccggaggtggtaaccatcaacacattggtcatgctagtacaggtagacgtgatgctccacctggacanaaggtttggtcttattgctgcaaggaggacctgtaggcttagaggacaagctgctgccactgctgccaaggccgataggcataataggatactgtttggtttggcgt

SEQ ID NO: 53 - DNA, 486 bp, Gossypium hirsutum
  Clone ID: uC-gsronu33B004c02b1
ggattaggagatgactcactgaagttgaactacacaacattggtgcggatgatgaaatacatggctcctccaccaggggagtatgagagaggactttttgctcatactgataaaccagtcagtacacttatttgtgaggatcaagtttcaggattggaaattgaggtcaacgacggccaatggatcaagttgaccaatctatctccttcttcttttgtttttgtagttggagatcctctcaaggcatggagtaatgggaggttgaaatcagtaaatcacagagtgatgatgagcggagacaaagatcgatactctatagcagcctttgtcattccaaatgagggtactataatcaggacacccgaagagcttatagatgaccaacatcctcggcttttcaaggacttcgatttaatggatttcttcctttttgccttttccgacccagcaaagcacatcgacaacggggagttgctccatgtcttt

SEQ ID NO: 54 - DNA, 539 bp, Gossypium hirsutum
  Clone ID: uC-gsronu33B004c10b1
ccctcgcgtccgctcatactgtgccatgcaaggttaccgggaaatgtgggtccgtcaccgttaggatggtgccggctcctagaggtgctggtattgtggctgctagggttcccaaaaaggtgcttcagtttgctgggattgaagatgtcttcacttcttcaaggggttcaaccaaaactcttggaaactttgtcaaggccacctttgaatgtcttctgaaaacatatggtttcttgacaccggatttctggagagagactcgtttcacaaggtctccattccaggagtatactgatctgttgggaaagccatcgaagacccttgtactggaagatgtcgagagagttgatatctgattgaagatcaacagggtcattacttattagtaagttgggcgtgtttctaggtcctttctatgttgcaatctttaattgtgtcttgcttgttttgattttgtcatgagattaaatcagtaatggttcaattttgttgtgttttttcatctggattctttataaagaattgtgatgagttgagga

SEQ ID NO: 55 - DNA, 570 bp, Gossypium hirsutum
  Clone ID: uC-gsronu33B004c11b1
tggttcttcgggaggttgttggatatctccaaatttgacagctacaatgagctgcgcagtgaactcgcacgcatgtttggccttgaaggccagttggaggaccctttgagatcaggctggcagcttgtatttgttgatcgggagaatgacgttcttctccttggtgatgatccttggccggagtttgtgaacagtgtgtggtgcatcaagatactttcaccgcaagaagtgcagcaaatgggcaaacgaggcctggagcttctaaactctgttccagttcagaggctctcgaatggcagttgtgatgactatgcgagccagcaggactccagaaatttgagctctggtattgcctctgtggggtcattggactactgaataatctttacctgttaagatgttatttttctccctgtaatgttagtgtgccttttgcaatccttatatggaaaagagctgcctaactctagctggaactttataatatagcatatatttacaccataagttaaatctcgaactatatgagatccttcgctcctttggtatggaatatgaccaatcattttt

SEQ ID NO: 56 - DNA, 439 bp, Gossypium hirsutum
  Clone ID: uC-gsronu33B004c12b1
cccacgcgtccgagatacccaatcctgagactgcaaaaggaaacgaatttcgaacccttttcaccatgagagctaagtggaagaagaagcgtatgaggcgcttgaagaggaagagaagaaagatgaggcaaagatctaagtagcctaatgttgcttgatgggtacttttttttttgttaaaggatttgagatttatctttataatttttatggtttagttctgtatttttgttgaacccttttttcatctacatgaacaatgttatggaattttctttttagaactaaatgcttatctgtttcgatgttagcttatagataagcataatattttataaaaaatcatattcatgcttctatatctgaacaacattcgtgtttagatttaaaaaaatcttaataaaggggggggcctgtttatagggtccaagtttacttt

SEQ ID NO: 57 - DNA, 134 bp, Gossypium hirsutum
  Clone ID: uC-gsronu33B004d01b1
gcgatcggtcgccctttttttttttttttttttttgttgggtttaacagactaaagggggcagtcataactttgaagcataaatacttacaaacacaaacagagcctaactaccttttttttttgttcacacac

SEQ ID NO: 58 - DNA, 207 bp, Gossypium hirsutum
  Clone ID: uC-gsronu33B004d06b1
atcccttattccttatacctcgctcgccttctagcgcggggtcttaaaagcaaagagggttcccactcttttctttccttttaagacactgatctattcccaccaaaaaatgttcggtagagcacctaagaaaagcgataatactaaatactatgagatattgggagtgccccaaaccgcttcccaagatgatttgaagaatgctta

SEQ ID NO: 59 - DNA, 512 bp, Gossypium hirsutum
  Clone ID: uC-gsronu33B004d10b1
tccctcgcgtccgcccacgcgtccgcccacgcgtccgctatccttctcatttttcactttcacttttagtttctccaaaaacattcctttttttgtttatttatcccctaaaagcttgtcttctaatcttcccccttaattgaaaccataaaaacatttttttgggtttagggtttggaggagagatgggcaattggagacatcgacgaccccgacgatttgaccgccaagatatagctcctaaatatcctccttcctaccatgtccctgaatcttctttttctgagttttctaatgatggtgtgcctttgtgggaaaagaaattctgcactctagttggtaaagtttcgtggcggaagatagtggatgccaagaacttcactagccacaacaataatgtgctcaactgggatgattcagctggagaagaagcatttcgtaatgcaaaaagccagttttgggcaaaaatcaatggcttctcatgtgacatttctgctcctgatccgaatgct

SEQ ID NO: 60 - DNA, 412 bp, Gossypium hirsutum
  Clone ID: uC-gsronu33B004d11b1
cccacgcgtccggtgtttctctccatctagccgtctcgcgtgcgccctgtggctctcttcaaccctcgcatatctcttcaagatctgatctgatctgacaaaaaaatgttcgggagagcaccaaagaaaagcgataatactaaatactatgagatattgggagtgcccaaaaccgcttcccaagatgatttgaagaaggcttatagaaaagctgcaattaagaatcatcctgataaaggcggtgatcctgaaaagtttaaagagttggctcaagcttatgaggtgctgagtgacccagagaagcgtgagatatatgatcagtatggcgaggacgcccttaaagaaggaatgggtggaggccggtggtgcccatgatccatttgatatcttccaatccttctttggtggcaat

SEQ ID NO: 61 - DNA, 139 bp, Gossypium hirsutum
  Clone ID: uC-gsronu33B004d12b1
aaaaattaagaatgccatggtaaatatggcccataatcccatatttagctaatggaagaacaagccttttttctcttgaattagtggtaaactgaaatgcaatgcaggctgtaatctttattcattattattttcatgt

SEQ ID NO: 62 - DNA, 490 bp, Gossypium hirsutum
  unsure (1)..(490): unsure at all n locations
  Clone ID: uC-gsronu33B004e05b1
ccctttcttccgagcaaagagaaaataggggtacggtaggaatcagaagaagagaaagggaaaggaagatgaagaggtggtttgatccatggccggttttcttcaagagagagttcaaccggacctggcccttccttgttggtttcgctgtaactggaaccatcatcaccaagttctccctgggtctcactgaggaagatgccaagaactcgcctttcgctcagaagcacaagaggtgatcaactgatttcaaaaaccaggagtctgccacaagcttgatggtaacaagctgatatcatatcaatggctgcaagaaaggtggccatatttcgatggttctttttttttttcctttttctttttgtgaaactccaacagcaaaaatgtacaaggacacctgaaatttaataaaattaagcatgcaagtgtcttcttattnaaaaaaaaaaaaaaaaaataaaaaaaaaataaaaaataaaaaaaagggcgg

SEQ ID NO: 63 - DNA, 480 bp, Gossypium hirsutum
  Clone ID: uC-gsronu33B004e06b1
gttttcactatttttctcctcctctctctgctcgggtggttcaaccaaatcgaagctggggttttgcagggagctttaaaacgacaatgacgaccgtcgttcccacctccgaagaagatcccgtcctccccgtcgtccgattcacggccgacctctcttgggctgatgccggtcctgaggttgcggaaccgctagtgacgaggctttgtatggaagcgcaagagtgtatggtgatgggaagatggttggatttggcttctttaatgcttacttctgctgagttggtctttcccaaggtctctgataaagatctcgagtgtatcttcactgttatctgcaatctagcctcaaagctcgaaaatccagatgatgaacttgagatggcaaaactcatatctacaaaaatcagtcaacaaccaaatgataagcctgcaatgcgtttaaagatctttgtcaatctctacaatttgttggaagggc

SEQ ID NO: 64 - DNA, 183 bp, Gossypium hirsutum
  Clone ID: uC-gsronu33B004e11b1
aaagccttaggggggctttaataaactgaggttgggttactcaaggctctcttaaactttcaccactcctgcatatttacattctcctacaacttaccctatttgacttgctctcgattcacggccgacctctcttgggctgatgccggtcctgaggttgctgaacccctagtgactaggttt

SEQ ID NO: 65 - DNA, 506 bp, Gossypium hirsutum
  Clone ID: uC-gsronu33B004e12b1
tttcatttttagctagcacttccaagccaaaggatattccatacaaactggagagtccacccctgatcccctttaccagtaacaccacatcaacggctcctgttgcaattgttggtgcgaccaatattaatgtctatcatgtaggaagcttggaaagtcagagctctgctcctgggacttctccagggtccattgatgttggggatgctctggaacagccatcatctcattgcatcacaaggataaagtcgttacagcagtgcgcatctgcaattacagagttagtgcatgagaagactgaggcaggtaagcatcttgaagcgttctcaatccagcttgtgattcttgcaatttggaagcaagcattgcatatatgtcatacacaggctgcatcagctatggaaggaagtccgagccaagagacaagcagactaaggagtagtaccagcaagaagcttggaacgtctgatacaagagagtcttcagaagatatatcctcggagata

SEQ ID NO: 66 - DNA, 514 bp, Gossypium hirsutum
  Clone ID: uC-gsronu33B004f04b1
ccaaaatgaagccactgtttcttttagtttgtgttctctgagcttcctctttctttattcccatttccgccatgcctatccaggaccagcccttgggtggtgaacgcaaaggaaatgaatgtggtcgtggaatcaaatgcataccaaagccaacgccacggcctactaagtgtaaaagaaacaatccttactgcaggcctccctgaatgtggtaaaaaataaagctatgggcctatggacgatatggatatgggtgaagttatgctagtaataaattaacaaataaacaaagtttccccccatgcttcatgacccatggcaattaccaatgaagttcttgtaatgatcatatcattactttcatgactactagtttgtatgtgttatgtttatgtttaataaattatggagtggttttatgttgaaaaatatcaagtactactttgattgtgatagggttatatgtttatgtttgaggaaaatatttcaaaaatgaaaatcacataaaccatga

SEQ ID NO: 67 - DNA, 517 bp, Gossypium hirsutum
  Clone ID: uC-gsronu33B004f06b1
cccattcgtccggctgatgctgtcactgcttcctgtgttaaagaatttgcaaaaccggacaatccttataatagaaaacgcaagaacttattaactcgtggttcaaagcgattaggcaactcatatggaagtgcaatggctttcggaactactatgagtagctcagacttgaacttgatgtcatcatcaccgtctagttgtcttccacctctacatccacagtataaaaaatcaactatgattagttcatcatcgatagctgctcaaccgaatttgaaccctccgtgccggtctttctccttgtctgatctacaatttgttgttgccgctgccgctgcaactcctaacatggctggtttggctgttcgtagttgcaacaaggacaacaaaatgcattgagttcaatgggaagttgccaaaatgtttaccgtgattggtacgggagactggcacttttatcccttcatgcatttgattgatctaatccctctgtacttggagtgttaggtattcaatg

SEQ ID NO: 68 - DNA, 84 bp, Gossypium hirsutum
  Clone ID: uC-gsronu33B004f07b1
ttcatgtcttgcattttgatttcccttttttggggccgcgatttttataaaacccaggggttaaaaaagcactgggttcttaca

SEQ ID NO: 69 - DNA, 211 bp, Gossypium hirsutum
  Clone ID: uC-gsronu33B004f10b1
tgaaaaacacgaggatagtgaaattggagaagtaaggaacaaagaggagaaaaagagagaaaaaaaggagaagatgcacaaagatgaagaagatgataagaacacaaagaaaaaaaagaaaaaagacaaggaggtgaagatgaagaaagaaggaaaacacgaggataaagaggtggtagaagatgatgaagagaaagaagagaagaagaag

SEQ ID NO: 70 - DNA, 97 bp, Gossypium hirsutum
  Clone ID: uC-gsronu33B004g11b1
ttgctataaacttcaccactttaagcccggcaggtttaataaaataagattcggtctaaaaacaacaaaataccaagttgtggccctcattttaccc

SEQ ID NO: 71 - DNA, 633 bp, Gossypium hirsutum
  unsure (1)..(633): unsure at all n locations
  Clone ID: uC-gsronu33B004h04b1
cccattcgtccgcggacgcgtgggcacgtggaggttattcaaggtatcgaaagaggcgatgctttgcctggcctcaggagctactccgatattgccgaggctgcaaaaaaggtaggatttgagattgtgaaggagaaggatctggccaagccaccgtctctcccctggtggactaggcttaagatgggtagaatcgcctactggaggaaccacattctcgtcattgtgctggctgccataggcatagctcctaaaggaaccgttgatgttcacgatatgttgttcaagaccgctgattatttgaccagaggtggggattctggaattttttcccccatgcacatgattctcctcagaaaacccaagggggctccttcaaaatcctaaacaatttctggaggtaacaacattgtggagcaattaatgtggtccaacctctggtactttacccttcttatattttttttcccttaattttattttcaaggttctttttttccccccctaacttaatccatcattatggaccctctttttggttggattaagtcgaagttgtggatttggggttaatttttggaatggtggggaaaaccgataaaggaaagcacgaaggtttngtctttttttttc

SEQ ID NO: 72 - DNA, 102 bp, Gossypium hirsutum
  Clone ID: uC-gsronu33B004h10b1
agacatagtcctaggacaggaggatctctcagggtttaggggatggtcttaaagcggatctgtgaaggaacacaaggatctcccagaaagatccctcctacc

SEQ ID NO: 73 - DNA, 490 bp, Gossypium hirsutum
  Clone ID: uC-gsronu33B004h11b1
gaagtatgggttggcatgagttactatgggtcggaaggctgcttgttcttatgcaactgcttcatggggtgtttggttggggaaaggacggtcattttgctgtttgcaagatagctgaggaatatcttactaaagatgctctggctacagtaaaggaactgctccctgattccgctggaggtgagcttgcatctgtatgctcctgggctgatgatgtaaggtggcactatcattggtctagtcccttacactatgttgacaccccagatttcaagtgtaattataaatactgccgggactgccatgatgctgctggacataaggatcactgcgtaactggagccattttcaactatacaaagcaacttttttcagcatatcagggatatagtcctcagttgagttacaatttgacagaggcgcttatgttcttagctcattttatgggggatgtccatcagccattacatgttggtttcttaggagattt

SEQ ID NO: 74 - DNA, 246 bp, Gossypium hirsutum
  Clone ID: uC-gsronu33B005a04b1
ccctctcgttcgtccacgcgtgcgcccacgcgtgggaggactcgtgggctttgccgctttactaactaaaaagaaaaaccttcctacggttaacgctgaagatacgttgaacaacaatggctccctctatggctactctaaggcgtgatctcatcgctgtatgcgctctcacggactgcgccattgccgacgacgctccgtgttcgagccgcacctctggtgccagatctatcttgccgccatttg

SEQ ID NO: 75 - DNA, 306 bp, Gossypium hirsutum
  Clone ID: uC-gsronu33B005a10b1
ttttagctcatgctgagaagactactaccgagtggaataagcttgtaagatggggagtcaatggaagcttgtgtagtgcgcttactgttagctaagtttgcatgttgaaatcaattagtttctattctagttgaataaggacgtgatagtattaaggtggatgaggcttgggactggggcatggaaatgacccaccaatgatagcttgcctattggctaaactaacatgcaattggcatatggcagggagagagtttagagaaggttcaagcaggaattggggggggggggacatttttcatggtc

SEQ ID NO: 76 - DNA, 245 bp, Gossypium hirsutum
  Clone ID: uC-gsronu33B005b11b1
gcttaactgtgaaactcatcatcacaaatcttcttcatgtatatttctctttttccaatgttcttttattaatcgctttttttctatttctcttaaaagaattgtatatttattctgtgttcttatatagctttagcttcagtggacattaatggagtacagtggcgaaatcagggaaagcatatatgttccaacatgcaatgaacatcgtgttgggcccgaaatactacaagcagttgataact

SEQ ID NO: 77 - DNA, 465 bp, Gossypium hirsutum
  Clone ID: uC-gsronu33B005c05b1
tcctctcgtccgcccacgcgtccggattcatggctttctggtgaggatggcggtttgagcttacgaacgttggacaggcagcaaaacggacacgtgtttaagtcaccaaagatgattcttcttgcgacaaatattactaatgctgaactcgagaaagcaagggcagcaggttttgcagatactactattatgaaacctttgagggcaagtatggtggctgcatgtcttcagcaggtgcttgggacagggaagaagaggcagcctggaagaggcatgctgtatggatcgtctgtccttgggagtcttctttgtggaaagaaaatattagtagttgatgacaatatggtaaaccggagagttgctgctggcgcattgaaaaaggtttggagctgccgtagaatgtgctgaaagtggaaaagctgcacttaaattgcttaacttccaacagttttgacgctgctttat

SEQ ID NO: 78 - DNA, 100 bp, Gossypium hirsutum
  Clone ID: uC-gsronu33B005c06b1
gtttatctatccaaatctatattctttataactagaacgtgtcccaagtagtttttgtgcccatgacttgtgcgaacctgtacaaaaaataagaggggtt

SEQ ID NO: 79 - DNA, 423 bp, Gossypium hirsutum
  Clone ID: uC-gsronu33B005c11b1
gctttccatcacaagggtctctctggcactttttgtcgtctatataaactcaagcagagtcgctcttagaacccatcttcatagcattttctagagagaaagagagagtttcttattagctgctgcggaaggtttattttctttactaaagaataaaagctttttctgcagtagcgttcaagtttttaccaatccaaaatttcaatttaaagaaaaaggagaaaacagaaatggctctctctttcgcaaacgctaagcttttctctactttcgttgtcgatggaatctctaacgttatctccagacgaggatatgcggcggcgtcacaaggaattgtgtcgagtggaataagaagaggagcaggaaggaacgctgctgctgtagtcaagaaaacaggggaagagatgtctggtggagcctaag

SEQ ID NO: 80 - DNA, 101 bp, Gossypium hirsutum
  Clone ID: uC-gsronu33B005d01b1
ccctcgcgtccggtgagttgtgcggggtgtcgggcacagttgaaggagaagcagggattcgaagcaccctggcaagggatgtagctgcggttatggagaac

SEQ ID NO: 81 - DNA, 84 bp, Gossypium hirsutum
  Clone ID: uC-gsronu33B005d03b1
ccctctcgtccgcccacgcgtccgggacggcagggaagtctttaaaaagcattgcgcttttaaacccctaggaggcctattcga

SEQ ID NO: 82 - DNA, 88 bp, Gossypium hirsutum
  Clone ID: uC-gsronu33B005d06b1
ccctctcgtccgagaaaaagaagcagagcaagcggctcctttaaccagtgaaagcggtgcaaaccctcctgtggctcagctagcaaca

SEQ ID NO: 83 - DNA, 454 bp, Gossypium hirsutum
  Clone ID: uC-gsronu33B005d09b1
gcatatcccagcaagagccactctctctaccttaagaatcgccatggactacgcttctcgaagaagtcaaggaggcctattcgaaggtctctacagagtcatcatgcgccgtaactctgtctacgtcacatttgtcatcgccggcgctttcctcggagaacgggctgtggattatggagttcataagctctgggaatacaacaatgttggggtaaatttctaattctaagaataccagtttttattttgtattttacttcacagttgcttagttatttgcggattgtttggactctgatttgcatattcggtagttattatttcactgtcactttgcacaagcacactgggatttgtatctgaatgtattgaagagacgatagccccttttctctgtttgtcaagatgtttaaacctttgtagtaattaagactgccggcggcaatactttttt

SEQ ID NO: 84 - DNA, 403 bp, Gossypium hirsutum
  Clone ID: uC-gsronu33B005d11b1
gtttcctcttgagccatatgagtggtatcttgacctgcggcgatacggaactgttaaacattgtggattcgggctaggctttgaacgaatgattctctttgccactggcatcgagaacattagagatgttattcccttcccaagatatccgggaagagctgatctctgattggatttttctaagatgacgtgagaaaatggtcttgattttcagtttaatactcatgggttttagtaaatttttgcgcattggcaatcatattacgtactttgaaaagaattgtaaaagtataactgtttcttaatttttgttctttctctgttcatccttaacagcaccacatgtttgttatatattgatgttagtgttatcatctaatgcaataatatatacgtcttcttt

SEQ ID NO: 85 - DNA, 428 bp, Gossypium hirsutum
  Clone ID: uC-gsronu33B005d12b1
cttttgcaaacaacactgagagtaacaatgtcctgaaagagcgacaagtttcagaagtgtcatcaaaaccagccaatgaaatacccaaggaagaacccctggttgttcggctaaaggcccgaatgcaagagatgaaggaaaaagagctcaaatccctgggaaatggagatgccaattcccatatgtgtaaagtatgcttcgagtcaccaactgcagcaattcttctcccttgccggcatttctgtttatgtaaatcctgctcgcttgcttgttccgagtgtccaatatgtcgcacaaagatatcagacaggctttttgcattccctttttgatacacaacctatttttaccctcctaatgtagggggttcgtgaccacctgtttgatattttcaatgggagaagcgggtgcaaatctttcattagtct

SEQ ID NO: 86 - DNA, 489 bp, Gossypium hirsutum
  unsure (1)..(489): unsure at all n locations
  Clone ID: uC-gsronu33B005e02b1
aattccttctcttctcctttaatccctaaatttttatccccaagttcccaacccatttgccaccgaagacaccgaccggaccacctggtgcatcgccctcgactaacccctctgttgcgtcgccgtcgtcgtcggtctctactgccacagccaatcgcaatgatgcgtgctcaagaggccgatcctatcaatctggaagtacttcttgctcttggtgtgagtcatacaaatgaattggaacagactgctgctttaaagtatctgtatggatggttacgtcatcacccaaagtatggtactcttgcgccactggagcttgctaattctttgtattatgcatatgcactagatttgaagccaaactatgtgcgtgcttgggcaaacatgggtatcagttacgccaaccaggtttgagtttttgttggatgcatggtccaggattagttgaattcatgcatagtgacgactngtttgagctaattgctgatt

SEQ ID NO: 87 - DNA, 96 bp, Gossypium hirsutum
  Clone ID: uC-gsronu33B005e04b1
gaataaccaaagaaaaacctaaagagtagagggcgatgcttgtttccgatatcatgtacacttcaagtcggaagcgacaatggagccgattattgt

SEQ ID NO: 88 - DNA, 503 bp, Gossypium hirsutum
  Clone ID: uC-gsronu33B005e05b1
catttaagtcgtttagaaattctaggggtttttggcctaatctaagaaagaagaggaagaatcaagcttgattttctctcaggatgtcagaggtaccattcagacctagggaaaagcttatcgagtatcagaaatattttcaaggcatccataaacacacttacttgaaaggtccttacgataagatcacatctgtcgccattcccgccgctctagcagcaagttccctgtttttaatcggacgagggatctataacatgtctcatgggattggaaaaaaggaatgagagctctcactcatggttagaagacatgtttttcatttttgggtttcattatagcatgaaattgcttgtttgtttgctctaataattgtttggtttttatgccaaatggagatcttaaaagataccctttggggctatgttttttagtttggttttggattctcttgaaagctaaatgataagaagctcaaggattcaacatgatattttatgatt

SEQ ID NO: 89 - DNA, 257 bp, Gossypium hirsutum
  Clone ID: uC-gsronu33B005e08b1
cccatgcgtccgtctcccctgctcttcacgcctagggtcccctttcaatcttcgattcagacgaagcatagtaagggcatcgacggcgcgccagcactggtaagaacctcttctcttcctctttacttttgttttgcgcacccagaaaaacaaaaaacaaataaataaccaagaaagcgataaaaaaaatgaagaaaatcaccttcaaaatcaaactgctatatttttattcccttttgtacttcggtctacacttg

SEQ ID NO: 90 - DNA, 526 bp, Gossypium hirsutum
  unsure (1)..(526): unsure at all n locations
  Clone ID: uC-gsronu33B005e10b1
tttntgtccaactgcgcccgtttttcaggccaaaaaagaacccaaggcgacctggggggctattttaaaaaagaaggggctttttccaccttgattttctctcaggatgtcagaggtaccattcagacctagggaaaagcttatcgagtatcagaaatattttcaaggcatccataaacacacttacttgaaaggtccttacgataagatcacatctgtcgccattcccgccgctctagcagcaagttccctgtttttaatcggacgagggatctataacatgtctcatgggattggaaaaaaggaatgagagctctcactcatggttagaagacatgtttttcatttttgggtttcattatagcatgaaattgcttgtttggttgctctaataattgtttggtttttatgccaaatggagatcttaaaagataccctttggggttatgttttttagtttggttttggattctcttgaaagctaaatgattagaagctcaaggattcaacatgatattttaggttt

SEQ ID NO: 91 - DNA, 449 bp, Gossypium hirsutum
  Clone ID: uC-gsronu33B005e12b1
ctctttcagtctttggttggttttgttcggtcttgaaaatgcttgctcggctcgcgtctcgacgttttctcgagatccgtcaagctttccgtcaatcttctcaggcctctcgatctttgtccactgccctgaactatcatcttgataccccagataataatcccgaccttccatgggaattttcggaggcgaacaaacaaaaggtcaaggagatattgtctcattatccatccaactacaagcaatctgcagttattcctttgctagatcttgctcagcagcagcatggaggatggcttccagtttcggcaatgaatgcagttgcgaaggttatagaagttgctcctattcgtgtgtatgaagttgcgacattctattcaatgttcaaccgatcaaaggtcgggaaatatcatctgttagtttgtggcacaacaccttgtatgatacgt

SEQ ID NO: 92 - DNA, 450 bp, Gossypium hirsutum
  Clone ID: uC-gsronu33B005f02b1
gctcaaacaaatagttctaaaaaaagaaagaggaggatgtttgcaaggaaggacgatgatgggtcttccatgcactatggctctttggtttcagcttttactttcgatttgccacccgctacctgtcccttttattattccttttttcttctcttttttttcctttctcttttctcattaactttcttcttctccttttctcttcttttcttttcttctttttttttctttccctttttatctttctcttttttttttactcttcctcttttcctttcatttctctttttttttttttcgtttctttattccctctcttctttttctcactttctttttctttctctctttttctttctttcttttttttttcctttttttttcttttccctatctatcttttttttttcctctcctttttttcttcttctccttttattattctccttt

SEQ ID NO: 93 - DNA, 468 bp, Gossypium hirsutum
  Clone ID: uC-gsronu33B005f04b1
ctttagcgtattagcattaggattccactgagtgctataacatacttaaaattgctgtgggggaaatttgatatatataatatagcattaatgatgaagagtccaaacaaaattaagagttattattattctctgtttatgatcagcttgatgctttgtttaggtgcgaggtcccaactaaccactgatttctattcacaaacatgtccatctctcctttcaacagtacggaaacaagttcagagtgcgatcaagaccgaaatgcgaatggcagcctctctgctccggcttcatttccatgattgctttgtgaatggttgtgatgcatcagttttgttggatggagacaatagtactgagaagtttgctcttgcaaatgtcaattcggcaagaggatttgaagtcatcgacgcaataaaaagcgccgtagagagctcatgcagtggagttgtatcatgtgctgatata

SEQ ID NO: 94 - DNA, 105 bp, Gossypium hirsutum
  Clone ID: uC-gsronu33B005f05b1
ccctcgcgtacgaccacgcgtccgcaaacaggcggatctcatttattatgttacggccgcgatggaaaatatgctgtctgtgctagtgaggactcttatgtctat

SEQ ID NO: 95 - DNA, 406 bp, Gossypium hirsutum
  unsure (1)..(406): unsure at all n locations
  Clone ID: uC-gsronu33B005f06b1
gttttacccaaacttgtaacttattgagtcagtacttgaaggagaaaggtagctttggagatctaagtctgggtatgacatgcaacgttgaagctaatgagactcccgagatgctgcgtcccaccatgaatttgtttcctgtcaatgggaaatccggtgatgattgccatgcggcgcctcctccttggaaactgagatccatggatttggtccctaatcaagctgctttttcatcacctaaagatgatgctctgaaaagcagcatgaacaaattgggttcttcagtggagcctcaaactgcacagatgaccatcttttatggtggacaagtgatttgtgttcaacgattttcccggccgacaaagctangggagatcatgcttttagctggcaaaggcagctctca

SEQ ID NO: 96 - DNA, 158 bp, Gossypium hirsutum
  Clone ID: uC-gsronu33B005f07b1
ctcctcgcaaaaatggcaaggaaaattgtgctcagtggggttctagagatgccttggcattgtgccagcagctgctgactggaacatcttgaacccaatatggaatatcaattgcaagacaagatagcttgtaaaactacatgataaagatggagtat

SEQ ID NO: 97 - DNA, 457 bp, Gossypium hirsutum
  Clone ID: uC-gsronu33B005f08b1
aaattatctgctttttcttagttttcctttttgtgccttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcataagtggaggcggtggcggaggatttggaggaggaaacggtggttacagccgcggtggaggcggcggcggatattgtggtcgccaaggaggatatggtggcggacgccgtgaaagtggatacggaaatggtgga

SEQ ID NO: 98 - DNA, 237 bp, Gossypium hirsutum
  Clone ID: uC-gsronu33B005f09b1
aagtaaatgtgaatccgaatcaaaccaccgtcttcttcaacagcatgtctcctcttcatatcaagagcttggattggaacaatccaaatgggatcaaatgtgccttagagactaccccaattctcaaccagtcaatgtacctagatgtgggcacagaccgtcgactacttgtcattgccaacaacattactcaaaatatgaatgttaaggttcattttgttaacatcacaagcctgt

SEQ ID NO: 99 - DNA, 207 bp, Gossypium hirsutum
  Clone ID: uC-gsronu33B005f11b1
ccctctcgtccgattagctgattgggcaattgactgctttccaaatattttggttcctttggacaactacatatccaggggaactgcacattttcttactagcacggcccctgactaccagcagagcctttggaatatgatttcttctattatggcagataaaaatttagaggactatgattctgctccagacctaaagctgatgga

SEQ ID NO: 100 - DNA, 128 bp, Gossypium hirsutum
  Clone ID: uC-gsronu33B005f12b1
gccccacgctcggactaaccaaagaaaaacctaaagagtagaggggggggctttgttccgatatcaggttcacttcaagtcggaagcgacaatggagccgattattgggctcctccgctcttattagg

SEQ ID NO: 101 - DNA, 102 bp, Gossypium hirsutum
  Clone ID: uC-gsronu33B005g04b1
gtctcagatcgcgagcggcgcacaaccaaaagggggggctttaaaacacaagacggtaaccgccaagacgatcactctcgaggtcgagagctccgatacgat

SEQ ID NO: 102 - DNA, 481 bp, Gossypium hirsutum
  Clone ID: uC-gsronu33B005g09b1
atatctcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgaccgcgacgttctttatccgagcctacgctttggactccgacgaccacgaggtggcgtacggtcaaaacaccgacg

SEQ ID NO: 103 - DNA, 502 bp, Gossypium hirsutum
  Clone ID: uC-gsronu33B005g10b1
cggtctcgtgggcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggtcgtaccttggccgactacaacatccagaaggagtcaactctccaccttgtccttcgtttgcgcggcgggatgcaaatct

SEQ ID NO: 104 - DNA, 491 bp, Gossypium hirsutum
  unsure (1)..(491): unsure at all n locations
  Clone ID: uC-gsronu33B005g11b1
cacttacctaaagacatggcttcatcatctcctctttctcccattctcctctctctgtttctagtattcatttgtggggtgtcagctcaaacggctcccgcccctgccccctctggccccttgaatttcactggaatccttgacaaaaatggccaatacacctacttccttcagcttttggcacagactcaagttgggagccaagtacaaactcaactcaaaaccaccactgaaggctttaccgtctttgctcccacagataatgccttcaacaacctcaaacctggtaccgtcaataacctggacccacaacagaaagtacaactagttctataccacgttattcccaaatactactccttgaacgatctccaatttgttagcaaccccgttagaacccaagctggtgagggatttcggcctcaacgtaactggcctgaacaccaggttaacgtctaagcggngttgtcgagactcagattaacaacgca

SEQ ID NO: 105 - DNA, 83 bp, Gossypium hirsutum
  Clone ID: uC-gsronu33B005h05b1
cactcctattgtactattccagctgtttgtctggggactggtaaagtcatcatcccaactctaagcaaccttacaagtgtgtg

SEQ ID NO: 106 - DNA, 53 bp, Gossypium hirsutum
  Clone ID: uC-gsronu33B005h07b1
ttcccttttcgacccacacatccaccctctcttcctcaccccattcttcaaag

SEQ ID NO: 107 - DNA, 529 bp, Gossypium hirsutum
  Clone ID: uC-gsronu33B007a01b1
cgttccttgtccgttacggagtcaaagtcaactcattggaagcggaggcaacttggtcataggagggaaaaaggtgtatccgaattcttggaccaccatattggtttccttggacaaccaaggtatgtggaatgtgcgatctacgttatgggacaggcaatatctcggacaacaattctacctcagagtctggaatccggttcgcagccttgctaacgaatatgacattccctctaatgtcctactctgcggccaagccgttgggcgtcacccgtagttcgattaaaccattgaaaaccaactttttctagggtcatgagagtttgactggcggagaaaaatagatgatagaaaagagaatggatcgaaatcattgctctttcatttgtgtatctttagaagcattagataaattatgcattcattggatatttggattactatattagctccaagagcctgaattatatgttatgaaaagaactgaggttttataaattctaaaccatataaagatctagcatttggg

SEQ ID NO: 108 - DNA, 359 bp, Gossypium hirsutum
  Clone ID: uC-gsronu33B007a02b1
gcttatgttgggtttagctcagttcttatatggctgctggttatgcacagtgctcagcgggaagtacgagagcgccaccattattctgtagattgtgttgttgccatctatgtgggtattcttctttggaagatgactggttttatctggtcggctaagggtggaactggagatagcagactcactaagcttgggaaaattcaaggtagactgctccaagcggccaaggattccgacatggatgaagtaagggagcttttcaaagttgttgagttggggaatgaagagagcccgaaacaaggcccgagcaaggccatgaggttgttttctaggggaactatttttttgtgcactttcca

SEQ ID NO: 109 - DNA, 566 bp, Gossypium hirsutum
  Clone ID: uC-gsronu33B007a03b1
gtcaccatcagcaatggtgcatccacgctctccatggcactctcccgtgccttacctctttggtggcctagcagcgatgctgggcctcattgcttttgctctcttgatcttagcttgttcctactggcggctttctggtcgtttggacaacaacagtgaaggaggtgatgtcgaaagggatgtcgaaagtggcgaaaatgagggcgactcaaccaagcaggtgaaggtttatgaggagaagatcctggtgataatggccggtgaagagaaacccacgttcttggctacccctgtaattgtttgcactaaagcttcctctttcggtggtaatataaatggcaaggttgatgatgacaaggaaggatcaaagaaagacgaaagtggcgagaaagtgaaaggagagatgagtggcgatgacgacgacgacgacgacgatgatcaacaatttccaacagtaacagacaactctgaaaaccatgacaaccatgacagccaaccaaccccagaccaaaatcaaaccagtgagcttagctcttagttgcttacttggcttcctttttcttttc

SEQ ID NO: 110 - DNA, 482 bp, Gossypium hirsutum
  Clone ID: uC-gsronu33B007a05b1
cccacgctttcggatttcatttcttaacccaaccggatgggattcttttgaaggggtaagcctatttatttctggttctaagagcagtagttctagtggtcgactcgcttctttcaaactgcctctcattattaagaaagggtaacgaagataaaatacgagcttgttttatagcaatagtaattaatcgttgttgttttaaggtcaatctatttactcgcctagataatatttttccttgttcactaataaatcgactaattaaactcatgtttctataatcaattcgatcccccgattggatcgggggcaaacgcctacgaaaagatcgcttggatttaagaaagagtcgctgggatttatccatgatttctttattccttatttctaatatttctaaaaagaatcctatccctatctctatttctaaaatcctattttgaaaattcaaattatagaattcatataataaataggatttg

SEQ ID NO: 111 - DNA, 154 bp, Gossypium hirsutum
  Clone ID: uC-gsronu33B007a07b1
tatatattaaaaaagaaacaaatattaaataaatggggagatatacaaaaaaaataaggaggggaaaaaaaaaaaaaacaccataaaatctaagaatagggggggcccttttttgggccccatgcttccttccccgtgcatgggcctcttttgt

SEQ ID NO: 112 - DNA, 552 bp, Gossypium hirsutum
  Clone ID: uC-gsronu33B007a08b1
gggtaagttgaggatgttgatgaggataaagagaaggaagaaaagaaaaagaagaagattaaggaggtgtcgcacgagtggtctttggtgaacaaacagaagcccatctggatgaggaagcctgaggagattaccaaggaagaatatgctgctttttacaagagccttacaaatgactgggaagagcatttggccgtcaagcacttctcagttgaggggcaacttgagttcaaggctgtcctctttgtccccaagagggctccttttgatctctttgatacaaggaagaagcccaacaacattaagctctatgtgagacgtgtctttatcatggacaactgcgaggagttgattcctgaattcctcagctttgttaagggtattgtcgactcagaggaccttcctttgaacatctcatgagaaatgttgcagcaaaacaagatcttgaaggttatccgcaagaacttggtaaagaagtgcattgagctcttctttgaatagcagagaacaaggaagattacaacatgttttatgaggcattctcaaagaacc

SEQ ID NO: 113 - DNA, 84 bp, Gossypium hirsutum
  Clone ID: uC-gsronu33B007a09b1
cccactcgtccgtaaattctgcttaagcaatataagcacttggctttgttattcttaaaagatcattctctatgattttccatc

SEQ ID NO: 114 - DNA, 305 bp, Gossypium hirsutum
  unsure (1)..(305): unsure at all n locations
  Clone ID: uC-gsronu33B007b03b1
cccacgcgtccggagatattgattcatggatcctatttcagagatgggaaaaaatgtgctcgtgaggatttctttttcatgttctgggagaatataccgtaccatctcatgagctcatgacattccattgcaattaaagtgtttcctcatagcattaggtctagaattctgtttcaatgtaaattacttggagaagggatccaatgttcttaaaggctatgttttatctttgttatatacccagataatatcaatgttattattttgttatgcatctgctattgctgagcagcattagctgatng

SEQ ID NO: 115 - DNA, 551 bp, Gossypium hirsutum
  unsure (1)..(551): unsure at all n locations
  Clone ID: uC-gsronu33B007b07b1
tctgtttcaagaagaacagtaagaagcgcggccacgtgagcgccggtcatggccgtatgggcaagcaccgcaagcatccggggggtcgaggaaacgccggaggtatacactaccaccggatcctcttcgaaaagtaccaccctgggtatttcaggaaagtgggtatgaggtacttccacaaactccgcaacaagttttactgccccatcgtcaacatcgacaagctctggtctctcgtcccacaagacgtgaaggcaaaggccaacaaggattcggcgccgatgatcgacgtggcccagtttgggtactttaaggtcttgggaaaaggtgtgctgccccagaatcaaccaatggtggttaaggctaagttagtgtctaagactgctgagaagaagattaaggaggctgatgggacggttgttctcactgcctaggttagggtttttgctttttgttctcttatattatcatctaggacttaatttttgaaatgagattttacaataacattcttaattntgcttcaacaatatatgggatggtgtttattt

SEQ ID NO: 116 - DNA, 296 bp, Gossypium hirsutum
  Clone ID: uC-gsronu33B007b08b1
tgctgccgctcgcgatggatttcttatgcagaagggactcgattaacttgatggagctgtgagagatccctataaatcgtctggtagaatataccgtaccatcttatgagctcatgacattccattgcaattaaagtgtttcctcatagcattaggtctagaattctgttttaaagtaaattacttggagaagggatccaatgttctttaaggctatgtattatctttgttatatacccagataatatcaatgttatttattttggtatgcatctgctattgctgagcagcattag

SEQ ID NO: 117 - DNA, 436 bp, Gossypium hirsutum
  Clone ID: uC-gsronu33B007b09b1
cccacgcgtccgcgagtccatcgaaaatatgagggtcaaagccctcttcgttgcgaaggttttaatacctgctgaaacaccatatggttaagttctcttctccaactttgtttttcgtatttgaaatgttttggttaaactttaggttttatttggttttaaaaacatcatgccaacataaaaaccgaacctttgaaagtattatttggttaaactgatgaatatcttgtattttccgcgctgttggatacttgggttgttttgtctaatttttgcaggaataagctttgtgacaacacagagtgcattttggtaatttttgtgtgtatattctctgatttcttgtgtgcctttccatatcccgattgtgatctctatttggtgctcttgcttttctggaaaaaataataattaaaattaagattcattttaagac

SEQ ID NO: 118 - DNA, 411 bp, Gossypium hirsutum
  Clone ID: uC-gsronu33B007b10b1
aaataatattcctctgtttatatccatctgcagctaatcaataagtgccaaaactggcacattcacggtgcctgacaatgtaacccttgaccagtacattgacttagccaagatagcggatcaagccgaacgctactaggagatggttcattccatgcataagcttgatctaggctctactcctgcctgctagctcaccgtctaggaactgaaccttctctcgtccgcttacaaaaacgtgatcggatctctacgagccgtgcggatgatgcgtgctcccatcgagcacaatgaagatggtatgaagaacgagtaacatgctgggctcgcttaggagtatagatcgaaggttgaatctgagtggccggctgtctgcactagtctcttgactgtgctggactctaatctgat

SEQ ID NO: 119 - DNA, 279 bp, Gossypium hirsutum
  Clone ID: uC-gsronu33B007b11b1
tttataaaagcatactagctccttatgcagctcatattgattagcgatgttagaaaattggtcaaatttataaaaagtccctgtactatgtttattcggtggatttagtacccctactataatttgatcttttctagtttgtctacttcaaggaatgtgtgttttaagtcccgatgtcaacctttcagcattagttctgtcaaataatttgacttgtctttcatttttgataaaatacatggtgatgggcatatacaacttcccatttttttgaacagt

SEQ ID NO: 120 - DNA, 533 bp, Gossypium hirsutum
  Clone ID: uC-gsronu33B007b12b1
tgtgaagaagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgttaatcacacacttagaatggagaaactattgtttgttgttaggcaaatgtgttgtactatttttttatgtttatttttaatcctcttttaggacaagattaaatgataggtttatcttactgcgtaggttccaatgttatgatgaaaggggctatgtggagagtgcgatgcctgatattctatggatagatctcatgtctgtatagtttgttt

SEQ ID NO: 121 - DNA, 426 bp, Gossypium hirsutum
  Clone ID: uC-gsronu33B007c01b1
tgtgaagtagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgttaatcacacacttagaatggagaaactattgtttgttgttaggccaatgtgttgtactatttttttatgtttatttttaatcctcttttaggacaagaataaatga

SEQ ID NO: 122 - DNA, 235 bp, Gossypium hirsutum
  Clone ID: uC-gsronu33B007c02b1
tgctggttaagtcatccgttgcaaagctgcggtagcatgggagtcggggaagccactgtcaatagaggaagtggaagtggcaccaccgcagaaggatgaagtccgtattaagatactcttcacttctttatgtcacaccgatgtctacttctgggatgctaagggacaaaaccctctgtttcctcgcatactaggtcatgaagctggagggattgtggagagtgtaggtgagggg

SEQ ID NO: 123 - DNA, 452 bp, Gossypium hirsutum
  Clone ID: uC-gsronu33B007c04b1
aacaaactagattgtgcaattaatacaaacaactgcaaaaaccatggagggtctgttgattgcagtattgggatacagctagcattttctgggacagataagcacctttctgccctgaattcatggtatgaagttgagaaccttcggcagtactcactgtttggcctttattctaatctcagggattctctcactagccagtataacaagttcttttaatggtgcttttgattattggttacattttccttcagttattgttatgttgtacttttttattctgctgttcaattgatgttgtgtctacaattctatttctatctttgtttctattcctttggggtgaaactgctggtcttatagttcacggaggattatgtggataaattatgtacaattgctttcttttttgtttgtaattacgaatctgattcatatggatgcttcattct

SEQ ID NO: 124 - DNA, 430 bp, Gossypium hirsutum
  Clone ID: uC-gsronu33B007c06b1
tccacgttcccggcaatctggagatggatgacaccggggaagaaacaccaaccgtgggcccacgatgtgtttgtcggcaactggaaaccgaccaagaacgacacgttggccaagcgggtcctggggttcggagctaccatgaatgtgctctatggagatcaagcttgcgggcaaggtgatgttgacgccatgaacaacatcatgtcacattacctttattaccttgacctaatgggagttgggagtagaagaggcatgaccccatgacgtgctcacatgtgaagaacaaaagcctttcactgtaccttcttcttctgcatcatcatcatcatcttgatctggctttggatctgatttgagtgattcatttcttagttagcctcgtatatctacattgcctatggatgggccactataatatatatatata

SEQ ID NO: 125 - DNA, 313 bp, Gossypium hirsutum
  Clone ID: uC-gsronu33B007c09b1
tctcttctttgaactcaaagtcccagctaatattagaatcatgggtgttgtcacttatgactatgagaatacctccccagacgcccctgccaggcttttcaaggcctgtactgttgaagctccaaaagtttggcccacggctgcaccaaatgcagtcaagagcattgaggttgaagctaatcctagctctggaagtatagtaaaaatcaactctggggattgccttccattccaatatatgaagcaccagatcggaggacatgttgaaagtaatttttcatacagttacgatttaatcgaaggagggcctttg

SEQ ID NO: 126 - DNA, 230 bp, Gossypium hirsutum
  Clone ID: uC-gsronu33B007c11b1
caatccatccaaggttgtcatcaccaagctgaggctggacaaggataggaagtctttgctggatcgtaaggctaagggacgcgccgctgctgataaagataaggggactaagttttcagctgaggatatattgcaaagcgtctactcttgtgggatctagtttgctgtcaaggtgatgttgacgccatgaacaacatcatgttacattacctttattaccttgacctaat

SEQ ID NO: 127 - DNA, 54 bp, Gossypium hirsutum
  Clone ID: uC-gsronu33B007d03b1
ctgtatctgaattcagcggcgtttttttaaataaacgtcacaaaatttagcggc

SEQ ID NO: 128 - DNA, 600 bp, Gossypium hirsutum
  unsure (1)..(600): unsure at all n locations
  Clone ID: uC-gsronu33B007d11b1
ggctgaggaagatcaccaccaccccacccttgtccaccaaagatgaggcttcatcaatggcgatgccgacgagtccgacgacacctgggacaccatcgacgccggtgtcggctcgtagggacaacgtgtggaggagcgtgttcaatccaggtagcaaccttgcaaccaaaggtattggcgctgaagttttcgacaagcctcaacctaactctcctactgtttatgactggctttacagcggggagacccggagcaagcatcaccgttgattaggcggtggctgacggcggcggatggtagcaaaaccactagcagaaggttgcagctactgaaggagcaggatttgcatgtaaatatatatatcgtcctttttaaaagttcttcaatgggtcaattaagtagtagtagtaagtaagatgtttaaaagagtaagcggcagcgcagggtggtcgatgaccttatgtcattcaagatcccggccgtgagcggcggcagctgctgctatattaaataattattaaataagggaaggggtattgtatgaatgaatgtgcgttagtatgtgattggaacatcaacttattaantaattttgggttt

SEQ ID NO: 129 - DNA, 353 bp, Gossypium hirsutum
  Clone ID: uC-gsronu33B007d12b1
cctttgcgtccgaaaacatagtataaagtagtggaaaaaaacagagaacatgatgcataagaaatatataaaatatattattgaggattaggtagatagaaatgccatcaagaagtatgctgcttgtgttgatcatttgtgattagaacttatttttaatgatatggcgcagactgaaagatctttgctatatgaggtaaataccacttcttagcactagttaacgttgtatacatttgattaattagcttttaaaatatatctgtataaagaattcgaattttgttactaatttaaataattgttcatgtttatatttggaaaagaaattcgttgtccaatggacgcatgaa

SEQ ID NO: 130 - DNA, 518 bp, Gossypium hirsutum
  Clone ID: uC-gsronu33B007e02b1
gggccttttgccaatttgttactggtgcgcctagactggcacctggtggtctggcagtgctgaatccaaagcttacaattgttagaaagcattcgtcgtctgcaattgctgctacttccaatggaagtggaccctcagaatcagcagatgatgacttgcccagtgtcatgacttgtgctaattacttgaagcttcctccatattcttccaaggaaattatgtataagaaattgctatatgcaatcaacgaagggcaaggatcttttgatttatcatgatggcattggcaaagcttcgtttctactttaatggtggatcatccaaaatttgcgtccataggccctccaaattctggatgacttacaagcagaagcagaaaagaaattggaaggcggattctgtggaaaattgattcaggcaggcggctgcttaaaacttttgtatataaataggaagtttatgcgtatgttatctttctactttaggtctgacaatttattgcctggcaagatataata

SEQ ID NO: 131 - DNA, 63 bp, Gossypium hirsutum
  Clone ID: uC-gsronu33B007e04b1
gcatctctggctacacttcaggcttaccttagttggtgactaatttcgcaaagggagactggt

SEQ ID NO: 132 - DNA, 216 bp, Gossypium hirsutum
  Clone ID: uC-gsronu33B007e06b1
ccacgcgtcctcgcttccggaaaaatcttgagagacctaacgattatgcaatctatggacagctctcgcataagcccctggcaaaagagggcgcaactgtcatccctcctcaaggtcagacacaaggcactcccacagctcatcgacttcttgataatcaactgtcccagtcagtgaaccgagctctgaaacgggcaacgaaggtgacatggacac

SEQ ID NO: 133 - DNA, 403 bp, Gossypium hirsutum
  Clone ID: uC-gsronu33B007e08b1
gcgtgattcatatcgggtatcaactcttttcctggaatttgcacttgaagtgatggataccggatcaaaggtgaagaaaggagcctgaggaaggaaaggcggcggtccaaagaagaaaccggtttctcgttcagtgaaagccggattacagtttcccgtcggtcgaattggccggtacttgaagaaagggcgatactctcaacgtgtgggaacgggtgctccagtttaccttgctgctggtcttgaatacctagctgctgaggttcttgagttagctggcaatgctgcaagagacaacatgaagaataggatcattccaaggcatgttctattggcagcgaggaacgatgtagatgatgtgaaggttttagctggagtgaccattgctaatggtgtttgtttt

SEQ ID NO: 134 - DNA, 281 bp, Gossypium hirsutum
  Clone ID: uC-gsronu33B007e10b1
tccctcgcgtccgaaataacccacggaagatggctactttggcggcggttgcagctcgtaaagcacctactctagctcgaacaccccttccatctcaacccgcttctctcattcctcgcctgactctttgctcaacgtcacaatatatccgacatctctgcatggaagctgtccagtgatcaaagtggagaaatgggttgctacaaagtggattagagaccaagaccaaaatgactgactattcagtgtttctgtaaaaaaaatggctcattatcggtgtt

SEQ ID NO: 135 - DNA, 501 bp, Gossypium hirsutum
  Clone ID: uC-gsronu33B007e11b1
cggacgcgtggggttttacagacttgtaatatctttatactccatttttatcttcattagctgtaatctcaggaagagaaattcatgtctgccatggtttccttgttattccacctactgtgttgcctcacagttttctggcttcttcctcttccttctcattcagctgaccctgatccattacaagacttttgtgtagcaaacctgagtgcctctatatctgttaacggttttccttgcaaaccagcatccgaggtgacttcggatgactttttctttgatgggttcacccaggaaggtaacaccacaaacgccttttcgtcattcctcacacctggaaatgtcctctcattcccagggctgaatactcttgggatttcaatgaaccgggtggactttgccccgggtggaatcaaccctcctcattcgcatccacgtgcgagcgaaggtcgtgtagtcattgaagggaggctcctcgtaggttttgtgactactaacaat

SEQ ID NO: 136 - DNA, 77 bp, Gossypium hirsutum
  Clone ID: uC-gsronu33B007f02b1
gttttctactcacacggacgggagggagaccagagggggaatacttcaatggtgtgtgggttgttacagaagcggtt

SEQ ID NO: 137 - DNA, 579 bp, Gossypium hirsutum
  Clone ID: uC-gsronu33B007f04b1
gagaaaatggagaaggtgatgaatatgataaagccaaaaccgaatccacaacagctgttaagagattggcagcgtcgccttcgccaggaatgccgaaacatcgagcgccaaatcagagatattcaaagagaagagaaaaatgtacaaaaagctattaaagatgctgccaagagaaatgacatggtttctgctaagtcactcgccatggaaattgtgagatccagaagaacagtcaatcgtctatatgaaaataaggcacaattgaattcaatatcaatgcaccttggggaaagtgtagcaattgcccgtacagttgggcatttgtccaagagtgctgaggttatgaagcttgtcaataaccttatgaaggctccagaagtggctgtcacaatgcaagagttcagcaaagagatgaccaaggcaggtgttatcgaggagtttgtcaatgatgctcttgacaatgcgctggattctgaggatatagaggaggagactgaagaagaagttgacaaggtcttgacggcaattgctggtgagacagctgcacagctttccgaggcagtcccggaagagaagatg

SEQ ID NO: 138 - DNA, 516 bp, Gossypium hirsutum
  Clone ID: uC-gsronu33B007f05b1
gtcattatgaagggtaacgaagataggtatagctggggactgtttacaaggccaagagaaggctacgtagtaaaggttccaaatgagcttgtggatgacaacaagcccatccttttcaaacctcatgactacgaagaatatttgaaattttattactccgaaatcactcaagcagctgttaaatctggaggttcagctgttcaatctgagggttatataactcgtcttaaagcttattgtagtgtctaagatttggccatcaataattattatattgtagccaattgtttggggtctttctataaatatggctaaaaataattgtttttttctacaatattaagggtaagatattaggttaatacagtttgaatatgtgtcaaatgagtgtctaataataggtttaatcacctctccatataagtcaagacctaaataactagtgtggtagaatttcatgttatgtattggactgcaaattctttttggagcattatataaaaaagtatttttttt

SEQ ID NO: 139 - DNA, 299 bp, Gossypium hirsutum
  Clone ID: uC-gsronu33B007f06b1
gtgtttgtttattgaattctttccttcactttctggagaaaaaaatatgtcttgagggtgcaattgcggctctcgctgccggcggtgacaccgctgctcatgcagggggccccatccctcgggattcggagaagacaaccagcactcataccatcatctccggaggtgcgccagtgaagatgaccttcgagggaccagagatgagcactactgaatcaggacatggatgcaagtgtggatcaaactgctcttgtgatccatgcaacctgtgaaaagactgatgaaagccatagattatg

SEQ ID NO: 140 - DNA, 418 bp, Gossypium hirsutum
  unsure (1)..(418): unsure at all n locations
  Clone ID: uC-gsronu33B007f09b1
gccttgtggaagaagaagcgtatgaggaggctgaagaggaagcgccgaaagatgagacagagatccaagtagatgcgccttggactgaattagttttgccctgacaatcccttgtcttcataattatcctgcatatgttgcatgaagttgtgaagattgaagggtattttcaggcaaccttatctgttttgtcttctatatctcggttaaagttttaagactgtttgagatgtttgtctagtactattagatattatgttggggatttgtggtttgatctgtgtaagcagttatcttaacatcctaaatgtttgaaattgaaacttttgttcttcttatatggtctataatatgcgagatagattgtttccttannaaaaaaaaaaaataaaaaaaaaaaaaataataatttttaaaa

SEQ ID NO: 141 - DNA, 146 bp, Gossypium hirsutum
  Clone ID: uC-gsronu33B007f10b1
tttatagtattaagagaaaaataaaaaaaaagagggagggtgaattcacaacaggtggtgggaaaaaaaaaaaaaaaaacttaaaaaggggtggcgtttcatggggcgccaagttttcgatcgttttattgaagagaaatatgttc

SEQ ID NO: 142 - DNA, 295 bp, Gossypium hirsutum
  Clone ID: uC-gsronu33B007f12b1
tgtttattgaattcttgccctcactttctcgaaaaaaaaaatgtcttcaggttgcaattgcagatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatg

SEQ ID NO: 143 - DNA, 283 bp, Gossypium hirsutum
  Clone ID: uC-gsronu33B007g01b1
caaaattccgatccactgcctgttcagatggtttcaccagaaggggatcttgtttggtttttggacaaagatgcagcttccaaactataagttttgaagcctatagcttatctgagttgttactcgagacttactttgagtgtgttaaattggagttaactggtctgagcagtgattgtgctaccggagttcgtctccgctatagttatcgactagcaaccattttcttctttttctcatgatgaaaacatgctatgttcaataaaacgtatttcatggttgc

SEQ ID NO: 144 - DNA, 454 bp, Gossypium hirsutum
  unsure (1)..(454): unsure at all n locations
  Clone ID: uC-gsronu33B007g03b1
atcgatttcagtttagcattcataatgtcaggaagaggaaagggaggcaaggggttgggcaagggaggagcaaagcgtcaccgtaaggtcctccgtgataatatccagggaattacaaagccggctattcggcgtttggctcgtaggggaggcgtcaagcgcatcagcggcttgatctacgaagaaacccgtggtgttctcaagatcttcttggagaacgtgattcgtgacgctgtcacctataccgagcacgcgaggagaaagactgtgactgctatggatgtggtttatgcgctcaagaggcagggcaggactttgtatggattcggtggttaaatgtgatttagggtttaggttttagaatggtggtgtcttagggnggatttgaagtcttgctgtcaagaatgtttgagctttgggttagggattgtaattagggggtgtttacccgttt

SEQ ID NO: 145 - DNA, 546 bp, Gossypium hirsutum
  unsure (1)..(546): unsure at all n locations
  Clone ID: uC-gsronu33B007g05b1
ctgtgagattatgagaccggtgggagggtattatttttagggggttccaccaacattaaaattctagacagcaactttcttttctatcttagttaatctttctacgaagattttttagaaattacagatgcgatcccaatccatgaggttgcagggggtacttatcctgaaggtttaaagcaattcacttggaaatatggcaatacaccaccaaacaagaggacctaggtttagaagcaaagcttcatgggtgttgggatgaatggatttcccaagaaactgcagccattgaaagattgatgagttactaaagtctgcattgtcattaatggagggttcagtatttatgatgttgtttcgtcatattttgtatcgtgttctttttagttgtttgaaataattaagtgtcangttgttacttgtacgaatagagttgtagctattgtttaatcaatgtatgtttctctttttctttaatatcttttgatttctttgttctttcctncctcttctttccttttgtctccttatttactttttttcttc

SEQ ID NO: 146 - DNA, 153 bp, Gossypium hirsutum
  Clone ID: uC-gsronu33B007g09b1
tcctcgcgtccgcaaaatcgcgccgcagcaggtgggcttttacgaaccaggggggggccataacccaccagataacgactaaacgaggacgctctccaacaactctggcaacggaacatggaagacagacctgctcgtcttgtaaggagaact

SEQ ID NO: 147 - DNA, 275 bp, Gossypium hirsutum
  Clone ID: uC-gsronu33B007g10b1
caattactgattagattatgagaccggtatcaatggaacttgtggttccctgcaattcctgcacttcactccaccggaaaccacctcttcaccagcgagtctcatctctgaaacgcagtgctttttccttgaaatgccgacgcacaactacatcagagctccagtctccggtgagcgttaccagcctggacggtagtctttccccttccattccttctcataaagtcaccgtccacgacagatttcgaggtgtcgtcctcgattttgctgttcct

SEQ ID NO: 148 - DNA, 509 bp, Gossypium hirsutum
  Clone ID: uC-gsronu33B007g11b1
cttgcacttgcctgggttcttcatcaaggggatgatgtttctcctatacccggaacaaccaagattaaaaatctagacagcaacattgaatcagtgaaagtaaagctgacaaaagaagatttgaaagaaattacagatgcgatcccaatccatgaggttgcagggggtacttatcctgaaggtttaaagcaattcacttggaaatatggcaatacaccaccaaacaagaggacctaggtttagaagcaaagcttcatgggtgttgggatgaatggatttcccaagaaactgcagccattgaaagattgatgagttactaaagtttggattgtcattaatggagggttcagtatttatgatgttgttgtgtcatattttgtatcgtgttctttttagttgtttgaaataattaagtgtaagtgtttacttggacgaatagagttgtagctattgtttaatcaatgtatggttttattggtctatatagttcttgatctctctggtctctc

SEQ ID NO: 149 - DNA, 574 bp, Gossypium hirsutum
  Clone ID: uC-gsronu33B007g12b1
ccctcgcgtccgggcgttttgtttcggacctttctaggactctccgataaccggacccgctagcacccggcgtcagcttttggaccggctttttcctcttctcttcctcgggccacggtttttgctaaggttacttcgatggtgaccaatgattatatcaccatgaacgggaacgggtttagcaagagggcagaagagttcatcaagaggtaccacgaactcgaggttaaagaaaatcagtgcagctcttcgctcgttaaacacatcaaagctcctgttcacctggtttggtcattagttaggaggtttgatcaaccgcagaagtacaaaccatttgttagcaggtgtgttgtgcaaggggaccttcagttggaagtgtagcagaagtaaatgttaagtcaggtttgccggcgacaactagcactgaaaggttagagtatctagatgatgatgagcacatcttgagcatgacaattgtcggaggagatcacatgttgaagaactactcatccattttacagtccatcctgaggtcattgatggcagaccaggaaccgttgtgatcgagtctttt

SEQ ID NO: 150 - DNA, 421 bp, Gossypium hirsutum
  Clone ID: uC-gsronu33B007h03b1
aaatacaaacccaaaaaaaaaaacggggtgttctttaaatcgcggggggtcaaaacaatccatgcttgcttcattagcaaatatgccgatgagttggctaaaaacgctgcttacattggaacccctggaaagggtatccttgctgctgatgaatccactggcaccatcggcaagcgtctttcaagcattaatgtagagaacgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaaggtggtgtcctccctggcatcaaggtcgacaagggtaccgttgagcttaaccgaaccaatggcgaaactttcaccc

SEQ ID NO: 151 - DNA, 152 bp, Gossypium hirsutum
  Clone ID: uC-gsronu33B007h04b1
gaattattgaaaaagaaaagatcaagtgagaggtggcgggaaccataccatggctggtgggcaaagatctgcagtgtcgtttaggaggcaaggatcttcagggattgtttgggatgacaggttttttttttcatttacttcaatcttttttt

SEQ ID NO: 152 - DNA, 565 bp, Gossypium hirsutum
  unsure (1)..(565): unsure at all n locations
  Clone ID: uC-gsronu33B007h05b1
ctcgtacggaaagcctctagccatgactttgaaacgtaggaatggtggccgcagcaagcatggccgtggccatgtcaaattcatccgctgttctaactgtggcaaatgctgccccaaggataagtcaattaagaggtttcttgtgaggaacattgtggaacaagctgctgttagagatgtccatgaagcctgcgtttatgacacttatactttgcctaagctgtatgtgaagatgcaatactgtgtctcgtgtgcgatccactcccacgttgtgagagtccgatcccgcaccgataggaggaaacgtgacccacccgcccgcttcatcagacgcagggatgatatgccaaagcctggtcagcctggtcaagcaccgcgtccgggtgttgcagctccagctcgtgcttaaggcctgtgaaagcttttaagataaattttctatatttatttttggttntaaatggttgcattaaatttaagaacatggagacatgtaggagggttttgattgcttaaaagtttaataccatntgataccttttattattattttggagccttgaat

SEQ ID NO: 153 - DNA, 325 bp, Gossypium hirsutum
  Clone ID: uC-gsronu33B007h06b1
gttttcgttagttgaatgtgacttgtgcaggccgtagatgctgctatacaacattatgaggcaagcatacacaagagaatcgcacagagcggacagagaccaaacctttatcagttgagaaccaatctaagtttgccaagaaaagattgtcatgaatttccagctcttgagaataaatctttgatgttttggcattttgatccaaactcttttgttttctctgctcttttatgtgtattatgcctttgttcatgtcttgcgcattgtttcaacaatctggccgttgagctccatcaattatagtaaagtaaaacatggcaacttt

SEQ ID NO: 154 - DNA, 426 bp, Gossypium hirsutum
  Clone ID: uC-gsronu33B007h08b1
cttctttcctcctagcccaaaaaaaaaaaaccctgtttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaacgttgaagataacaggcgtgctctccgtgagctcctattcacaactccaggagctcttcagtacctcaggggtgttattctctttgaggaaaccctttatcaaaaaaccgcttcgggcaagcccttcgttgatgttttgaaggaaggtggtgtcctccctggcatcaaggtcgacaagggtaccgttgagcttaacggaaccatggcgaaacttcacc

SEQ ID NO: 155 - DNA, 273 bp, Gossypium hirsutum
  Clone ID: uC-gsronu33B007h09b1
tttttgaagccacttgctctgcatataccatctgagcagattaataacgggttaggagtcgtgggccaagatgcgggttacacactataagaatcactgcctcattgataagtaacaccacactctagacttactttgagtgtgttaaattggagttaacttggtctgagcactgattgtgctaccggagttagtctccgttatagttatcgacttagcaaccatattctttcttttccttatgccgaaaacattcctatgtttcaataaaac

SEQ ID NO: 156 - DNA, 502 bp, Gossypium hirsutum
  Clone ID: uC-gsronu33B007h10b1
cccacgcgtccggaaagcctctagccatgactttcaaacgtaggaatggtggccgcaacaagcatggccgtggccatgtcaaattcatccgctgttctaactgtggcaaatgctgccccaaggataagtcaattaagaggtttcttgtgaggaacattgtggaacaagctgctgttagagatgtccaagaagcctgcgtttatgacacttatactttgcctaagctgtatgtgaagatgcaatactgtgtctcgtgtgcgatccactcccacgttgtgagagtccgatcccgcaccgataggaggaaacgtgacccacccgcccgcttcatcagacgcagggatgatatgccaaagcctggtcagcctggtcaagcaccgcgtccgggtgttgcagctccagctcgtgcttaaggcctgtgaaagcttttaagataaattttctatattttatttttggttttaaatggttgcattaaatttaagaacatggagacatgtag

SEQ ID NO: 157 - DNA, 583 bp, Gossypium hirsutum
  Clone ID: uC-gsronu33B008a01b1
ctttcatttcacccttttccgccatatcttcagtgtctcactctctccgtgcttcactcccgcttctcctttccctcttcaaagaaaatgcgtgagatccttcatattcaaggtggccaatgcggcaaccaaatcggagccaagttctgggaagttgtttgtgctgagcatggcatagatgcaactgggcgttaccaaggagacttggatcttcaacttgagcgaatcaatgtctactacaatgaagccagttgtggtagattcgttcctcgtgctgttctcatggatcttgaacctggaaccatggacagcatcagatctggccccgtcggtcagatttttagaccagataacttcggttttggtcagtctggtgctggtaacaactgggctaagggccattacactgaaggtgctgagttaatcgactccgtacttgatgttgttccgaaagaggctgaaaactgcgattgccttcaagggtttcaggtttgtcactccctgggaggaggaactggatctggaatgggaacacttgtgatatcgaagatagggaggaatacccagataggatgatgctgac

SEQ ID NO: 158 - DNA, 631 bp, Gossypium hirsutum
  Clone ID: uC-gsronu33B008a03b1
tgcatttgttattgatacagaaaacatatatggctgcctttgcaactgccgaggcctgcgattcaaacacagcgcttttggcaagcggtgaactgcgtgctctagaaccgattttcaagatatacgggcaacgtcgttcattctcaggacccattgtaacactcaaggtgtttgaggacaatgtcctggtgaggcagcttcttgaaacccggggtgaaggaagagttctagtcatagatggtgggggaagcaaaaggtgtgctttggtcggaggaaacttggcgcagtcggctcaaaacatgggttggtctggtattgtagtgaacgggtgcattcgagatgtggatgagattaatgcatgcgatatcggcgtccgagcattgggatctaatcccttgaaatcaaataaaaaggcaattggtgaaaagcatgccccgatcagcattgccggaaccttaatccgtgatggcgaatggttgtatgccgatagtgacggcattcttatctcgaaaatggaactatctatctatagcagtagtccttacctttcgagccaataaggggaccgataagttctcagtacaggatcgatatcatcccaatgtgagtttttagtggaatcgatatgaca

SEQ ID NO: 159 - DNA, 465 bp, Gossypium hirsutum
  Clone ID: uC-gsronu33B008a04b1
cccactcgttttagtttttcttcttctttttttacccaccttggtttttgatgtcttctggttgaaagaaagctgatgagtcgagttgggtatggaaggtggtggatttagggttttgagagggtgcattttgcaaatagtacaataagtcctgctcacttataacaagagaattctttagggtctttctaaggttgatggaatagggaaaagatttgattgggggctattttgtctgtgcagtgggaagatgatgatgatggaaagaagcagcttttagggttattttcctccttttccttccttttttttcctttcaagaaggctcaatcaatgttacaggcaaaaatatcttattgatggtttttggtcaatcgcatggaaaggaaaaagaagggtaatcaaaaatagttccatttttagtttaatgcacattacaggattactaccctggctttgcttaca

SEQ ID NO: 160 - DNA, 109 bp, Gossypium hirsutum
  Clone ID: uC-gsronu33B008a06b1
ggtgttcactggtttccaggcaccatccctttcgagtggccatctaatttctttcgctgtaaatcacatcgatatttttaagaaattgaataaaatcttgatttaattt

SEQ ID NO: 161 - DNA, 390 bp, Gossypium hirsutum
  Clone ID: uC-gsronu33B008a07b1
ttcttactgggtctctctggattgtcttgtcgatggcattcgtctctcagaacctttcctgttagatcatcgaatccattgcttttgctcgccataacatgagggcaatgagaagcatgcatatacgtcaagctggcattcaagtgggtaactcatgttgggagccatactgtctagaacatgaaagccaacccgagggactgatgcccagtgacacgcgcgaaggtgtagcaaatgatggtagcaacactgtggttagtgcgactgtttcacggatacaatgtgcctgggctgtgtgagcagagccagcacctactgtggcccaggcggtcaggactggagatcagagacctgctgttttggccagtcaggtgctggtagccactgggc

SEQ ID NO: 162 - DNA, 582 bp, Gossypium hirsutum
  unsure (1)..(582): unsure at all n locations
  Clone ID: uC-gsronu33B008a09b1
gaaaatgtttacatggccaagctggctgagcaggccgagcgctatgaggaaatggtagagttcatggaaaatgtagcaaaaactgtagatgttggtgagctgactgtcgaggaaaggaaccttctctctgtagcttacaaaaatgtgattggggctaggagggcttcatggaggattatctcttctattgagcagaaggaagagagcagaggaaatgaggatcatgttgcaaccatcaagaagtataggagcaagattgaagctgagttcaagactgctgctgagaggaaggaagctgctgagagcactttgttggcttacaagtctgcacaggatattgctctcggtgacctagcgccaactcatccaattaggctgggacttgctcttaacttctctgttttctactatgaaattcttaactcacctgatcgtgcttgcaatcttgcaaaacaggcatttgatgaggctatttctgagttggatacattgngtgaggaatcctacaaggatagtacattgatcatgcaacttctcnggacaacctacccttttgacatctgatatcacggatgaaagctg

SEQ ID NO: 163 - DNA, 492 bp, Gossypium hirsutum
  Clone ID: uC-gsronu33B008a10b1
cccactcgtccgcagagttctaccgccatggggagaagacctgcaaggtgttatcgtcagataaaaaacaaaccttacccaaagtcacgttattgtcgtggtgttcctgatcccaagattaggatttatgatgtgggaatgaaaaagaagggtgtggatgagttccctttctgtgttcacttggtctcttgggagaaggaaaatgtctctagtgaagctctggaagctgctcgtattgcttgcaacaagtatatggccaagtatgctgggaaggatgccttccacctgcgagtccgtgttcacccattccatgtcttgcgtatcaacaaaatgctttcatgtgctggagctgataggctccaaactggtatgcgaggtgcttttggcaagcctcagggaacatgtgctagagtagccattggtcaggtcctcctttcagttcgttgcaaggacagcaacagtcatcatgctcaagaggcccatcgacgtgct

SEQ ID NO: 164 - DNA, 447 bp, Gossypium hirsutum
  Clone ID: uC-gsronu33B008a11b1
cggtctcgtgggtttcgttccattttccctaacagacctgcatcagatccgatcagatttaactcagatccatctgtatcgggtcttctaaattccagatctttacttttctcgagtaaaggaagaaagaggaagggagagatgagagagattattagcgtccacattggccaagctgggattcaggttgggaattcatgctgggagctttactgtcttgaacatgaaatccaccctgatggaacaatgccgagcgacacctctatgggcgtcgcacacgatgctttcaacactttcttcagcgaaacgggttcgggaaagcatgtgcctagagctgtctttgttgatctggaacccactgatatcgatgaggtcccgaccggcccttatcgccaacttttccaccctgagcagcttatttccggcatggaagatgctgctaataat

SEQ ID NO: 165 - DNA, 560 bp, Gossypium hirsutum
  Clone ID: uC-gsronu33B008b01b1
gccactttgtatgaattaagcctcttaaaccaaaacccagtttggatttctagcttttagttccagattttgtcacttctttgttaatccttcaagttcctttcttttattgtttacttgttttcaaattcagtgctttcttcgtttagtctttgaagctttgcgtttcagctctcttaagtccaaactcttgtaagaaaggacatggagtctgaaaattgggttacagtggaggaagagataattgtgagtgaaaaaacagatattgaagaatctgctacagaagaaaagaaaaaggtacatgatgatgctgatgctgacattaatggtgaaggggattcaaattcgaagcagcaagaaacaaaatctgaaggcaagacaagtaaagctcctgcaaatgtttccaaaactcaattgtcaagaaccttaaaggagtctggtaatgcaaagaataataaggtgacaaacgataaacctaatctgagaaatgcagttctgatttctcgtaaccagaggcctgttctgtctcaaagtctttcatttcctgcaagaagaatcca

SEQ ID NO: 166 - DNA, 289 bp, Gossypium hirsutum
  Clone ID: uC-gsronu33B008b02b1
gattcaaggttcagtgctaggaacactgactgagaaggggatcaaagctgttcaactaactaccgatttgaagcctggtttacccagtgaagcagaaagaatcaggaattgcaaggatagggtccttgctttaaaggaagaaccacatatccctcgagagtggctgtcccatgaagattcaccaggcttagccatgtctcgagcctttggagactttgtgctcatggaccatggcctcattgcggaacccgatgtcttttatcaccgcctatacccagaggaacacttc

SEQ ID NO: 167 - DNA, 548 bp, Gossypium hirsutum
  Clone ID: uC-gsronu33B008b03b1
gcctgatggccagatgccaagtgacaagactgtcggaggaggtgatgatgcttttaacacctttttcagtgaaactggtgctggaaagcacgtccctcgtgctgtctttgtggatcttgagcctactgttattgatgaagtgaggactggtacttaccgtcagcttttccaccctgagcaactcatcagcggcaaggaagacgctgccaacaacttcgcccgtggccactacactattggcaaagagatcgttgacttgtgcttggaccgtatcaggaagcttgctgataactgtaccggtcttcaaggtttccttgttttcaacgctgttggtggaggcactggatctggtcttggttccctccttttggagcgtttgtctgttgattatggcaagaaatccaagttgggtttcactgtctacccatcaccccaggtctccacatctgttgttgagccctacacagtgtcctctcaactcactcccttttggagcacactgatgtggctgttcttcttgacaatgaggctatctatgacatttgcag

SEQ ID NO: 168 - DNA, 504 bp, Gossypium hirsutum
  Clone ID: uC-gsronu33B008b06b1
cccttgtaatttcatcggatctcccattgtctattctcatagttggtgttggaggagccgacttcaaagaaatggagattttggatgcagacaagggggaaagactagaaagttcaaccggacgtgttgcttcccgtgatatcgttcaatttgttccatttagggatgtacaaaacgggccttctgttgttcaagaacttctagcagagttaccatcacaatttttagcctacatgcgaagtatagagattaaaccatgcagttagatttttatacagaatgtacatatcaaaattattgttcgagtttgcctcttataagttggaaatgctacggtggcatagcaatgcttaaacttgccttgaaagagccaacagaatctattggcattatgacggtagattgaagattaatcagtcgaccaaaaatcacagggctgacggtacattgcttgtcatatccatcgtccacaatgggttgtacagagacggatttacaatgact

SEQ ID NO: 169 - DNA, 577 bp, Gossypium hirsutum
  Clone ID: uC-gsronu33B008b07b1
taaatttagtgcggatcaagcatagatggaaaacatgggagttttaggcaaggtggtggattaccttctattgttatcattctttagcatcacattaacaggtcagttggacatccccgagtccatcctaccccacgcctacaatcccttctatcaagtttataccacgttaacccaggattatttggtgcttgagcaggctggttttttcaaggcacttatgacgttggaacttgtttaccaactccctctcgctttgcttaacatctatggattgttatactccaagccctggttcaacaccacctgcctgctctttggtgcctctatcgttgcctctacgacagctatggtgggagacattctgaattcccagaaggcatcagccaatttgatggccatgtattatccaccgtttcttccattaggggttctggctatagtgcgaggggtggttggactatcgagcatggctgctccatccattggcaatggaccttcgtcggctgtgaaaaagagggcttaaactaagtcgagccccgataggtttcaacatcttctttaagagaccatacta

SEQ ID NO: 170 - DNA, 297 bp, Gossypium hirsutum
  Clone ID: uC-gsronu33B008b09b1
tccactcgtccgcggacgcgtgggtttgatttgattgatcaagttcttcaacaaaaacccatcaacgaattcctttcgcttcctgtttatttttgagttttcgtcgagttttggagcatgggaaaaagcaatagtagcagagattggactcagatctatgccatttacggcatggatcaatggcaaacactggttttccttttgtgtcacgctgttttcttctcattactatctattatcttccttttctacttcggttccatcttccactttttccaaactttatttgccagcccc

SEQ ID NO: 171 - DNA, 443 bp, Gossypium hirsutum
  Clone ID: uC-gsronu33B008c02b1
atccgaaaaataataaaaaaaaaaaaaaaaaaaaaaaaaaaaaaggaaaaattaaaaaaaaaaaaaaaaaaaaaaaaaaaaaaaaaaaaaaaaaaaaaaaaaaaaaaaaaaaaaaaaaaaaaaaaaaaaaaaaagggggggcccccccaaaaaaaccaaagtaaacaaccccggcatccccatagaaaagctccaaaaaagggcaaccaaaaaaaaataaacggcccctctttaaaaaaacaataaccggaaaaaccccgggggaacccaaaaaaaaacccacggaaaaaaaaccccttttaaacagtaggaaaaaaaaaaaaagggcctaaacaaacagcccaccaaaaaaatgagtcaacccaaaagggcaaaggaaaccccccctaaacacaccaaaaaaaccggggggagatgaaaataatcccaaaaatacccaaaaa

SEQ ID NO: 172 - DNA, 69 bp, Gossypium hirsutum
  Clone ID: uC-gsronu33B008c04b1
gttgtttgtttactttagtatctaactttacaagtaggtctattttgactatgaatttatattccgtcc

SEQ ID NO: 173 - DNA, 441 bp, Gossypium hirsutum
  Clone ID: uC-gsronu33B008c10b1
tccctctcgtccgcgagtccatcgaaaatatgaggttcaaagccctcttcgttgcgaaggttttaatacctgctgaaacaccatatggttaagttctcttctccaactttgtttttcgtatttgaaatgttttggttaaactttaggttttatttggttttaaaaacatcatgccaacataaaaaccgaacctttgaaagtattatttggttaaactgatgaatatcttgtattttccgcgctgttggatacttgggttgttttgtctaatttttgcaggaataagctttgtgacaacacagagtgcattttggtaatttttgtgtgtatattctctgattttttgggtgcccttccatatcccgattgtgatctctatttggtgctcttccttttctggaaaaaattataattaaaattaagattcattttaaggaaaaa

SEQ ID NO: 174 - DNA, 551 bp, Gossypium hirsutum
  unsure (1)..(551): unsure at all n locations
  Clone ID: uC-gsronu33B008c11b1
gtagaatcaaatagataatgttcaggaaccaatacgataccgacgtcactacatggagcccggcgggccggttgttccaagtggagtacgcgatggaggccgtgaaacaaggctcggcggcgatcggactccgatctaagacccatgttgttttgggttgcgttaacaaggctaattctgagttgtcttctcaccagaagaagatcttcaaagtcgacgaccatatcggtgtcgccatcgccggtctcaccgccgacggacgcgtcctttctcggtatatgcggaacgagtgtatcaactatagcttcacgtacgagtcgccgcttcccgtgggccgactcgttgttcaactcgccgataaagcccaggtctgcacccaacgttcttggaaacgaccttatggtgttggtttgttggtggctggctaggatgaatccggngctcatctctactataactgcccaagtggaaactactttgagtaccaagcttttgccatcggatcacgctcgcaagctgcataacgtacttgaacgcaggttgagagctta

SEQ ID NO: 175 - DNA, 197 bp, Gossypium hirsutum
  Clone ID: uC-gsronu33B008c12b1
cccactcgtccgccttattttagattattgaactggtgttttctatatatataagtcttgggtgctgtggtatttccatggatgggaataaagatcagtcaagaaacattaatattactagcagaagtactgcatgttagtgtttctcttctcttactatgaatagaaagcgaatacaaagtggtctctcattcttt

SEQ ID NO: 176 - DNA, 524 bp, Gossypium hirsutum
  Clone ID: uC-gsronu33B008d03b1
cgatattttcatcgaagcaatcaaaccttattttgctggtgataatccagctttttcctctgaaaggaaatttgcacaagatgctctttgggcttgtttggaaataggcctgcgtttgcttcatccatttatgccattcattacagaagaactgtggcagcgccttccaggagtaaagagccacacaaagaaagaatctataatgatgtgcgattacccgtcaccaatagagagctggacaaatgaaagggtggaatatgaaatggaccttgtagagtccactgtaaggtctcttaggtcacttcgggccgagctgcttgctaagcagaagaatgaaaggttacctgcttttgcattatgtcaaaatgatgaagtggcgaaaataataagatcttgtgaattagagatcttaacccttgccacgttatcgtctttcaaggttctactaagtggtgtggatgatgctccagcttgatgtgcatttgaaaatgttaatgaaaaccttaaagtttatcttaaggttc

SEQ ID NO: 177 - DNA, 306 bp, Gossypium hirsutum
  unsure (1)..(306): unsure at all n locations
  Clone ID: uC-gsronu33B008d05b1
gtctttgtgatgtttaggaacaaacggaatcggagggggggtttattaaaacatggcagacgtgccacaaggggaagctaaacagggaccaacacaacaacagatgctgattgcaagccatagtgcgggaaagaccggaagacatgggataacaagccaaaaagcgagagggnntntagtgcggggaccacgcacggactaggagggtgagcaatatacttccaggaattctgttgacgagaagcaaaaatagcgctgagagcagtgcacggccagcgctcccttttgtggacccgaacactataa

SEQ ID NO: 178 - DNA, 336 bp, Gossypium hirsutum
  Clone ID: uC-gsronu33B008d10b1
ttactacagtcgatagcaaaacgatggatgtgcccgtcgaacaaaaccggggttctgaaccacatggtatggttcaacaggcacctcaactgcaacagatgccgcatacaggccattttgtgggaaaatacggctatccaatgtagagatgagatcagagctccaaaactctgtatataagccaattttatttttagagtatcaaaacttagacgtaatttaatttgtcaaacctgatgttcattttaaagctatgacattctgatgtaaaaccatgtatagaaaactaattcctttgaatttaatttgggatacatgaattttgatttaatatgt

SEQ ID NO: 179 - DNA, 181 bp, Gossypium hirsutum
  Clone ID: uC-gsronu33B008d11b1
atatacgttatgatccaaatgatgctacacttttttgtattggccgcttgtaatatgttattgtattggccgctttgttgtaagtacaatatagcatgtgcttttgtgggaattatgatttccattattgccagaatgcgttgcagtagtactttttcatatttatgatccatgttttttc

SEQ ID NO: 180 - DNA, 451 bp, Gossypium hirsutum
  unsure (1)..(451): unsure at all n locations
  Clone ID: uC-gsronu33B008d12b1
ccctctcgtccgaagaggccaaatgaacttcaagaggcttacattgacagatatcacaattgacattccccgtgttcccaagaagaagacattgatcgaagctatggagaaggctgatgttaagaacaaatgggaaagtagctcgtggggtagaaagttgattgtccagaagagaagagcatctctcaacgactttgataggttcaagcttatgttggctaagatcaagaggtccggagtcatcaagcaagaacttgctaagctgaaaaaggagaatgcatcttgaatttgatattgaatcatggatttttgttagtttttgtcatcaaacattctgcaggttgttctttttttgtaattntttcttttatttacaaatgattaaaaagattaagatcagttgagagatctttgtttgctatattacatattttatagtgagtttaatagc

SEQ ID NO: 181 - DNA, 532 bp, Gossypium hirsutum
  Clone ID: uC-gsronu33B008e01b1
catgtttttaactggtggactgacaacatcagcatttagcttgtcatctggggtaggagcatggaacgcagtggttttcgagatcgtgatgacctttggtttggtttacactgtatacgccacagctgttgacccgaagaagggtaacattgggatcattgcacccattgcaattggtttcattgtgggtgccaacatcttggctggtggtgcctttgatggcgcatccatgaaccctgcagtctccttcggaccagccgtggtcagctggacgtgggacaaccactgggtctattggctcggtccattcgtcggcgctgccattgcagctattgtctatgaggtcttcttcatcgccccagacacgcacgaacagcttcccactactgaatattaagatttatggccttcttccatgtacttaaacaagggtttgaaagttgggtggatcactttggtttcattgttgtgggtgtttattccatgtttgtatctctcttttgttaagtgctggttcctgtgaacttggttt

SEQ ID NO: 182 - DNA, 517 bp, Gossypium hirsutum
  Clone ID: uC-gsronu33B008e02b1
tgaaaataatggacagtgatgctggttctcaggatgatttcgtgggagaagtagctataccactggagcctgtatttatcgaaagaaacattcccctgactccatatactgttgtcaaggatggagaatatcgtggggagattaaatttggtctcactttcacccccgaggaacgtgaaagcagggattttgaagttgaagaatcttttggagggtggaagcagtcttcatacactgattaggcaggccacttatagttttcagccttaattcccgtttcaagaagtaactattaagtttgattttcggaccatgtttggttggatgttattaccatgttgtctttttactgccgttaattgtgacactgggaaattgtcactgattgaaatgtttgcctaatttgtactctggagatttagtgacatgttggttcttggatttgagcaagagatacggtttggttggtttttaagtaagcccgtacattttgaacacggaaaaaaaaacacggttt

SEQ ID NO: 183 - DNA, 467 bp, Gossypium hirsutum
  Clone ID: uC-gsronu33B008e04b1
ggaatcactttcttttggaacttcggcttatgttactcaagatgatactttaatgacaacgcttacagtaagggaagctgttttgtactcagcacagcttcagctgcctgattgcatgtcaatatctgaaaagaaagaaagagctgcaatgacaatcagagaaatggggttgcaagattccatggacaccagaatcggagggtggagcaccaaaggacttagtggtggacaaaagcggagagtcagcatttgtattgagatcttaacatggcccgagcttctgtatcttgaccagcccactagtggactagatagtgcagcatcctaccatgttatgaatcggattgtgaaactagctcacctacatggaaggactatattcgcatccattcatcaacctagtagtgaagtttttgagctgttgcataatctctgcctactttcctatggcaaaacagtctattttg

SEQ ID NO: 184 - DNA, 239 bp, Gossypium hirsutum
  Clone ID: uC-gsronu33B008e05b1
gactctcttttgtttggggacggagggactcataactgggtcttgttcaaagagggatgaggttccgcacgcccaatccatttcgactattgcagggcccaagaagccgatatcagtgttaatcacatttctggaaggaggggcagagcaacattcttgtggaagggacatcaaccaagcagattgaagtttacatgggtggcaagtgccacaagatgggagctgcggccttgttagat

SEQ ID NO: 185 - DNA, 317 bp, Gossypium hirsutum
  Clone ID: uC-gsronu33B008e12b1
ccctctcgtccggctgcttgatgatagtgggagtgacagagccagctatccatcgagcagtacaaacaaccatcattttaggcctaggcaggatttccccggtggtggtactggagatggaagcggttcaaataattagatcagtattgctacgcctatatggtcatgttatatggaataattatcgacaatgatactacgacgctgttacatgcttaattaggttttctctatatatgtgtgtgtgatctaattagcttctctttgtagctttgtactattgttctcttttgctattatacacgagatgttatagt

SEQ ID NO: 186 - DNA, 604 bp, Gossypium hirsutum
  unsure (1)..(604): unsure at all n locations
  Clone ID: uC-gsronu33B008f02b1
gattactacaaatacatgtatccatgtgcccctggagctcaatactacggccgtggtgctttgccaatttactggaactacaactatggagctgctggcgatggtataaaagttgatttgttgcaccaccctgagtatctcgagcagaacgcaactattgccttccaggctgccatctggaggtggatgaccccaatcaagaagaaccaaccttcagcacacgacattttcgtgggtaactggaaaccaaccaagaatgacacagaggaaaaacggggtcctacttttggctccaccatgaacgttctctacggagattacacttgcgggcaaggcgatatcgatcccatgaacatcatcatctcccattaccttcattaccttgacttactaggtgttgggcgagaggaagcagggccacacgaggagctaagctgtgccgagcagaaagcattcaacccaaccccagctccacctgctgccagtgcttcctgatctttggttcagccaatttcattgttaaaatgcagttgtcaatgaagggtattcatangagagctgggcaattagggtgctgtaaatcatggtctatgtcgtgtgagaa

SEQ ID NO: 187 - DNA, 517 bp, Gossypium hirsutum
  Clone ID: uC-gsronu33B008f03b1
cccacgcgttcgcgatgttgttgtgtcggaccggccacaatcggcggctacccttttcttcgctttcctccgccaaacctaagcaatactccatcaggtccgccgtgtcaccaccggaatggcgggagagccggcggtcggttgctatatctctgtttctatctcacttgctccttgcacctaaacatgcgattgcaggtaacttcttggataaatacgtgaaaaagaaaaagctggatccgcttgaggtttatgtgcctgctgttatattgactcaaatacaaattaaagacctggagaaaactttagaagttgatgataaaccggaatatgcaacctgcagatccctgctacgttctggtccggctgcatctcttcgtgtaaatatacgagctggggcacaatatgcttctgatgctggaaatggtgaaaacgctttcaaagacgtggatcaatgtctcagggcattggaggaactagattccttgtttctacatgcatcaagaaatgaaccaga

SEQ ID NO: 188 - DNA, 407 bp, Gossypium hirsutum
  Clone ID: uC-gsronu33B008f04b1
gaaccatatttcctccatgctaagcatatgtacaacttggataggatgaaaaatcagaagctgacaatgtcgcttggagttttgacagccttcagcattggcgtgtttgttcccatctatgctgtcattttccagcagaaaaagactgcatctggttgattttttatgcttgccttcatggcggtatggctgcctgcaataatggaagcaactgcctttgtgatcttcagcttttgagccgatgtagtttgatgattatgatgatacttgcaggattttagtatttctgttggcaatcacctgttgttaattatgggaattgattatttgataataataataataaacaatatatttgattttgcatgggaagggaaggtaagggaattgcttttaggcttaatggt

SEQ ID NO: 189 - DNA, 543 bp, Gossypium hirsutum
  Clone ID: uC-gsronu33B008f05b1
gtttctttttagtgtggggactgtggggctctgttgaaatcgttggaggaagcccaagaacatgccgaactcacctcccattccaacttctcagagtccactgaagctgttctcaatcttgtttgctcttcttgtggcaagccatgccgatccaaaatcgaaagtgatttgcatacaaaaagaacggggcatacagagtttattgataagactttggaggcagtaataccaatcagtttggaggttccaaaggtagctaaggagtcagaggaggctattgctgcaggtagcaccggtgagcctgaagagatggttgttccagaggttgacaaaaaactgcttgaagaactggaagcaatgggtttccctacagcacgagcaacccgtgcactccatgtttctggtaatacaagtcttgaggctgctgtgaactgggtagttgaacatgaggctgacccggacatagatcagatgcccatggtacctgtcaacagacatgttgaggcatctaaaccttctcttacagcggatgagatgaaactc

SEQ ID NO: 190 - DNA, 381 bp, Gossypium hirsutum
  Clone ID: uC-gsronu33B008f06b1
gaccggaactcccagttccgggtcaggccaccgggttttcttcgcttaaggatccaaaaaaatatggggggggtgtcaaacgaacagtcgtgtgcgggcccacgcaccatccattcagaaagcacgaaggccgaaaagccaagagcaaagtcaaaccctacactacgggcaaaaaagccaccacaaaacacaaacgtgcgagttgtcacatgaggacacgcagatcttgaacgccggagccgacaatgctggctgcaaccacccccagaccgaaaggaagggacaccgaggcgactcagaagcttgaagggcgcagaacaagaggacgaaaaggtctgcgaggatgcatgcagaggagactggcaaccaaaaaacccataa

SEQ ID NO: 191 - DNA, 365 bp, Gossypium hirsutum
  Clone ID: uC-gsronu33B008f07b1
tgctcttacagcgcgagctacgaacgggaatcgggggaaaattcctgaaccgggacgcggcggctgacgggaacgttagggagtgcggtgacgtcggcgggggcctcgggaagagttatcaccactgtgtaacggcctgcccaccctggaaacgggtcatccggaggtagggtccagcggccggaagagcacagcacgaagagcggagctcggtgcgcccacagcggcccttgaaaatgcggaggaccgagtgccgaccgcgccgggtcgcgctgatctacgtatgaggtctccaaggagaacagcctctgggcaatggaacagtgtacgcaggggaagtcggcaaaatggatccgtaacctcca

SEQ ID NO: 192 - DNA, 475 bp, Gossypium hirsutum
  Clone ID: uC-gsronu33B008f11b1
ctttctccaagacatttgcagttttgtccggcgttcacagtttggttgtttgctttttgaagaggcttcggggaaaagatgatgttattaatgccggtgtagccggatgctgcactggacttgctctaagtttcccaggtgcacctcaggcacttctacagagctgtctcacctttggggcattctcatttatcatcgaagggcttaacaagcagcagccagcattggcacattcattttctgcgagaaacaagagtgcacaccacaagggacctcgtcctttagcactacccctttctatccctattccggatgagctgaaaggagctttttcttcgttctgcaagtccttggtaaaaccaaataaaggtaggtttcctacaggtaactaagtagtaggtggaccatttttcatttttcctgttgtttgtagaattttgcaagtgttgagaatgtagactgaaagttttgtctg

SEQ ID NO: 193 - DNA, 540 bp, Gossypium hirsutum
  Clone ID: uC-gsronu33B008f12b1
cccacgcgtccgggcgccaatcagctttccgccttgaccgaccgtccggcatcgtcttggccctcgatttttcccttttgtaaaccttttttcaccaattcccgaaatggcagtgaaaccctccaaggccgaaaagaaaatcgcgtacgacgcgaaactgtgccagctcttagatgagtacacgcagatcttgatcgccgcagccgacaatgttggctcgaaccagctccagaacattcggaaaggtctccgaggcgactcagttgttttaatgggtaagaacactatgatgaaaaggtctgttaggatgcatgctgagaagactgggaaccaagctttccttaaccttatccctttgcttcagggaaatgtgggctttgatctttactaagggtgatttgaaggaagtcagtgaggaagtagctaaatacaaggttggagctcctgctcgtgttggtctggttgcacctattgatgtggttgttccacccggcaacactggtcttgacccatcacagacctctttcttcaggtgctcaa

SEQ ID NO: 194 - DNA, 631 bp, Gossypium hirsutum
  unsure (1)..(631): unsure at all n locations
  Clone ID: uC-gsronu33B008g01b1
cccactcgttcggcccttccttgctattcatcattttcctacaactttttcggcttcctgtcgattttagtggctttttcctgatctgcgatcttaattgcaggatacaacatgaagggaggtaaatccaagtcagatactaagggctctaggctcgccgtgaacaagaaatctagcgccaaagctggaaagaaatcggggaaggcggctaaggatccaaacaagccaaagaggcctgctagtgccttcttcgttttcatggaggagttccgtgagcaatacaagaaggaacacccaaaaaacaaatctgtcgctgctgtgggcaaagctggtggagataaatggaagagcttgtctgatgctgaaaaagcaccttatatagcaaaggcagagaagcgaaaggtcgagtatgaaaagaacatgaaagcctacactaagagacagactgaggctcccaaagaagaagagtcggagtctgagatgtcagtgtctgaggtgaatgatgaggaggatgaggacgatgaagaaggcagctgagaggaagaagatgatgactaagaaggaaggaagactngttgaggagatatagcatcacgagtataggctgggtgcttattggttatatgttaat

SEQ ID NO: 195 - DNA, 543 bp, Gossypium hirsutum
  Clone ID: uC-gsronu33B008g03b1
gcactacataaagttactccctgcacttgggaccaatgagataaggaatgttatggacatgaatacagtttatggaggttttgctgcagctgttattgatgatcccctgtggaccatgaatgtggtgtcttcctacgctgccaacacactgcctgtggtctacgatcggggtcttattggaacttttcatgattggtgtgaagcattttcaacatatcctcgaacatatgatctccttcaccttgacggcctcttcacagctgagagccacaggtgtgacatgaagtatgtactgttggagatggaccgaatcctgcgacccaagggttatgcattaatacgggaatcaagctattttattgatgcaatagccagcattgccaaaggattgaagtggagctgccgtagagaagacaccgaatatggtgtagccaagagaagttattagtttgccagaaaagctcttgtattccgctagcggcagttcaagatgacaatatatgtattgcctggttaagttaaaaagtactatataatataata

SEQ ID NO: 196 - DNA, 358 bp, Gossypium hirsutum
  Clone ID: uC-gsronu33B008g04b1
ggaagtgggtatggaatcagtacccaaggtatatgcgactgatacattaggcacacatggactgcacaacggggatcaagcggcggttaaaacctggtgcggcagcgcagaaaagatgccgctgcatgacccaaggtacacggaagctgattacgaagccatgcctgagtggagagttgatggatagattacgaatacggactacccatcaccggctgacacaaaaacaaaagagaagctctcgccatgggcgctaaatgtgagtgccccgattgctacacaataatgctggtttacatggcgccaatgtatcttgcttctcttctttgcaggaacagaggacagtctgcatgggcat

SEQ ID NO: 197 - DNA, 336 bp, Gossypium hirsutum
  Clone ID: uC-gsronu33B008g06b1
gccattcggtcgtttatatagttcaggactacaagggggggtttatttaaactttcactggtggccccccccggtatgattcgcgattaaaatcaatctcgggatcaggatcgcagctccacagacataaaagcgtactccaaggctactagacgaggctaacacctgaggaggctgaagcgctgagagaacacgctggaatttggtttcgattacctgaggcgatatacgtactgctcacaactataacgacagagttccatgcgacctgaaagagcactactctatagcccggctctgttttaatgggagaagtgattgttggcatatcggaca

SEQ ID NO: 198 - DNA, 568 bp, Gossypium hirsutum
  Clone ID: uC-gsronu33B008g07b1
catgtctgtctgcaggttgtcatcctgaagcccattttagtcgctgttacactcgtattatacgccaaaggaaaatatacagatgggaattttagtccaagtcaagcatatctctatcttactatcatctatacaatctcttacaccgtggctctgtatgctttggtgttgttttacatggcatgcagagatctccttcagccattcaatccagttccaaagtttatcatcataaaatctgtggttttcttaacctattggcagggtgttctgttttttcttgccgcaaaatctggatttataaaggatgctgacgaagcagctcaatttcagaacttcattatatgtgttgagatgcttcttgctgctctaggtcatctttatgcatttccatataaggagtatgctggtgcaaatattggtatgtctcgaggttttacacgaagccttgcacatgccttgatgttgaatgacttctatcatgatactgttcaccagtttgcacctacgtatcatgattatgtactgtacaaccataatgatggtgatgagggaacaaggaaatacc

SEQ ID NO: 199 - DNA, 341 bp, Gossypium hirsutum
  Clone ID: uC-gsronu33B008h01b1
cactttctttttaaaaaaacaaagaaaaaaaaagggggggtggttttggaaaaaaaggtggataaaatagaaaaggaacgcttaaagagggaggtctggctggtcgggtttccgagttcttacttctttgacccaagccatgggggggtgcctcctggggggtcttgtctcctgccccctttatcgtgctcactgtttcttttctttttgtctccctggtgtacttttgtggcggggctttcctctcgtgcttcctttgagacccccgggcttgctgactttttggtggtgcgcctcccccgcccttttttcgcctggtgggtttgtgtttaaggccctcc

SEQ ID NO: 200 - DNA, 569 bp, Gossypium hirsutum
  Clone ID: uC-gsronu33B008h08b1
gtgatctctcgcagttcgtctaagcactttgccgatgatttgagtggtcctctttcaccagtgtcactgccagcccctaagcaactaaaatttacccctgggtttgttaatgtatctgctagagactcagcagcatttctagatcaaacacgaaagatggtaccagtaggacatttatcaatgatgaaattgacaaccaagggacaaaccggaaaactctggaggtggaagagaagtcatcaccaatggcttcttcaatttagatggaaatggcagaaaccatggaaactatcagaatggatcaaacacagcgacgaaaccatcatgagatcaaagcctcgtgcacttgctctaactgaccggatatgataaaagcttacattcaccaccttcttcgtcatgtatatatacatcttgactgtcataatggctctccacggcttaccaagaaaataaacccaggcatgttgtaaatagggaagaggttggctcttcctggatgtgtctaaacaatgaagcttatgcaaccgtagtgtgatggccaaggactattgtgatttcattcatat

SEQ ID NO: 201 - DNA, 569 bp, Gossypium hirsutum
  unsure (1)..(569): unsure at all n locations
  Clone ID: uC-gsronu33B008h09b1
cccattcgtccgagaggtaccaaaaccaatattgatgccaatttcaggaaaggagcaaaagtgtgttgggaatatatttagttgcagttttaatgcaagagagaagaaactgatatgtgtgaccagtggcaactcttacttgggttctttcattgtcaaagagctattggctcatggttaccttgttcgagtaaccattcaacacccagctgaatttgaagatgtgaaagacctgctaggggtggaagatttaaacctattggaaagtgtagttgtaaccaagatggaagatttacaaagcctttgtgatgcttttagaggttgccatgctgtttttcatacatcttccttcattgatccacatggtatctctggttattcagaacaaaaggtgtttttggagactgaagtggcaaggactgtcatggaagcttgtgctaaggcagcctatataaagagatgcgtcttcacttcatctctattggcatccatttggaggaatgaaaatatagatggaattattgatgacagctgntggagcagcgaagaaatttgcagagaaaataagc

SEQ ID NO: 202 - DNA, 509 bp, Gossypium hirsutum
  Clone ID: uC-gsronu33B008h10b1
ctctggttaccgcggagatccatcatttggttatgctagccgatatggttcctatgctggtgggcttagtgggactggtataggtccgtatggacgtggaggtggaggctatggaagttacagtggttcaggccctagtggtaattatgattcaggcccgggtgctggttttggtggaccgggtggattatatggtagtagatcaggatacggaggcagtagtcgctatcatccttatgcaagatagaacgtgtttaagatctcccataaaagttgccccaggttttcaatctcatcacatggttcgataggcactgtgcacttttgcaagttgtcactatctagaagatcaaatctatttagatttgcatgcttagtgaaaacccaagttagatcaagcatcaaactagaactgcagctactcatggtagagcaagcaaactcgataatattagtagagcttctatctttcactttaagtttatttattggcggttttattgcagttt

SEQ ID NO: 203 - DNA, 534 bp, Gossypium hirsutum
  Clone ID: uC-gsronu33B008h11b1
atttttaagcacttcttgtcatctcccatctgattttcttaatcatggcttatcatcgtttgcctttttttgtgttaccctttttattaatcactttgtcattgatgagtagcaacacagtcttggttggtgctcggcgtcttttggagacatctgtgccggagattcctaaacctgagttgcctgagatgccgtccttcccaaaggttgaacttccaaagcctgaaatgccagaaatcccaaaacctgaaatacctaaaatgcctgagttgccaaaacctgaattgcctaaagttccagagttgccaaagcctgaattgcctaaggttctcgagttttcgaaagttccagagttgccaaaaccggaattacccaaggttcctgagttttcgaaagtgccagagttgccaaagcctgaatttcctaagattcccgagttgaaaaaacctgaagaagtcaaagttccagagatgcccaatgctcctaaatgtcaaaatctgaagcaccaaaagttccgagttaccaaatctagaa

SEQ ID NO: 204 - DNA, 508 bp, Gossypium hirsutum
  unsure (1)..(508): unsure at all n locations
  Clone ID: uC-gsronu33B008h12b1
ggagtgcgcatcaggctctatgttcgtggagccattttgggttacaagaggtcgaagtcgaatcagtatccaaatacgtcactgattcagatcgaaggggtgaacaccaaggaagaagtgggatggtactgtgggaagcgaatggcgtacatttacaaggctaaagtgaagaaaaatgggtcacattatcgttgcatttggggtaaagtaactaggcctcatggcaatagtggtgttgttcgtgctaagttcaagtctaatctccctcctaaatccatgggtgataaagttagagttttcatgtatcccagcaacatttgagatgcgaggtaggaattgcaagttggtaggatgagttgtgcaagtcgggactggattgcaatttagagctatattttatatctatgatgattttggtagctntttgtatttcttaagataatcaatattgttaagttcaaaatgtggaatctttgttatttataaaatatcagtatatttttggatc

SEQ ID NO: 205 - DNA, 426 bp, Gossypium hirsutum
  Clone ID: uC-gsronu33B009a05b1
ttgacatatgggcaaagctggttgttcattggctccggcggcaatgaccccaactccgacacctgcaccggctccggcaccagaatacgtaaacctaacctatttactctctgtggctggtccatttcacactttccttaactaccttgaatcaactaaagtgattgacaccttccaaagccaagccaacaacactgaacaaggcattacaattttcgtaccgaaagacgattcgttcaagggtcttaagaagccgtcattgtccaatctcagtgatgatcagcttaaatcgctcatccttttccatgccttgcccaaatactatgcccttgccgacttcaattacctttgtacataaggccctatcactacacttgctggtggccaatacactttgaatttcaccgatgactccggcaccgtgca

SEQ ID NO: 206 - DNA, 434 bp, Gossypium hirsutum
  Clone ID: uC-gsronu33B009a06b1
attgaggcaagatgggggtgtttttgttgttttgagcactgaacaatctagaagcgatgaggaacttttggaaatgtcacgttcctgggacattgtgggaattgatttaataagtggcgttacttgtaatgccccttatgagtgggttgataaaacaaaatcagattgggacttcaactccaatggaagagatcaggagacttacagagtcgttgcctatgattttgggatcaagcataatatacttcggcgcttagcatcttatggctgtaaaatcactgttgtcccgtccacttggccagctgctgaaacccttaaagtgaagccagatggagttcttttcagcaacggtctgggagatccatctgcagttccttatgctgtagaaacagtaaaggaaatactgggtaaagctcctgtttttggaatttgca

SEQ ID NO: 207 - DNA, 370 bp, Gossypium hirsutum
  unsure (1)..(370): unsure at all n locations
  Clone ID: uC-gsronu33B009a07b1
ttcatccttgttgaaccttatgggacttttttatacccgaatctcaggagtgctagggaactcgtttacaaaagaggttttggaaagttgaacaagcagcgagttgccttgaccgacaacgcaattgttgagcaggcactaggcaagttcggcatcatttgtgttgaagatctcatccacgagataatgactgtgggacctcatttcaaggaagccaacaacttcctttggccatttaagctcaaggcaccattgggtggtctgaagaagaagaggaaccattacgtcgaaggtggagatgccggcaaccgtnagaattacatcaacgagttaattaggagaatgaattaaaaaactaaactgggttttt

SEQ ID NO: 208 - DNA, 112 bp, Gossypium hirsutum
  Clone ID: uC-gsronu33B009a10b1
tctgaagcatcatctttgttgccgtaggatagagcccgcataacacccaaagggcacgcaaggtttgagcgacggcgaaggactcataatcaaaggatgcaatgggataggg

SEQ ID NO: 209 - DNA, 413 bp, Gossypium hirsutum
  Clone ID: uC-gsronu33B009c01b1
ttcctttctttgcattcctgtgacttctcctgtttgtagacaccattgcagcagctaggaaagatgctggagagtactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgttatgaggagttcgaaccaaggccaaacatttcagcttacggtgatgacgctaatctaaaaggagataaatcatcatcttttgcagaagattttgaaccgagacctaacatttcggcttacggggggcgatgaatgctggtcttaaaggacagaaagaatcattcttaaagattttcgatccacagccaaatat

SEQ ID NO: 210 - DNA, 355 bp, Gossypium hirsutum
  Clone ID: uC-gsronu33B009c07b1
acgagtgattggttctattagaacaggccttaatggatgcaaacaggtaaaggaatatgatcatcttgaaaggaacagcttactcacttatatcaccgtcaccatcccactccgattctgggttagacgacagtacttctgaggttagtgatgccgcactatgctgcatatgcttggagcagatctgcacgagtcgaaggcaagactgtggtcaccagatgtgcgcacaacgcacattgggcctttgctgccataacatgccgaaccccacatctgaaagcgttacacccccagtctgccccttttgccgcagcaccattgtccgattgtcagtagccaagatttaagatttgcg

SEQ ID NO: 211 - DNA, 336 bp, Gossypium hirsutum
  Clone ID: uC-gsronu33B009c12b1
aataatggcagcaatggagttattttggattttgtttttaatgtttttagaacgatatttgagttaaatggaacacaatttttgcctttcaaaaaaaaaaaaaaaaaaaaaaaaaaaaaaaaaaaaaaaaaaaaaaaaaaaaaaaaaaaaaaaaaaaaaaaaaaaataaaataaacttaaaaaaaaataaaaaaaaaaactaaaaaattaaaataacgaaatttaaattaaaaaaaataaacaatgtaaataattttattaaacatttggtgcgcgcatttttgttatattattttttctccttctctttattatattttttatttttttttttat

SEQ ID NO: 212 - DNA, 257 bp, Gossypium hirsutum
  Clone ID: uC-gsronu33B009d04b1
ccggcactgaacactgtagaccttgcgctgaacaaatacctgtatattatgttccgagcccagctcaatacggtattccttaggttcatccagtccaatcacgtggccagcctgctcatcagtctgctctgcaatcgcatcaatggcctgaccggttttgacccaacggtcgatgctgttgtgcaggcttacattgtccacattgaacgtactcaccgatgaacacaaagtgcgagtggttcttagtgacattattc

SEQ ID NO: 213 - DNA, 325 bp, Gossypium hirsutum
  unsure (1)..(325): unsure at all n locations
  Clone ID: uC-gsronu33B009e01b1
ttgaatagcaagaacttgggggaactcttggaggagaaagagtcggtagtggcacaaatggctgagttgaagaagattctgtatgggaagttcaaggactccatcaatcttgaagaggattaatccccttggtttgcttttctttaccttttaagttggattactacttgcttgtgattgatatcagagctttggtcatctttctatttcgatttttagggtttgtcaccctaaacttcctggatatcctctttgacatgaacctatagacagatcaatgaatgaaatggtgttatgaaaagacatagattataaaaaaancagg

SEQ ID NO: 214 - DNA, 266 bp, Gossypium hirsutum
  Clone ID: uC-gsronu33B009e05b1
cagggccgacgacagcttctcctttcccaacagaattaccacattggacatatccagtgccacagcgccaccttccatgccaccgcggaatccgacctttttctccgaatccgaaaacatttcccagctgttatcccatattaaactcctcattcgccgtcgtaccgctgccattgctgccttagatgctggctttttcttcgaagccatttcgcatttctctaaaatcgctgacagtctactccctgtaccttaaagtttttctt

SEQ ID NO: 215 - DNA, 282 bp, Gossypium hirsutum
  Clone ID: uC-gsronu33B009e09b1
aaaaaaaaaaactttgaccaataagaggaaaaaggcgcgccaccaccacaaaaagggaaagactagcgtgtgggggtgcgcttttaagaaaccaggataccggcccactgttgcgcagttttagacgctcctgtgggccccccttaatctattccagggccgcggcttccacaccctgggaccgggaaaacccctggtctagccaagcttaactgcttttcacctcccccccttttcccaggtgtggttttatcaaaaagggcccgaccctgtttccctttc

SEQ ID NO: 216 - DNA, 275 bp, Gossypium hirsutum
  Clone ID: uC-gsronu33B009f01b1
acctctgcttgtttatgaaaagaatgaaaacttgtgcgccaagaagaccaagaagagaagagcaaaaaagtgaaatatgtacgtgagagcggtgccaacgactgatctgaacaagaatacggagtggttcacgtacccaggggtttggaccacttatatcttgatggttttcatttcatggctcctcgttttatctctctttggcacctctgctggaaccgcttggacaattgttcttctcgtgcatttctttgtctcatatcacttttttcact

SEQ ID NO: 217 - DNA, 165 bp, Gossypium hirsutum
  Clone ID: uC-gsronu33B009f06b1
ggcacccttttcaatcatctgcaaaacccacgtctccttttctctttaaatccctttctccgcttcaaactcaactcgcggccaactctgtcccatctccgagacctgcctcttttcgattcccagtcttccaaaccttacaagttcagcacccattttaccacc

SEQ ID NO: 218 - DNA, 107 bp, Gossypium hirsutum
  Clone ID: uC-gsronu33B009g05b1
caagatattacacctcttctgaattcactgtggttgtgggatactgtagtttccttggcacggctttatgatctggcgtttggattgaacgacatagcttcctgtgg

SEQ ID NO: 219 - DNA, 194 bp, Gossypium hirsutum
  Clone ID: uC-gsronu33B009g11b1
cggaaagcatttgcaacatgcctagcttatggttgaaggcatgcacaccatcagtgaccccttccaaccctccgtcgcccacgttaacttgctgctcctccctatcccacgctgtcatgctttgactttgcttatataagaactccaagctctagccttcccttgttattgacccacaccttgccatgaaattg

SEQ ID NO: 220 - DNA, 417 bp, Gossypium hirsutum
  Clone ID: uC-gsronu33B009g12b1
atttctggcaaggagtgtttttcaaggatcgcgtggtactcacttcatgaaggtagaggaaggaccttgaaaggaagagatctgagaagggtccgaaatgcaattttcgaaaaaaccgggttccaagactaaagttacaccaaaaaagagtgagaattttgatttctcgttagaaaaattttcctcgagttttgttttaattttaatttactcctccttttgcaactctgattcgattcaagagatcattttcttttcgtgtaattctaacttcgagatctttaagtgatttagcggagaaaatttcgattcaggtttaattttctttgagatttgattttttttagagtataatttgtttttctttttttcgggtattttggtaagaaaatgggaaaaaatgggctcgttggcttt

SEQ ID NO: 221 - DNA, 195 bp, Gossypium hirsutum
  Clone ID: uC-gsronu33B009h04b1
ggcgtgccactttaggtcaaatgatggcttggccgccgaagagcacgcatgagcttggaaggcaaccagcacacacaaagctttcaagcaacaagacagttagaaggattagggttcgtggtggcaatgtcaagtggcgtgctctcaggctcgacactggaaactactcgtggggaagtgtggctattactcgta

SEQ ID NO: 222 - DNA, 175 bp, Gossypium hirsutum
  unsure (1)..(175): unsure at all n locations
  Clone ID: uC-gsronu33B009h07b1
acagacancnncttaggtggggggtggctgatttcattcatggctctatgcaccaagcgcgctagccggcttggcaagaagataaagcctaaacaaaacattttatcttccaggactcccccattccaccagccgaaatcacctatgaagtctcctttgagatcccctattcccc

SEQ ID NO: 223 - DNA, 457 bp, Gossypium hirsutum
  Clone ID: uC-gsronu33B011a01b1
ggaacacttctcaatggagtttccagcctgtgcatgtgggcgtcagacccaaggtgtcttggcatacgagtttccacatcttgacatcataaatgagttgcttgatgaggagcacaatgttgggaaggcagctagtgcaggagcaggcttgcatgctcttggcaatgagccatatttattaaatcagcattttccttatcattctgatttggtcttgtcagatgttatgggagtcctaagatgctcgtgcatatttgagcgaatgctgagttaccataatgaggggatccatcaaggttatagagaggcctccagcagccatatcgatacagaagtgtagtttattccacaagcttgccccttacattatgctgatggacatcaaattgatggactgctcccaaacctgtggcagatggcaacttcggttctgtctttactcagcatgaggaatgca

SEQ ID NO: 224 - DNA, 124 bp, Gossypium hirsutum
  Clone ID: uC-gsronu33B011a02b1
gcgaaatgagctaccttggtcttttcaccaaattcttggattatttaattcaccattataataacattccactaagctgtattttacaattgaaaaaaaaaagaaaatgcggatggggaatgag

SEQ ID NO: 225 - DNA, 435 bp, Gossypium hirsutum
  Clone ID: uC-gsronu33B011a04b1
ctcttgctttcgctgtacttgacatggtccaagccatgcgcaactactttgatgcgtctattggatgcaccaacctaaccggagatttccgacatgtctgtatctattattagagcaagaagcataactgcacgagagctatgtttaccatcatggagaccaactgttgcgctatttaaactctaataggaacccttctttcggtctgccttaatgctgctttcaaaactggataaattctcgttgctaagcgtatctcgctggatattctagagggcgaactggcgaaccataagtctcacgccgaatatctgtttcaacagctatttatggctaagaagatacattgaacggaggaggaaactgttaagggagtagtggaaaatgatgagccttttgaagagcccttagatgagcaaattgatgggctctatc

SEQ ID NO: 226 - DNA, 508 bp, Gossypium hirsutum
  Clone ID: uC-gsronu33B011a05b1
ctaataggttgcttttttgacaccatttcaaaatcccctataaatacatatatactctgactgtccaaacactccggtacatcaccgatccaatcaatcgcttcaactatctcaccaaacacatatccaatggctccgatcgctgtcggcgacgtgttaccggacggtactctctcctacttcgacgccgatgataagctccagcaggtgtccgtacattccctggctgccggtaaaaaggttatcatctttggcgttcccggtgcctttacccctacttgcagcttgaagcatgttcctggattcatcgagaaagcaggggagctgaaatccaagggcgttgatgaaattatttgcattagcgtgaatgatccctttgagatgaaggcatggaccaaaacttaccctgagaacaaagatgtcaagtttctagctgatggttcagcaacatacacccatgccctggtgctgagctcaacctggcgataaggtctcgcactcgtctaga

SEQ ID NO: 227 - DNA, 462 bp, Gossypium hirsutum
  Clone ID: uC-gsronu33B011a06b1
cggactcgtgggaaccccacaaaatcaccctcccatttgtgtttctcttcattcaaagacattgatgctatcctcaaagaagaagaagaagaacaagtcctctatcctcaatcccctaaaaggccctccattttccaccgtgtcaagctctccaccaccgtcttacgcgcctggtcctcttccaaccgccgtccacttactctccccaacgctgaccaacgcgtcgtcgtttacctcaccagcctccgtgtcgttcgaaaaacctttgaagattgcaagaccgttcgatcaatccttagaggattcaatgttcccatcgacgaacgagatgtgtcattggattctagtttcttagacgagttacagggatccgtggggcgtacaaaagtttcacccttcccttggttttcatcggcggaacgtatatcggccgagcagaggaagtgaaacgattacatgaat

SEQ ID NO: 228 - DNA, 402 bp, Gossypium hirsutum
  Clone ID: uC-gsronu33B011a07b1
tctctttcagttccccaaatggttccctattactcgcgaaacttacctcgatcgcctctccttgaggttcgagcgtgaaggagagcccaatcaacttggcgccgtcgacgtcttcgtcagtaccgtcgaccctctcaaggaaccccccatcataacggccaacacggttctatcgatcttggccgtcgattacccggtcgagaaagtgtgttgttatgtgtcggacgatggtgcttccatgcttcttttcgattcgttgtctgaaacggctgagttcgcgaggagatgggttccgttttgtaagaagcataatgttgagcccagggcgccggagttttatttcaatgagaagattgattatttgaaggacaaggtccatcctagctttgttaaagaacggag

SEQ ID NO: 229 - DNA, 447 bp, Gossypium hirsutum
  unsure (1)..(447): unsure at all n locations
  Clone ID: uC-gsronu33B011a08b1
gcgtccattcgtccggtttttctttttttctttatttttaagtgtcaaaccccacaattgttgaggtaaacattgtgaataaaaatggaaaaacaaatgatatttgcatgggcaatgatattttgccttgccatggcaccagtgtatggccaatactactccagaactgttaaggcaggtcctcgggtggaaaagattacccacctgcacttctacttgcacgacattcgcagtggcagtaaccctactgcattcctgatagccagttccaacatcacccaggacccgccctgatacggtaccttgtttgcaatggatgatcctctaactacagagtttgaactaacatgcacgctcgtcggaaatgcccaagggctctacttagcattgagtcgagacncttaccaagttttctgcagtcttttacgctgatttactgttaccact

SEQ ID NO: 230 - DNA, 471 bp, Gossypium hirsutum
  Clone ID: uC-gsronu33B011a09b1
cccacgcgtccgggagtccttcgcatggaaagaacaaaaattaccgatgcttatcaccgtcatccaaggctcaagctatcgctagaggccaaaaggagcttatggaaatggtcagcagaatgcccgagtcttgtttcgaacttactttgaaagatctagtcgaacaacaacagcctgtggttgttgaaccgagacagaagagtgttgctgaagggagaggtaccatcgaccaacatacatacaacaaagagaaggggaagaagaagatgaagaagaatccgaagcctcaatttatatgaagtgggagcacagataatggagggcttcttttgaaaatggtgtttccattttccttagggtcaaagtgtaagaacaagaagaagaagaataatgagtctaatacaaatcataattccaaagtttctgcaaagccaactgtatcagatgaatctggtaggaacgtagataaga

SEQ ID NO: 231 - DNA, 506 bp, Gossypium hirsutum
  Clone ID: uC-gsronu33B011a10b1
ttcctctcgtccgcccacgcgtccgttgctctccacgaactggttattgcaagtggtgaagatccgggagagcgcattgaggagatggcatcactgctcaagaagcttaaagattttgtcctcactgaaaatcctgaagctgacacctctgagggtgaaaagggcttgatgaaacacaggtcacctgttatcccagatgatttccggtgtccaatatctctcgagttgatgaaagaccctgtaattgtctccactggacagacatatgaaagatcctgtattcagaaatggttggatgctgggcacaagacgtgtccgaaaacacagcagacactattgcacactgcccttacgccaaactatgtcctaaaaagtctcatagctatgtggtgcgagagcatggtgttgagctgcctaagaaacaggggacttgtagaagcagaaaagcaggtagcagtgcttcggactgtgatcgtactgctatcatcacttgtgtggaaaaactg

SEQ ID NO: 232 - DNA, 53 bp, Gossypium hirsutum
  Clone ID: uC-gsronu33B011a11b1
gcgtccattcgtccgcccacgcgtacgcccacgcgtgcggttctagatcgtga

SEQ ID NO: 233 - DNA, 410 bp, Gossypium hirsutum
  Clone ID: uC-gsronu33B011a12b1
gctgcatgtcgacgccggatctagggtttcttttaaaggcttctgatgatgaactgggtttgccacctagttattcgtctgttgagcagggcgtggatataaagggaagtgctctaataggacctccatggaatacaggaaatgattggatatgagctcccaactcccctgtaccgatcgctagacttctgcatttgctgtgactaacattccgacaacaaaaatcatagacatagccgtgattttgtggcgttaggaggcttggtcgaacccatggacgaaatatcagagcttacctgatgacctgaatccatctgcgcactacatgtgccattggattatagcttcttagacgaggtacaagagaatcgtgtgcgtaaccaatagaatacccttacctactaaaatgg

SEQ ID NO: 234 - DNA, 245 bp, Gossypium hirsutum
  Clone ID: uC-gsronu33B011b01b1
gcgcccacgcttccgcccacgcgttcgtccacgcgtgcgcccacgcgtccgaaagaagtcaatgtttagtatagtctattgaataatctattttattctaaacagtgaggatcctgtcaatttctactataaaagatttgatagaataaaattacttacaaagggaaaaaaaaaaaaaaaacaaaatcaagcgaaaacaaaaaataaaacaaaaaaaatacaaaagaaaaactggggcgcccgaa

SEQ ID NO: 235 - DNA, 464 bp, Gossypium hirsutum
  unsure (1)..(464): unsure at all n locations
  Clone ID: uC-gsronu33B011b03b1
cccacgcgttcgctgaaaactaattgaaatcgacggctggctctcattttcgttcctctcgggcttccggcaccgtggacacccaaaatggaggctcaccggctatctactactaaacctgtacaatctctcaagccaacgtaaatgattcctttagaggaagataccggtaaagcctgcgacgcactgtcggtttccttgtacctaacgaacgccctgttctgcaccctcttcttctcggaggtttattttcttctttcccgttggcgtgagaagatccgtacctccacacctgtgcatgtcgtcaccctttcccgagatcatcgccattctctcatttgtcgcgtnctttatttaccttttgggttttctttggaattgaccttcgttcaatcttgtggttctccaaccatcgcctgacatttggattgccaggaaagtggagatgaagttctgcttgcaaa

SEQ ID NO: 236 - DNA, 243 bp, Gossypium hirsutum
  Clone ID: uC-gsronu33B011b04b1
aactgtgtgtgtagtcctaacaggaagctgatcgttgcttgggtacttagaacagtgttttggtgttgaaatatagattggtggaaactacggggcaggtaggcaggggttttttctttggtgttggattgtgtgtatttgaaccaattagattgacaatgttattgtgtctgaatatatggtctagtctccctatataataatatatgtagcctgatcttaatttctcagcttagctgatat

SEQ ID NO: 237 - DNA, 121 bp, Gossypium hirsutum
  Clone ID: uC-gsronu33B011b05b1
cgttttttgagatcttctttgtgggtagttagtttgcattactgtctctgcgccatagacgacagatgacatcttgttttctataacagggataatagcatatttggaactgtattttatc

SEQ ID NO: 238 - DNA, 514 bp, Gossypium hirsutum
  Clone ID: uC-gsronu33B011b07b1
gtctttatccgcatattatgttagcccttcaaagctccgtcaacaatggcgaaaacgacccaaaccacgaccaacatcacgatcacgacgatcaagacggtgaacgtatcagagacatccatgctttaaccccaccacaccctcccgccgtcaacgcccgtcgtcgttgggaaaccggaagcagccgtgcatcgtcatcgagcgaagtagctccgagtgaaaacttcaccaccatgagccgagaattcaatgctctggtcctcgccggatcttccatagaaaacaacgattccgagttccgtacatactttgaataacaatcagctgcgaggatcggggaagatcatgaactgcaagaggaaactaaccctttagctatagtacccgataatggtccgtaccgatcgagaatcggatcaacaagaagggtagggttggtgggttagaaaacggcggcaactgctgcggcgggaagtggtggtagtagcggccgacatgggaagtcacggtgctg

SEQ ID NO: 239 - DNA, 237 bp, Gossypium hirsutum
  Clone ID: uC-gsronu33B011b08b1
cgttttgttcttgagttgttggggtcctaactcatgaaccccccctcccttattttatgttaaaagtacaagggaattgtataaattacttggatgtacatacatatcttttttttttaatcttatatatgaattatatagataatagatatgcaattgtttcaggattttgcatgaggttttttttatgtctatatttcctctaataataacaagtaatgctttagattatgtttt

SEQ ID NO: 240 - DNA, 441 bp, Gossypium hirsutum
  Clone ID: uC-gsronu33B011b09b1
gcgccctcgcgtccggaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctgacccaagcaagctaaacagtatcacatgttgctattgttgccgctacttgaagcactgttcatctatttaatgaataaagtgacttcctttttcatgtatatttgatctgaattggtatgttttagatcaatatgcagtcaagggggggggctttgtatttttttgcatgtttggctttttaaatctgtatgaattcaatgtagtctatgctttt

SEQ ID NO: 241 - DNA, 408 bp, Gossypium hirsutum
  Clone ID: uC-gsronu33B011b11b1
gcgcccacgcgtccgattttctttccttttcttttctttttttccttcttctttgtgtagacagatacaatgatgtcaattaacaaagggaaagaaatagctgaaggttcttcgggaccggctgctgttgctgttggtggtgttggtgggggtgatcagcggaatccaccgccgttgagcaggtacgagtcgcagaagagacgggattggaacacgtttggtcagtacttaaggaaccaaaggccaccggttgcactttctcagtgtaacgctaatcatgtccttgaattccttcgttatctcgatcagttcggtaagactaaggtgcacttacaaggttgcgtgttcttcgggcaaccggagccgaacgggccatgtacatgtccctttagacaagctggggtagtc

SEQ ID NO: 242 - DNA, 526 bp, Gossypium hirsutum
  Clone ID: uC-gsronu33B011b12b1
acgcgtccttgctttcgttctgcaggacatgctcggaggacatggatacttccttcaaccgccgatcagcatcgaggacatctatcattggatataaccctcctgtatctaagattagcaaaatttggtataaagtcccatgatatcctccagactgtaaatgtaatttttgagggcatctgtaagctccagagttttttgtagaattcttttacctcggtctgtattaaataatcattacggtctcgactagcatcttgtaatagtttataggcactacggaccgaaaattctcccgagagttcccctttccacacttgaaaatcttcatgctcaaactctgctaggggaatctgcaatattttcctagcaacttcctcttgaaagtttatcgaccccctgaatccagtcatcattccaaatggagatactatgccctgtacccaccctgcagctcattcctttttggagaagaccttttgcagcccatatactcttccaggtaaaagaagggaaatattacctg

SEQ ID NO: 243 - DNA, 467 bp, Gossypium hirsutum
  Clone ID: uC-gsronu33B011c01b1
gcgaggacactaagggaatagatgctgcatgcacaggggaaccttggagacggatctcacatgaacatgggcaagagagtgcacggatgccagctttggaggatttgagagctgagccaggaatccacatgacccagagagcctattgacaagcctgaagagagcctgtcggtggggataacctccatgcttggctggagactgtgaccatcacaggtgggaagagtgcacattggaacattggcgtggaaaggcacaaacaggcgaccacaatccctggtctgatggacggcaccactaagcccgactacgctacctgtgttaagatctctactgatgcttccatcaaagaaacgatcccaccgggtgctcttgtcatgctcacacccgtgggtgcaggtatcttctgaggcatggaatctgtttccggtgtgctcgctggatccctcgactcacgtgttcagatc

SEQ ID NO: 244 - DNA, 476 bp, Gossypium hirsutum
  Clone ID: uC-gsronu33B011c02b1
gcgggaaaacttcatggttcccaaccttgaccggggcttatggcagtactcccgtcatccaaactactttggagagcagttatggtggtgggggctggttgtatttgcatggaacttgggtcatggatggacctttgttgggtctttgatcaacagtatgtgcttagcttatgttactgtgctcgcggagcaacggatgttgaagcacgagtatagagctgaagcatacaggttataccaaaagacaacctcagtgtgggtaccttggttcagatcttctgctatggcagtgaaggataaggatacttgatctgactatgtttgtttcattgaaacaaacatcttgtgttagttgttatcctttttagctatctatttgagagggggaaaaaatgggtcttaatctgtggtagtaaagagagatccctctatcgctatgaactcaagtaaattatttcttcatttgtaataaaaac

SEQ ID NO: 245 - DNA, 502 bp, Gossypium hirsutum
  Clone ID: uC-gsronu33B011c03b1
catgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttaccacttcccattggatttgccgtgttcatggttcaccttgccactatccctatcactggcactggcatcaatccagcaaggagctttggagctgctgtgatttacaaccaagaaaaagcttgggatgatcaatggatattctgggttggacccttcattggtgctttcgttgcagccttttaccaccaatacatgctaagagcagcagccattaaagccctttggatctttcaggagcaatgcttaaaaacatttcaccttcattacaataagaaaacattgatgtaataacaaatgaggaatgagagcaagtttatgt

SEQ ID NO: 246 - DNA, 565 bp, Gossypium hirsutum
  Clone ID: uC-gsronu33B011c04b1
cgatgtcttccagctgctgccagccaagattcaggtgggagtattttctgccacagtgccgcctgaagcccttgagatcactaggaagttcatgaacaaaccagtgagaattgtggttaagcgtgatgagctcaccctcgagggtatcaagcagttttatgtgaatgttgaaaaggaggaatggaagcttgaaactctctgtgatctctatgagacccttgccatcacccagagtgtcattttcgtgaacacaaggcgcaaggttgactggctaactgacaagatgcgaagccgtgaccacacggtttctgccacccatggagacatggaccagaacactcgtgacatcatcatgcgtgaattccgctctggttcttctcgtgttctcatcacaactgatctcctagctcgtggcattgatgtgcagcaagtgtctctagtcataaactatgatctgccgactgaaccagaaaactaccttcaccgtatccgacgaagtgaaggattggaaggaaaggtgtgccatgactgtgtgactaatgatgacagagatgctgttgacatc

SEQ ID NO: 247 - DNA, 550 bp, Gossypium hirsutum
  unsure (1)..(550): unsure at all n locations
  Clone ID: uC-gsronu33B011c05b1
cgatctctttttttgagtcaaagcagaatcaaacagagagcttggtggagcaacccgttttgcagccaacgacatattcgggtagtcctatgtggcactatattccgggttctcattactctgtacctgccgctcaacaaatacctgtatattatgttccgggtccagttcaatccggaaatccgcaggttcaacctgttcaaatccggccacagtatgtccagcagtatccaatgtcaacgggtcaaataccggttgggtatcatcagccggttgctggtgtgggtcaagcatacaggccagtaacggcacgtggacccttatgatcccgcataagagtggctccgatggtgtgaaacaacctatatattatggagttagaaatgcgggtccagtgccagtttacttcagaatggtggtgccngtggggagagattgggtagaagcgggtcggattcacacagggtcgggtctcgcagaaggctgtagtgagcggtgtaaatatggaaggtatttcttatgtatggtggttgagatatatgactgggtt

SEQ ID NO: 248 - DNA, 571 bp, Gossypium hirsutum
  unsure (1)..(571): unsure at all n locations
  Clone ID: uC-gsronu33B011c06b1
gcgtccttctttctcctatactcaacttcttccacttaaaagcaggttagctagctagggtttggcgagccagagagatgggttcaaaaagaacggcatcactagccctgttctttgcactcaacatcctcttcttttccctgatgagtgctagtggttcctgcccttcccccaaccccaaacctaaacctaaaccaaagccaaaccccactccctgcccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaagaaagtaccctctggcttccaatgtcgctaaatcagttctctaaattctntctcttcttagtgctgcgtggtttgatgttctaaggtctagtttgcatgataatgtttcttg

SEQ ID NO: 249 - DNA, 433 bp, Gossypium hirsutum
  unsure (1)..(433): unsure at all n locations
  Clone ID: uC-gsronu33B011c07b1
agatgctcttgatgctgcaggcaacaccactgctgctattggaaagggtttcgccattggttcagcagcactggtttcccttgctctctttggtgcctttgtgagccgagctgctatctcaactgtcgatgtattgacccctaaagtttttatcggtttgcttgttggggcaatgcttccttattggttctctgctatgaccatgaagagtgtgggaagtgcagctttgaagatggtcgaggaagtgcgcagacagttcaacacaatccctggtctcatggagggcaccactaagcccgactacgctacctgtgttaagatctctactgatgcttccatcaaagaaatgatcccaccgggtgctcttgtcatgctcacacccnnntcgtgttggtatctttttcggcgtggaatctctttccgtgtcctcgct

SEQ ID NO: 250 - DNA, 512 bp, Gossypium hirsutum
  unsure (1)..(512): unsure at all n locations
  Clone ID: uC-gsronu33B011c08b1
ggttctcaaaagtctttcaattctccatctccttcaaaaagttttcttcccaatggcttcaatttgcaacagattcatcagtagatcatcacccttcatcaaatcagctgttagatctaacggtccaaaatcctctttttccagatccgccgccgctccctccatttcctcacctctcccctccccttccatatctcctcttcgccgtttctcctccaggtgtccatcggagctgggatctgtgcagtcactgttgccgctacacagcgcagtggcagtggcgaggatgacttcatgcctgagcacaacatcgaggagttgccgggctctttctcagggtacactctgctgcacctatcccggcctctagtactngtttatctgttttctataatggaattgatgggtacgtgagaacatgtagctgtttcggtggtcgacctgtcatctattcttatttgagtttatagattgacactgttgaactacttagatgatctattcatatacta

SEQ ID NO: 251 - DNA, 333 bp, Gossypium hirsutum
  Clone ID: uC-gsronu33B011c09b1
ctcttctgaacacgcatgtgcctgaactattcgctgaaacaaagtactgcaactcatacagattctaagattgcaccaccgacggtagatctaactgaacttaacccatgtacaaatcagaggatatacaggtgatgataaaccgagggctgatgcgaggaaaggaggggaggccgcgctccggctttagcaaccgctatctccacaccaaccctagagcttggccgttgatacctaataggtagaccaaactaaacacatgcactgcccgtggttttccactttcaagacctacgccatgcactctccactggatctcctatatgattacta

SEQ ID NO: 252 - DNA, 549 bp, Gossypium hirsutum
  Clone ID: uC-gsronu33B011c10b1
tgtattataattgctttaatgtttttctctttggtgacctaaatctgtgttatttgcttctttcaccatgaccaagcagcaggctaactggtctccttacgacaacaatggaggatcttgcgttgcgatcgctggagctgattactgtgttatcgccgccgatactcgaatgtcaaccggttacaatatactgacccgagattactccaaaatatgtaaacttgcagataaatgtgtcatggcatcctcaggatttcaagctgacgtgagggctttacaaaagcaactggcagctaggcacttgatttatcagcatcagcacaacaagcaaatgagctgccctgcaatggctcaattgctttccaacacactttatacaagcgtttctttcctactattctttaatggtttgggtggccttgataacgaaggaagggttgtgtcttacatatgatgctgttggttcctatggaggttggatcagtctcaggttctgttcaacgtcatatgccgtcttgataccactgagttgcagccttttatgctgca

SEQ ID NO: 253 - DNA, 505 bp, Gossypium hirsutum
  Clone ID: uC-gsronu33B011c12b1
tgtttatgccgagatgaggggtattgagatggaggaattcgagaaagcttcgattgtaggggctgaaaacggggtgacattgaaattgcttgataccactaggatgtcaatgttgcggcctgacggtcacccgggaccttatcggcagtttcaaccctttgcaaaggataaaaatgtcaaagtgcaaaatgattgcttgcattggtgcttaccagggcctatagattcatggaatgatatactaatggagatggtaattagaggggcacattaataatttagccattttttgggggacttgagttgcaaaaatgcttttattttttaaaaaattttaattttttgttcaaaggaaggggatcatggtttccaagttgcttggaattacttattttttaacaccaccatcaggtcctattagcttctccaaagaaattaaaagcccgtttgatgaaacttaccttgggtcctctatcaaattgattattaaaaatcaaataaattc

SEQ ID NO: 254 - DNA, 324 bp, Gossypium hirsutum
  Clone ID: uC-gsronu33B011d02b1
ggaccgggcctgaattccgggttaccacgcgccttatttctagaaacgcccattgtaggcacgggcagggtcatgcacgtagcgggtaaacctgaaagtctacattaagtgataaaacctcactagacctaagcgttggagaggaacctttagaacatgaacaaaccatgagcccacccaagttaactggttcaaaacatcattcttcctagtttgaaaagagcatagatagaagaactcctatggtgcgtgcctgaatgatgaaagacccggccgtattgtgtaagggacccggcccggaacagtaaataaaacaccaaaaat

SEQ ID NO: 255 - DNA, 537 bp, Gossypium hirsutum
  Clone ID: uC-gsronu33B011d03b1
gcctcactccgccatcttcaataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagttactggtgtttttactgacaaggacaaggctgctgctcacttgaagggtggcgcgagaaggttatcatttctgctcccagtaaggatgctcccatgtttgttgtgggtgtcaatgagaaggaatataagcctgaccttacattgtctgcatgctagttgcacaccact

SEQ ID NO: 256 - DNA, 497 bp, Gossypium hirsutum
  Clone ID: uC-gsronu33B011d05b1
gaacccattcccctcctttagggtttagcagttaaaaagagaaaagcaaaagtatggcgaccgccactgtccccgctgccgcaaggcagctttctcctaaggaagccgacatccaaatgatgttggccgccgaagtccatctcggtaccaaaaactgtgacttccaaatggagcgttacgtcttcaagcgtcgcaatgacggaatctacatcatcaaccttggcaagacctgggagaaacttcaacttgctgctcgtgttattgttgccatcgagaaccctcaggacatcattgtccaatctgcaaggccatatggtcagagagctgtactgaagtttgcacaatacactggttgtcatgcaattgctggaaggcacactcctggtaccttcactaaccagctccagacatcgttcagtgagcctcgtcttcttatcctcacagatcccaggactgaccaccagcccatcaaggagcagctctcggaacattccaac

SEQ ID NO: 257 - DNA, 525 bp, Gossypium hirsutum
  Clone ID: uC-gsronu33B011d06b1
cctatatatatcaaaccttggttttctgtaaatctataaaactggtttgattcttcttcgggttatcagacttttggtgggtttgggttttcttttttcgtttgatgaacaaagatgaccgtggaattgaagatggtatacggcggtgatggtggtggtagttttgcaagaaaagtggcggaaactgctttgaaagaagctgcaaattctgggattcagggtgttgaagaattgataacgttgatgtctaaaaatcaagagcttttcaatccagatgtttctattaaaactgctgctccatcaggttcagcagagtcagccatggatatccaagctgttacagataagactgttaactctttaaagaggttatttctttattggatcgaccgagaatcggccatgctcgatttagacgagcccctgttcttgacccaaaccaagatacagaacaggcttcgaagaagattcaagagccagagacaggcgtcttcttcttttcaagtaaccaaagatcaagtgtct

SEQ ID NO: 258 - DNA, 250 bp, Gossypium hirsutum
  Clone ID: uC-gsronu33B011d07b1
ttatgtatactagaaattcccattgtaggcacaaccattgtcggtgtttgtagcgaataaacctgttagtctacattaagttataaaaccttcctagtcctagcgtttgtgagtaactttaagattctatcagtcatgagtccgaacgagtccctgtttcaaagcatgatctttttagtttgtaaagtgcattgcttgttgaacttttatggtgcgtgtttgaatgatgaaagacctcgacatattatct

SEQ ID NO: 259 - DNA, 607 bp, Gossypium hirsutum
  unsure (1)..(607): unsure at all n locations
  Clone ID: uC-gsronu33B011d09b1
gcagtcttttgatctctgccccaaagcaaaaagttgtcatcttttacaatcacaactactggttatttattttcatggctcaaggagattctaacttccagcaagacatggctaaagaggaagaagaacagaggctgaaatacttggagttcgtgcaagtagccgccgttcacgccgctttgtgcttcaccaacctttacctttacgctaaggaaagatcggggccgttgaaacctagcgtcgagaccgttgagggaacggttaagagtgtggttggaccggtttatgataaataccatgatgtccctgttgaattccttaaattcgttgattccaagntgggtgaatcagtgaccaagcttgatcgtcgagtccctccagtcatcaaacaggtctcaaccgaagccatcttggcagcccaaaaggctcccgaggtggctcgtggcgtggctcncgaagtccaccgtgctggagtggtgaacaccgcctcaggattagcnaaatcagtgtacaccaagtatgaacccacagcanaagagctttatgcgaagtatgaacccaaagctgaacaatgtgcggtttcagcttggcgtaaactcaacatgct

SEQ ID NO: 260 - DNA, 518 bp, Gossypium hirsutum
  Clone ID: uC-gsronu33B011d11b1
tcctcgcgtccggcggacaaagtattcccttgctgcaaacccaccgccaccgctgcccctggtggatcagcagctcctactactactaccaccaccaccaccaccacaaccaacggcggaactacaaaatcccacctcattaaccccaccgcccgcctaccctaccgtccacagccccataacagacgtcgcaactaccgtccacggcgcaactactgttgctgctgctgtttctggatcatcctcataatcctcgtgctcgcccttttagtagccataactggcacagtcctttacgtcctttaccgccctcaccgcccttctttcaccctcgctgtcctccgtatccaccgcttgaagctcaaaaccgccgtcgactcctccacttgccatctttcaacccttttcaacttaaccctgtcttgcaaaaaccccaactctcatttctgcttctcgtacgacccattcgtcattcatgtgtgaccagcaatggcgatgttctgatagggaaccgaacg

SEQ ID NO: 261 - DNA, 566 bp, Gossypium hirsutum
  unsure (1)..(566): unsure at all n locations
  Clone ID: uC-gsronu33B011d12b1
gcgtcctcgcgtccgatgcactctaatactttgcttggtgaatttgaaaatcttgacttgtacaggtctgtgcaaaatgggtcccgggaacacttctcaatggagtttccagcatgtgcatctgggcctcagacccaaggtgtcttggcagacgagtttccacatcttgacatcataaatgagttgcttgatgaggaacacaatgttgggaaggcagctagggctggagcaggcttccattctcttggcaatgagccatatttattaaatcagcattttccttttcattccgatttgggcttgtcagatggaatgggatcctcaagtggctcgtgcagatttgagcgaatgcggagttaccataatgaatgggttccacaaggttatagtagctgctgcagcaaccatttcgatacagagagggagtttattccacaagctagcccnctacgttatgctaatggacaacagattgatggactggtcccaaaccgtggcaaatggcatcttcngatctgtctttactcagcatgaggaatgcagatggtgaaaatacgcatactaca

SEQ ID NO: 262 - DNA, 444 bp, Gossypium hirsutum
  Clone ID: uC-gsronu33B011e01b1
gcgtccactcttccgggcaattatggggttttttgtagatgtgttactcgttcaagtcggcaactttgttgatggctctccatggaatcatcatcatagtcatcggccccatcgtggatatcatggaccatggatcaatgctcatgccactttctatggaggtggtgatgcgtctggaacaatgggtggagcatgtgggtatggaaacctgcatagccaaggatatggggttaatacaccagcattgagcagtgcattgtttgacaatggaatgagctgtggtgcatgttatgagctgaggtgcgcgaatgacccgcaatggtgcttgcctggttccattgtggtcaccgccactaacttctgcccacccggcggctggtgtgaccctactaaccaccacttcgacccctattttccagcgcattgctcagtacatagctggaa

SEQ ID NO: 263 - DNA, 385 bp, Gossypium hirsutum
  Clone ID: uC-gsronu33B011e02b1
ctcttcttttagtattttatgcactaagaatgtggtctaagggttctagttgtgttgtggtgaagggagtgtccttgaacaggagactaagaggtaggttgttcacttgtctgggcaatacccctttgttctccttttcctcctttgtctagtgttagcctgggggttctttctttctagttgtctcatatgattgaattcgcctcaatgttttatatgaggcaagtggattaactcctaattgcttgctgctacagtaggtacacaatattcattgagtgcggctctgtcaaaccacacattcacctttggtagttaacccttcatgggggacttgaatgtggcactgactgtaagcatgttggcacaagctggctgtttatta

SEQ ID NO: 264 - DNA, 427 bp, Gossypium hirsutum
  Clone ID: uC-gsronu33B011e03b1
gcgccctcgcttgcgcccacgcgtccgcttttatctcatgaaatgcaagagtttctcctctttttgataaatacttaatttcgcttcatttgagtcttctttcttaaatttcgtctaaaaatcctctcccaatttcatttccaaagcttttcaattctcttgattgttcatatattataaatttcttctttttcagccatgggtgttgcagttctaaaaccagacgattgtttgaagctaccaaatcccgtgaaacaacgaaatagtctttgccttaatccgaaccgatcgaatcggtcacacccaaaccgtaaactcggtctgctactacctcccctgctttccagtctgccggccccaggtaccgctaaagatctcgggtgggtcaagtaagatcctcaaccccgtgaggttctaaaaaaccgac

SEQ ID NO: 265 - DNA, 447 bp, Gossypium hirsutum
  Clone ID: uC-gsronu33B011e05b1
atgaaattaaggctgctatcaaggcggaatctgaaggcaacttgaagggaattcttggttatgtggacgaagatttagtctcaactgacttcatcggagacaacaggtcaagcatttttgatgccaaggctgtaattgctttgaatgacaactttgttaagcttgtgacttggtatgacaacgaatggggttacagttcccgtgttatcgacttgatccgacacatgtctaaggcttaagtgagtgagtgattgtgctttgtgtatccaagctttagcaattttaatttagaagagatgttatgagagaataaacgaattgtacggagcatatttttgtgtgaagaggggttgtttcagttttattacccatgtacttgaatgtttcaagttcattgcaggtgtttctctactttaatgcaatgttggattatgggttctctactta

SEQ ID NO: 266 - DNA, 99 bp, Gossypium hirsutum
  Clone ID: uC-gsronu33B011e06b1
ccctttctttcgaccacgcgtacgcccacgcgtccgatttttgggaaaattgcgcaagggctttgagttccttcgttgcgaaaccaaaatgggactttg

SEQ ID NO: 267 - DNA, 553 bp, Gossypium hirsutum
  Clone ID: uC-gsronu33B011e08b1
tcggtctcgtgggctatatgcggcaaaacgatgatgggaagactgtagcagcgatggatatgttggtgcctcgggttggtgagctcattggtggaagccgaagagaagaacggcttgattatctggaaaatcgtttagatgagttgaagcttagtaaggagagctactggtggtatcttgatttgcgtcgatacggttcagttcctcatgcgggtttcggactcggcttcgaaagactggtacagttcgccactggaatcgagaatataagagatgcaatacctttcccaagagcacctggttctgctgaattttagcggtgcaaacataaacgagttttccatattttcttaagcagttttttagctttcgtctttttctttttcctttctcaaattcatattttatactaagatatcccatctattctttttagggcactgaagactttagccacctttttgccttttgtatttttttttaaaattatattgaagtttataatatgtaaaaactgaaactagttctgttgtaaaatgaatttatatattat

SEQ ID NO: 268 - DNA, 538 bp, Gossypium hirsutum
  Clone ID: uC-gsronu33B011e09b1
gcttcctcgcgtgcgcccacgcgtgcgcccccatcccctccaggcttttggatgtccttcctccgtgtgatgcaaggtgttgttaactgctttggcaggatatctattctgatagaccagaatacacaagcattccacatgtttatgactgctcttcttcagcttttcgatcgcacgggattattgtatggagagttagctagatttgtgttaagactgctgggaatcaaatcaaaaccccgaaagatcaatcaaccaggaccaggtggactcccaggaccccataaccctcatgggaatcaaaactacattgaagggccaaaggctgctcccagtggtgtatgggacaatgtatggggagaaaatggcagcgcctagtttgattatggacggtggcctagccaaagcacacgctgcaatttgagtaccctgcttgaataagacaggaggacctcatttgagaatgtgaccgagtttttctacattgtctgatatacccccactctcatagtgtaaaaaagaagattgaaactaataa

SEQ ID NO: 269 - DNA, 457 bp, Gossypium hirsutum
  Clone ID: uC-gsronu33B011f01b1
tactatggtaagttggacgcccgccggaccgacccggaactgatggctggaccgacgcacgcgaagagctttaacattaacgccctacctaaaaccggtggcgtcaaatacaggaatctggccatacactgaacgttagggttatggtttactgtatctactctctggggcaatggaggccccatgggcgacgctggctccaagcttctcaaggcgggacatgccgtcccagatcaggctccatccttgataatgcctactcaaatgaaacgcatgctggaagatggatcatctgctgataattcattgttggaagatgttaccatcgatcctgttgtgcgaggatgcgttaaagactgggatgccatggaagatttgttgcaccatgttctatacacaggccctgaatggaaggtggaaatgaaggacaaattttgtttactgcaccgttttgtac

SEQ ID NO: 270 - DNA, 419 bp, Gossypium hirsutum
  Clone ID: uC-gsronu33B011f05b1
gcgtcctcttcttgcgtccacgcgtgcgaccacgcgtccgctgatgttcactgcagtgggtcacctctaatgacttattaaactgcaaccaactaaaagacttctcaagacctgcttgacaatacagtattgtcaaatatcttagccgtatattttgcaattctatctgttgtttctatagtccaaccaagggtgtctaggaatgtttaggacatgacatgatataatccttcatccgaatttgtttgcattgtctaattggatcatgttgtgcactaggaagatgtaagaataacatgctactctatgcatatccattctgctttagttcatttgtagctagacaccttcctttattagatgtttctttgttatggaattatataggctttcaaattttaaatacaagtgtgatatat

SEQ ID NO: 271 - DNA, 527 bp, Gossypium hirsutum
  unsure (1)..(527): unsure at all n locations
  Clone ID: uC-gsronu33B011f07b1
tgttgtttaagtggaaatggacttcgagtggctactggttcctacagcaatctgtttcgggtgtttggttgttctgaaggtagtacggaagcaacaacactggaagccagcaaaaaccccatgaggagacaaggtcaggcgacatcaaggccttcaagatctcttggtaatctctctggtgttgtccgacgaggtttgtgtttcacatccttactgattcgtaatttgaaatgatctgtaactcatttaattgcatattttcatgatttcgcttgattattagtgaattagtattatagccatttcctgagcacctagttttcaaataatcgactcaaaaagcattatatataatatcttttgaggtaaacatctatttaactacatgcatttctcgtcgccattttagtgaaaggagcagataactcgggagttgatgcnaatggaaatgcntttgatttcacttcgaagctgctacacttagcatggcatgcaccgagaactctatgcctgtgctgcatgcacag

SEQ ID NO: 272 - DNA, 531 bp, Gossypium hirsutum
  Clone ID: uC-gsronu33B011f09b1
gcgcctttctctggttttgcgcgcttcctttcaccctgagaggatgacactgtccatgtgcttctctgccaccacggctgctcatcctattcccacttcagatccgcatgcaccccattcatccgactctcaatcactcgtggctgtttccttctgcaagtttgttgatttcacagaccattcatccgaccatgctgatttccatcttgacattttatttgttcatattccatgtagtttatatttgccatcttgaaaacaactccaccaaaaatttcaacagtctttttatattgtattttttttcaaacgccatttttcaaatctttttctttgaatttcggatcccttcagagtgctgaaaaatattcaggtgctattgctagggtttacaaggagctacgtcaggcatggaggatgccaaagagcaaattatacaggagtccaaaaattccacgctaccatctcaagatgaggttgtgttcttatcttggctcattgtggaatatttgactgggtaaagatcttagc

SEQ ID NO: 273 - DNA, 511 bp, Gossypium hirsutum
  unsure (1)..(511): unsure at all n locations
  Clone ID: uC-gsronu33B011f10b1
ttctctcgtccggaccctggagtttttctcatggcctacgtcgagggaggtgttgtgaaatcaaagcgttcaatatggcgactgagaactatcactgattttttctgggcaattatcaatttcattggagtgttcttctcaaccatgttctcgatggaaaagtccgatgcctacagaaaaggctttggttcaagcaagaaatgggatggtggtccaggaggacctggaagtggaccatatgtgttnggttggtggcccacgacgaccaccacggggaatggacaatgttcggggaattgaccatagttcccttcctgcctgtggctcctgctgcggtggctaattgctgcaagcatacatcttgtgcatgtacaatgttatatagctaaagtcctctaattataagtaaggatgttccacatgtttttaatgccaatagattgcctgtgaaacaggcaactttgaacctctttaaaccagagatgcttttatgtactttcaaacttttgct

SEQ ID NO: 274 - DNA, 507 bp, Gossypium hirsutum
  unsure (1)..(507): unsure at all n locations
  Clone ID: uC-gsronu33B011g03b1
gattgatttatggggtccgaagggccagcagcaggaaccatccatgtgactggttttaagaaattccatggagtttcagagaatccaactgaaacagttgtcagtaatttaaaagagtatacagaaaagaaaggtttgccaaaaggtgttattcttggcagctgtagtgttcttgagactgcaggtcagggagcactccctcaactataccagacattgcaatctgccttaaccggcaaggaatcttcttgttctgggagaattatttggctacattttggagtcaatagtggtgcaagtagatttgctgttgagcgtcaagctgcgaatgaagctactttccgttgccctgatgagatgggatggaaacctagaaagtacccattattcctgcagatggtggaatttcacgtgtaagagagacttctcttctgttgaggagattacaaggccttagaaagaatggattgaggtgatgacctcnatgatgcagacggttgtgtgcat

SEQ ID NO: 275 - DNA, 432 bp, Gossypium hirsutum
  Clone ID: uC-gsronu33B011g09b1
acggcctctcgtgcggttcatacggtgctttcggatgtcgtaacttaatcaaaacgaatgctcgaacatggttaccaagcttatacacattcggcaacagcatatataaattcatattttgcctactagcatttatatttagcatttaactacaattagatacatctatttgcttataaacttacctcagacattataaaacggaacaaggtaactagtcaataactttcgatttgcctcgatccaaatccgatttctttggttcttgatctaaacatattcaaattaagctcattcaaacatatgttcattcaatttagtccaaaaacacgtaaatgggaaaattatcattttacccctgacatgtacattttttacaatttagtgcctattgaacaaaacacaaaatatacaagatttcaatatacccat

SEQ ID NO: 276 - DNA, 596 bp, Gossypium hirsutum
  unsure (1)..(596): unsure at all n locations
  Clone ID: uC-gsronu33B011g12b1
ttgtctatactcgtcgatttctttgaaaagtgtaagaaagatccatctcactgggataagatctcccaaggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtcttttccttttccttttttcgccggcattgtttgaacatggggttgtgcgcccgtcaattccagttaaatatggtgacttttgtttttcaagttcctatcttttttatttttatttttttaaacgcttatagccattagcgatgctttcagatgtacanataaaaaaataaaaaaattgagtatttctaaataacgtacattgtatcatcacgagtgggtcagcttcaatcaaca

SEQ ID NO: 277 - DNA, 298 bp, Gossypium hirsutum
  Clone ID: uC-gsronu33B011h01b1
cgattggttttaattagcagtgtgtttctgttaataagtttagtcggctgatggatatattctgttaattatagttctggaattagtgagtgcctgcaggtgaggagcttagtagtttaaaataagctgcaaaagcttgtactaagaattcctcagttatatatggtgcctgatcgctagtggctgtgctttaaatgagatgttttggctgtcggaagtgaccaaactatatttgatatgaaaaattgtccttaaaaaaaccactacttttaacggtaaattacctattccgtgaatc

SEQ ID NO: 278 - DNA, 335 bp, Gossypium hirsutum
  Clone ID: uC-gsronu33B011h02b1
aaatggaagtcgcccacgccatttctgcaagagcagtggatctgttgctcgtcacatacttcagcaattgcaggatgtcaacatcattgatattgatcctaaaggtggtaggagaatcacatcaaacggccaacgggatctggaccaagtagctggaaggattgcggttgctatctaagaaattttaactttatgtttttcatgttcctgagatttagtcgtttgaaaattgggttttcataggaagcctgttttaaacattatccgttttggcatattaagatctgaatctattatgattgtgattgttattgaaaacttgatgtatgctaaaa

SEQ ID NO: 279 - DNA, 567 bp, Gossypium hirsutum
  Clone ID: uC-gsronu33B011h05b1
ttgatttccaggaaagatatgctgaaactggggtggacttaatataatactagggggggagatcacaaacgggtcgtcttaccctccgggagttgaagcgtgggaacttaattgctgcaatgcagcatgtggatgaagaggaagatattaacaaagtattaaggtacttctcttatgaacacttctatgtaatatactgcaagttttgggagctcgacaccgaccatgattttttgatagacaaagagaaccttatcagatatggtaaccatgctcttacctaccggattgttgatagaattttttctcaggttccaaggaaatttagaagtcgggttgagggaaaaatgggctatgaagattttgtttactttatattgtcagaggaggataaatcttcagaacctggtctggagtactggtttaaatgcattgatttagatggaaatggggtgcttacaccgaatgaaatgcaattcttttatgaggaacagttacatcgaatggagtgtatgacccaagaaccagtgctatttgaggatatattgtgccagatttttgacatga

SEQ ID NO: 280 - DNA, 472 bp, Gossypium hirsutum
  unsure (1)..(472): unsure at all n locations
  Clone ID: uC-gsronu33B011h09b1
tccctttcgttcgacgatatcaagcatatgatgaagttttgcaatagcctgcatggtggtttgaacaagcttgctgagttgttggaagtggaaagagttggtgtgtgtcatcaagctggctcggatagtttgctcacatcgtgcacgtttaggaagttgagagataactttttcaatggctccactgagaaatatgcaggtgtactgtatggcctaggggtcgaaagtggacagactactaattagaaagaagaaataataattgggaaaaggttgatgaatgtagactactttagtgtgagactttataattttcattgtatacattggcaaaaatgattgttaatttagttgtgagcttatctgctttgcttgcattataactgaaaccttaactggttttcttgtctagntctaagtggaagtcatgtataaattatgcagttagtgtttcaataataatttgaaccat

SEQ ID NO: 281 - DNA, 581 bp, Gossypium hirsutum
  Clone ID: uC-gsronu33B011h10b1
tgatttccaggaaagatatgctgaaactgtcatagacagaatattttactatataaatagatcagaaacgggtcgtcttaccctccgggagttgaagcgtgggaacttaattgctgcaatgcagcatgtggatgaagaggaagatattaacaaagtattaaggtacttctcttatgaacacttctatgtaatatactgcaagttttgggagctcgacaccgaccatgattttttgatagacaaagagaaccttatcagatatggtaaccatgctcttacctaccggattgttgatagaattttttctcaggttccaaggaaatttagaagtcgggttgagggaaaaatgggctatgaagattttgtttactttatattgtcagaggaggataaatcttcagaacctggtctggagtactggtttaatgcattgatttagatggaaatggggtgcttacaccgaatgaaatgcaattcttttatgaggaacagttacatccgatggagtgtatgacccaagaaccagtgcctattgaggatatattgtgccagatttttgacatgattggaccagagaatga

SEQ ID NO: 282 - DNA, 390 bp, Gossypium hirsutum
  Clone ID: uC-gsronu33B011h11b1
tgtcctctcgggcgaccacgcgttcgtcaaagctgaggcatatgcaaagttactttcggccgatggatactcgcacacggatcagaagacttggataggcgtataaagtctgtcaacatgctctgctcaataaaggtatcttatatactttcactttagctggcctatagaggcattacgcttgccccttacacatgacattctttctaactgcatcccctctaataccactgtggtatagtgctgtcttgatccaatgaattcacagaaaagaatagccttctttaccaggagagagctgacatttgactatatatatgaacctggtactaatatcatatacatgatcgcgacttgcctcgagatgcatgaccatgctgagcgtgcact

SEQ ID NO: 283 - DNA, 572 bp, Gossypium hirsutum
  unsure (1)..(572): unsure at all n locations
  Clone ID: uC-gsronu33B011h12b1
ggccggattcctgggtcgcccactctcggcttttctattgtgatttgagcttttcagatgtggggtgatttgattcaactgcggtcagttcaaaccggacccataacttgattgtcaggctgcggcataatgtcattcggactgggctacgcaacataagtatctcatattctcgcatcgcactggccgatgttgcgaagaagcttagattggactctgttgctgatgctgagagcatagtagccaaggcaatcagagatggagctatcgatgcgacattggatcattcaaatggatgtatgctgtccaaggagacgggtgacatctactctacaactgagcctcaaacggcattcaactctaggattgctttctgcctcaatatgcataacgatgctgtgcgtgcacttcggttgccaccaaactcccacaaggagaaagaaagtgctgagaagaggagagaaagacaacatcaggaagcagagcttgcaaagcacattgcagaggaagatgacgacngaatttagagattgacattcgaaagttactttatccacatatgatgtttgatc

SEQ ID NO: 284 - DNA, 593 bp, Gossypium hirsutum
  Clone ID: uC-gsronu33B012a01b1
ttcagaacttatggatcgaacaagagctaccgaaagttaaccgaactgaaacaccatggttaattgttctaatgcattccccatggtatcatagctataactaccattatatggaagctgaaaccatgagagtaatgtatgagccattattagttcagtacaaagtcgatgttgtattttccggtcatgtccacgcctatgaacgatccgagcgtatatcgaacatcgcatataatctcgtaaacggtgaatgcagtcctgtaaaggatctatccgctcctatttacataaccatcggcgatggaggaaacattgaaggcatagcaaacaacatgaccgtccctcagccggagtattcagcttatcgagaagctagtttcggtcatgccattttcgatataaagaaccggactcatgcctattatagttggcaccgcaaccatgatgggtacgccgttcaaggcgattcgacgtgggttttcaaccgattctggcatccagttgacgagtctaaagagaacatgatgtagttcccttttgactcttattttagattaaaaatgcagaaatataaattataaaaatttcttttt

SEQ ID NO: 285 - DNA, 345 bp, Gossypium hirsutum
  Clone ID: uC-gsronu33B012a02b1
tgaaatttgaaaagaagagaaaaaatgcataatccaccaccaccagacccccaccatcctcatcatccccaccacccacatccgcaaccccatgctccgcctccaggtccgccacatgctgatcatcctcctccaggccatgctcctcctcctgggccaggcccccatgcgccaccgccaggaccaggtggtccaggtcatcatcccgagccacacaagcctcgtccatgatccttataccgtgtatacaatattatgtaagcttaggctgggtaccgtacttatgtaataaattaagaaaacctatttctactataataataataaagatgtaatttctacgtt

SEQ ID NO: 286 - DNA, 470 bp, Gossypium hirsutum
  Clone ID: uC-gsronu33B012a04b1
gtgcccgttaccatcctcaactggtcctttgtcagaaatgatcagccccggtttgagacttgctaccagattgccttggccatcaaggacgaagtggaggatcttgagaaggccggtatcaatgttatccaaattgacgaggctgctttgagagaggggttgcctcttagaaagtcggagcacgccttctacttgaaatgggctgtccactccttcagaatcaccaactgcggtgtccaggacactacccagatccacactcatatgtgctactccaacttcaatgacatcatccactcaattatcgacatggatgctgatgtgataaccatcgagaactcacgttcagatgaaaaggctcttttaagtattccgggaaggatggaagtatggtgctggaatcggccctggtgtgtatgacatccactctcccagaataccatcaaccgaagagattgctgaccgaatta

SEQ ID NO: 287 - DNA, 112 bp, Gossypium hirsutum
  Clone ID: uC-gsronu33B012a05b1
ctcacgcgttcgtgtgcttataacatttcaaactatcctatgaactgtagaattcttggatgattgtgatttacttcctgtgttggtactaaaaatggaagatgattttctt

SEQ ID NO: 288 - DNA, 249 bp, Gossypium hirsutum
  Clone ID: uC-gsronu33B012a06b1
ccttgcttaatttccattctggtgtctacaaacagggaagggggtcatcggagcagattcccctttttggctcaaattgaattcatcattgaattcatcatttttacacgaattgtatgcgtggacaaacctttgaaggtgtagttttacttgtaaactctttatcagcaaagctatttaaaacaaatgattgattcaaaaaaaaaaaaagaagttcaaaagatgtagataacattaaagccaaagtag

SEQ ID NO: 289 - DNA, 496 bp, Gossypium hirsutum
  Clone ID: uC-gsronu33B012a07b1
ctgcaactaccattccaagcttgcttgaaaatagaaaaatttggcgatctgattcttaaggctacagaaccacaaatggttttgtttaacatctatgatgactggttgaagagtatctcatcatacactgcattctcccgacttattctgatccttcgtgcacttcatgtgaacaatgagaaggctaagatgttactgaaacctgacaagacaattgttactgagccacatcatatctggccttctctaactgatgatcagtggatgaaggttgtagttgctttaagagatctcatactctctgactatgccaaaaagaacaatgtgaacacatcagccttaacacagtccgagattcgtgacattattcttggagctgagattactccaccctctcaacagaggcaacatatagcagagattgagaaacaggctaaagatgcaagtcagctgacagctgtgacaactaggactacaaatgtgcatggggatgagc

SEQ ID NO: 290 - DNA, 419 bp, Gossypium hirsutum
  Clone ID: uC-gsronu33B012a08b1
tttgctatgcaagattgttgaaaacccaaccattcttgaggatgaagcataattaagggaagtgttgaaatttgcaaatgcatgtggagccatcacgacgaccaaaaagggagcaatccctgcactaccaaccgaggccgatgcccttgccttaatcaatggagcttagattttaagcaacttgaataatttgcacattgttttgcctcccgtgattatcctttcatttcaaagagttctcaatttattcccctttgatatgcgacctttgttcccccaacgcccaattgcttgtgttctaatgatggaaaagactttggggttttaagcgtgtaggaaattcttttccctcttttataattttgcaatgtgattatcgaacttgttctgtcatcaaaaaaaaaaaaaaaaaggggcgg

SEQ ID NO: 291 - DNA, 461 bp, Gossypium hirsutum
  Clone ID: uC-gsronu33B012a11b1
ttattcctgcagagaatggatttggcccgcaagtatgcatttgggaagatgttggtgatcggtgctaaccctccattcaaggtgaaaggactatggcttttccgtgggcaagagattcctcaatttgtgattgacgagtgctatgacatggaactctacgagtggaagaaggtcgacctctcagatgcagcccagaaggaacgggtgaatcagatgattgaagactgcgagccatttgagggagagcctctcttggatgccaagtgctttaagtgatggaatatgttcttaattttacctttttatatttctggtacctttttgcatgtcaggttttatttataggttgctgttttcagttttgattaaggtaacattacaattaagttttaatgttctgagatgttggacttgaaattctctatttatgttttataagaaagatatagttctatggtttt

SEQ ID NO: 292 - DNA, 517 bp, Gossypium hirsutum
  Clone ID: uC-gsronu33B012a12b1
tccacgcgtccgcccacgcgtccggtctacagttgagtcggtagttaaatcagcagtgtcaaaagagaagcgcatgggtgcttctctcgtccgcttgttcttccatgactgctttgtcaatggttgtgatgggtcaatactcctagacgacacttcttctttcacgggggagaaaactgcggctcccaataataattccgtgagaggtttcaatgttgttgatgacattaaggccaaggtggagaaagcttgccctggtgtagtctcttgtgctgatatcttagcccttgcagctcgggactctgttgttattcttggagggcccggctgggatgttaagcttggaagaagggattcaaagaccgccagcttttctgctgcgatagtggtgtcatccaccttcgacgccaccctagtcaactcatcacagattcaagcgcgaggtcttttgccaggacatggttgctttatctggggctcacacaactgggaagcaaggtgcgtgctttcagagtcg

SEQ ID NO: 293 - DNA, 419 bp, Gossypium hirsutum
  Clone ID: uC-gsronu33B012b02b1
tccacgcgtccgatcttaagtcacaacttcaaatcagactgaagacataattgtactttattgttattttcatgaccttactaacttgagaatatatataacacaaataatttggtattgcgctttccctgtgaaataaaatgatatgaaccgggcgggcgccacactgatgtattcaacgagtctaaaacgaaatacgagctgcttttcatacattaggaatctgactgacttgcttacatgaaatatgaaatagtgacaatatatgcggagatagcagaaaggctgacactggacagaaaaacaagtaaatatttgcactttactctatctattggcaagtaccaagtaaccgagggggcaacaggctgaacctaccacaggccatggctactttattcttaaagcacattaacgag

SEQ ID NO: 294 - DNA, 561 bp, Gossypium hirsutum
  Clone ID: uC-gsronu33B012b04b1
tccacgcgtccgattttagatcaggcaattggggtgtgggaggagaatcactcagaatacctttttttctttttcttttttaaaagttatttttgcaatttgaggttatggatgtctgttaaaaatggccatagttttgctgtccttttctgaatggtcctagcatgaattttccttgtgcttggcatcaaataagccaaattaaggcctctgtaatgggttttgagatttctatatattaatctcctagaacagtgacaatcatactcctgctcttgtctctccgtattcaaggtcaagggcctgtttttttttttttttttttgaaacttcctatataagttttttgtacgctgtctattcctcgaattctgactatgaaaactaggaggggattagcgttctgaggccttttggccatccattgtgatgaagaaatggtctgatataaagcccaaggtgtatgattttagtgaagatgaagtcgacactgaaactgagaagtgagatgatgattcagattgcatggtagcgaggatcacacccgtaggacattggaga

SEQ ID NO: 295 - DNA, 143 bp, Gossypium hirsutum
  Clone ID: uC-gsronu33B012b05b1
attacgccatttggttgggagcaaattttccttttgtccaaaggatttttgctgctcattcatggtgacttggtttatggttttatctgttgttgttaaaatcttataaaaatatatatcgattgctgcttttggtttgtatt

SEQ ID NO: 296 - DNA, 545 bp, Gossypium hirsutum
  Clone ID: uC-gsronu33B012b07b1
tgtcaatcgaagatccatttgaccaagatgattgggagcactactccaaactaaccaaggaaatcggagaaaaagttcagattgtaggagatgatcttttggtcaccaacccaaagagggttgcgaaggctattgccgaaaaaaacttgtaatgcccttcttctcaaggtcaatcaaattggatctgttaccgaaagtatcgaagctgtgaaaatgtccaagcaagctggatggggtgtgatggccagccaccgcagtggtgaaacggaggatacttttattgctgatctttcagtcggtttggccacgggccaaattaagaccggagctccatgcaggtctgagcgttgagccaagtacaatcagcttctgcgaattgaggaggagcttgctgcggaagctgtctatgctggagccagctctcgtgctccagttgcaccctattaagatgcttgtttagatgataatttgctgagactgtatgcgtgcggtagagcttcagtggtttagtgtgaccctaaacatgtttcaataattttgatagc

SEQ ID NO: 297 - DNA, 494 bp, Gossypium hirsutum
  Clone ID: uC-gsronu33B012b10b1
tttgacgcgtgggaaaaaaaaacaaaaaaccaaaggattttaaaaacaaatacaaaagagactagattaaaaaaaaaaaaaaaagggggttaaaatctaaaaaaaacaaaactcgcacagcagctattggaaaatagggggccccccttttgaggccccaaatttcccgcccccgcccggggacccccatcttttttttcttgggggccccctaatttcatttccctgtcggggcttttcaacaccattccccgggggaaacccttggcttcccccactcgggtcccctcccgggccctccccccttttttccgggtggggtataggcccattggccccccccggtgggcctttccaaaaggcgcccccccttgttttttaatgggccccccccccgttggggctcttttgggccccccccctcgggggttccccccccccggatgggtttttttttcccgccccctaacccccccctcttcccatggcccctg

SEQ ID NO: 298 - DNA, 562 bp, Gossypium hirsutum
  unsure (1)..(562): unsure at all n locations
  Clone ID: uC-gsronu33B012b12b1
tccacgcgtacgcccacgcgtgcgtttgatgatagggatttgcggtgggagaagacgagagctcatctctctgcttcaaagctcctgtccgggtagaattctcttcttcctttgcgttgtgttctttgttgttcaatcgccatggcttcaaagcggattttgaaggaactcaaggctttgcagaaagatccacccacttcttgtagtgctggtccagtagctgaagacatgtttcattggcaagcaacaatcatgggaccctcagatagcccttatgctggaggtgtgtttttagttactatccatttgcctccagattatcctttcaagcctcctaaggttgcgtttaggaccaaggtcttccatcccaacatcaacagcaatggaagcatttgtcttgatatcctcaaagaacaatggagtcctgcactaaccatttccaaggttctgctctcaatctgctccgtgctgaccgatccaaaccctgatgaccctncttgtccggagattgctcacatgtataagaccgatcggnccaagtatgaagccactgctcgtagct

SEQ ID NO: 299 - DNA, 602 bp, Gossypium hirsutum
  unsure (1)..(602): unsure at all n locations
  Clone ID: uC-gsronu33B012c05b1
ctcttcttctccactaatccaccttcaatcccaataaacagtacagcatgcgccataatacaccagccctgaggctttgacaaatccagatcaaccagacttcctcacactcagagatccatacttttattgaaggcaagtaaaagaaggatatgaacgaggtgatgatggcagcggatgcaagctcgatgagaggaggtggagcgacgtcatttgcgtggtctgcgtcgtcgaatctgcttgctaataaccttcctctgctcacggccttgctcgctttcgctctcgcccagtttctcaaactctttaccaattggtttaaagaaaggagatgggattctaagaggatgattgattcaggtgggatgccatcatcacactctgcaactgtgacagctttcgcggttgctataggtttgcaggatggaatgggaggaccggcttttgctttgcagttgttcgncatgtgttgtgatgtatgatgcatctgtgtccgacttcacgctggcgtcagctgaatgctgaataaatnggtgtgaagtcctcctgacaccattgctagcggaggccctgcggaatacttgacatactcactcagtgtg

SEQ ID NO: 300 - DNA, 542 bp, Gossypium hirsutum
  Clone ID: uC-gsronu33B012c08b1
tcgtaaatgaagggtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattggtatcttatagtcgtgtgatttctcaccaataatcatatattagtattggttccaccacgcactacgttgcttaattaattttttaatcaaatatgttctacattt

SEQ ID NO: 301 - DNA, 308 bp, Gossypium hirsutum
  Clone ID: uC-gsronu33B012c09b1
tctaacataattctcattgccgtggacgctgatcgaagatcatttaataccggtgcttattatttattcgatgtgatcatgcccgcgacggattatcaaggaactttgtcaccgttgacaaatatcggccgttcgttattaccagtgaggagggatcaagtacacgccatggaatcgccgatcggtggatcggcgtctaacgaggcggtgatcgagtcctttcaaaggcaagtagctgacagatttcacgatttagcttctgtcccggtgatcctacgtggctagctttcttaggagggactatgggc

SEQ ID NO: 302 - DNA, 340 bp, Gossypium hirsutum
  Clone ID: uC-gsronu33B012c11b1
atccacgcgtgcgcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggttttatctgttgttaaaatcttataaaaatatatatcgattgctgctcttggtttgtatc

SEQ ID NO: 303 - DNA, 481 bp, Gossypium hirsutum
  Clone ID: uC-gsronu33B012d04b1
cccacgcgtccgcccacgcgtccgcgtttccagagccatgccgttcttgctcttcaggaagctgcagaagcataccttgtgggtctctttgaagacaccaacctgtgtgcgatccacgccaagcgtgttactataatgcccaaggacatccagttggctcgtaggatcaggggcgagcgtgcttaatttccaagtgtgttgatcacttaacttagaatggagaaactgttgtttgttgttaggcagatgtattgtactatttttttttttttatgtttaattttattcctcttttaggccaatattaaaagataggtttatcttagtgctgaggctcaatgttatgatgaaatggggttatggtggagagtgtgatgtctgatattttaatggttaagaacactcatgtctggtatagtttgtttaaatgtgccttctgatcaaaactagtgacttcgaatattattcatatattgaaagc

SEQ ID NO: 304 - DNA, 512 bp, Gossypium hirsutum
  Clone ID: uC-gsronu33B012d05b1
tttggttttcgtttcgttgaaagcttcgttcgtgttcggttcgggtgttactcaaaaaggacatgttattacatccgtggaaactgccctttttgtttgttcaatggtgatgggggttgctcatataattgtggcatatagaacaagttgtagagaaagaaggaaactattggtttacaagattgacattgaagctatttcagcttgtaagagtgggttttcaagatacgagaagattctacaagacgaaagagtgaagcttcatttgaatttacgatgatattaacttcaacaggcttaaaaataacaataaaattaaatcaatggtgaaacatgccgcctagatacaaaagtgagatttatccaaaacaagtaccagctggaaatcatgagtagtatagaagtttaaaacccatatatacaaatacaccaaaattggtgtgtatatatatagatatattgaggcattctttcataattttgagtgtacaagtttaataatgaaattaatg

SEQ ID NO: 305 - DNA, 549 bp, Gossypium hirsutum
  Clone ID: uC-gsronu33B012d06b1
tttgattttttctaccggtttgttctgcatctaccttactatgcccgtcaccgagtacgggaaactcaagatcccgcgttccatctccgatctgcgcttgctgaaagataatattgcaacatatgcaagtgattatccaacacaattcattttgggttactgctcgacttatatcttcatgcaaacctttatgattcctggaacaattttcatgtctttgctagctggagctctctttggtgtaaaaggcgttttcttggttgtctttaatgccacagctggagcatgctcttgcttttttctgtcaaagctgataggcaggcctttggttagttggttgtggcctgataaattaagattttttcaagctgagattgctaagcgaagggacaagttgctgaattacatgctctttctgagaattactccaactctacccaacctatttattaatttggcttcacctatagttgacataccgttcatgtgttctttttagctacttttggtggcctataccagcctcttatataactgtcaaagctggtc

SEQ ID NO: 306 - DNA, 338 bp, Gossypium hirsutum
  Clone ID: uC-gsronu33B012d11b1
tttggttttcgtttcgttgaaagcttcgttcgtgttcggttcggctgttactcaaaaaggacatgttattacatccgtggaaactgtcctttttgtttgttcaatggtgatgggggttgctcatataattgcaacatatagaacaagttgttgagaaagaaggatactattggatgacaagattgatgatgaatgtatcaaatttcatgtgagtgggttttcaagatacgagaagagtctacaggacgaaagagtgaagcttcatttgaatttacgatgatatgaacttgaacaggcttaaaaataacaataaaattaaatcaatggtgaaacatgcc

SEQ ID NO: 307 - DNA, 400 bp, Gossypium hirsutum
  Clone ID: uC-gsronu33B012e02b1
gttagtgccgcagcttctctttactctgtaatggcgaagtcaaagaatcacacggctcacaaccaatcttacaaggctcacaagaatggaatcaagaaacccaagaggcaccgccacacttccaccaaagggatggatcctaagttcttgaggaaccaaaggtatgcaaggaaacacaacaagaagaatggagaatcagccaatgaagaagagtaggcttttagtggggtaaaagaaaattctagcctgggttaggggtttctaattatggctgttttgtttgtttcaatggaaattagggttttgtttttttcagcattagcactattttgattattatctttgttataaaatatttgaagctttgagcttatcaatattgagaacatgtttcgagttt

SEQ ID NO: 308 - DNA, 440 bp, Gossypium hirsutum
  Clone ID: uC-gsronu33B012e03b1
gggacaattgccaaaccaagcgcctgcatcaattgagagtttgagacgcgactcgccaccgccgcctccacaacagtcctcatctaactcttcctcttcatggtttggaggactttttggtggaaagaagcaggaaccggcaacaggtagtggaagtaaaactgaggttttggagagcttcgatgctcctccggtgccgtctttcgaatacaaataaggtggtggcttccccattttgtcacagttaagaacactaatcctgcctttttgtttcagcactttaaagtgtttcagcttactaagcttgcatttttatcattaaattgactcgatagttgttattgctttcttgttcttggatttccctattgcaagatacatgcctatagagctgtttctcatcagtcaaataaaaaacccaatgttgttggattcaaaaa

SEQ ID NO: 309 - DNA, 567 bp, Gossypium hirsutum
  unsure (1)..(567): unsure at all n locations
  Clone ID: uC-gsronu33B012e04b1
ctgagagctaacttgctctgttttttctcatcatctttctttctccccctaaattctcacttcatatatactttatatcaacgatgtcggtaaaagagtgcggcaatcacgggaaataccgccggaaaatcttccggcgaatcatcgccggcatcctaatcttcattataatcgttctgataacaattcttctcatatgggccatcctccgtcccagcaaacccaggttcatcctccaagacaccaccgtctacgctttcaacgcctccacccctaacctcctcacctccaatttccaagtcactctatcttctcgaaaccccaacgacagaatcggcatttactacgaccggctcgacgtttacgccacctaccagaaccaacaaatcaccctccgaacatccatccctccaacgtaccagggtcacaaagagatcaacgtttggtcacccttcgtcaatgggaattcagtgcctatcgcaccggaatattccgccagtttaggatccgatcagagtgccgggtcggttntcttgatgatcaagattgatggacgggtgagatgga

SEQ ID NO: 310 - DNA, 608 bp, Gossypium hirsutum
  unsure (1)..(608): unsure at all n locations
  Clone ID: uC-gsronu33B012e10b1
tccacgcgtccgcttaattagtccttcagttttgttattgccatttacatcgttaatcaatccttcttaacacttaattatggcagaaacccgtagctgtgaatttggaatttccggaatgaagagagcggcagcggctgatagctttgaagtggatgatgagatattcgtggccaagaaatctatgttgccaacactggcagtggcaccagcagcatgggaaaatgaccctgctgcctccttagccggtctgcgccatgaattcggtgagcatggtggcattaacatgtccattgaagcttccgccaccttcaccgtcatggaacctgagacaatgcgccgcatgttcactggcgaactgggccccgatcgtgatttcttcatttatagtcgtcacttcaaccccaccgtcttaaatctcggtcgtcaggtggcagccctagaaggaaccgaagctgcctattgcactgctagtggcatggctgctatatcatcagtgatgttgcaactctgcagcagcggcggacatgntgtgggcgtcggcgaccctctacggaggaacccatgcacttttaacccatttcttgcccagaacttgtaacatcacg

SEQ ID NO: 311 - DNA, 528 bp, Gossypium hirsutum
  Clone ID: uC-gsronu33B012e11b1
gtggaatttgtgtcttctgaatctatacttgtttcgaacattactttccttaacgcacctgcatataacattcatccagtctattgcagccatgtgcacattcatcacataacggtctatgcttcgccaggatcaccatatactgttggtatagtcccagattcttcggataacatttgcattgaggactgtagcattagtatgggtcatgatgcaattgccctcaaaagtggctgggatgaatatggcattgcttatggcatacctaccgcaaatgtccatatcaggagggtccaacttcagtcattctcaggctcttctcttgccttcggtagtcaaatgtccggtggcatttcggacgttcaagtgcagcagctccacctctatgactcattaactggtattgagtttagaacaacaaagggtagaggtggttatattaaagagattgctatatcagatgttgacatgctgaacattaaaacggcattttgtgccaatgggcattttggatccccatccgatgac

SEQ ID NO: 312 - DNA, 481 bp, Gossypium hirsutum
  Clone ID: uC-gsronu33B012e12b1
gcgttcgatcacacggaacaggcttccagagccatgcctatcttgaccttcaggaacctgggaaggcataccttgtgcgcttgcaggaaggctcttgctggcagtcaacccaggatccgcggtgggtttgcatagactgaagacatctgacaactccaagaggcagtaattgttgcctacttactttgcaaaacaggaatgaagttgcttgaccctggaggtgctggagaatatatatatgcatatatatctcactagtgtcaacttggcgcgcacacacatatatctatatatatacacctttgagggaatcttatacagagttgctgctgaataaaccagatcgtaaatgctgagaaataattctatcttatttgctgttataaccttctctcctatccaagtaggatgtacatagtggttgttcaataaaatgatggcatagcagaaaattgcacttgttcaagttgaaattgtcaag

SEQ ID NO: 313 - DNA, 411 bp, Gossypium hirsutum
  Clone ID: uC-gsronu33B012f01b1
cccacgcgttcgctctctcctgcgcctcaacagcaactgggcaatagagaggggtgacttagggtttgccgaaacttgactcaatttttggggccgtttgggtctgttccagctattgggccgttgtatttgggctatggggcattgggtatcaatattggttgtaatatttgggcctttatgatagattattagtttggtttcattctttggacttttggtttaataattcggtatttattttgggttttggttctaagtgggccccggctaaattggcccattacatatacgtatttctaaaagtattgatcaattgtatattcttctagtttgaggcgcaaccgaataatctgttacattaattgcataaccaatgttccaattgaataaattgttataaataatcgt

SEQ ID NO: 314 - DNA, 512 bp, Gossypium hirsutum
  Clone ID: uC-gsronu33B012f02b1
tggtgaccaacatagaagaacaaaccactttggggaagaaggagcaagagccaaggtttgtccccgagacccaaaatggctatgggctttacggtcacgagtctggtcagctccctcctagcaccgccagtaccaaagaaacctatgaaccctatgtcacacctgttaaataccaccctgatgaaccctacaatagcatcccagcgtccaaaaccaacaacaaagactcttacttttatagcaagacaaatgcgtacgggaacactgagcagcaaagtgaagccaggttcaatgagaaaggatggaccaccaaggaaaccaacaactacaatggcaactattacaatggtaacaatgaggccttgttcactgagaaagggtggagtactaaggaaaaccagaatagcaacaactattacaatggtaacaatgaggccatgttcactgagaaaggctgggagtactaaggtaaaaccagaacaacaagcactattacaatggtaacaatgagt

SEQ ID NO: 315 - DNA, 560 bp, Gossypium hirsutum
  Clone ID: uC-gsronu33B012f03b1
gacattcttagtgattgctgatctgaaaactcatgagaagcattgtggtaaggataagtggctttgttcttgcggcaccacgttttcaaggaaagataagctgtttgggcatatcactcttttccaaggtcacactccagccattccttctgatgaaattaaagcagcacccgccggaacatctgatggagccactaataaggttggaagtgtgaatttcaacctctcttatgtttctagtgaaagtgaggctcaaagtagtcgtatggacattaaaggggggattgatgatgctgtaggttacttctcaccgttgagcttcgatacatgtaattttggtgggtttcatgagttccctcgaccaccatttgatgactcatagagttcatttgcatttctactctctaggtcctgtaattacagtcagaaaagtgcagaggagtaaagcccttgattgtggctaatttcttccctcatcagtagggattcagggatgtgttacatttgtgtggtaaggcagccctctgtacttggatgcttaagaaatgctctaaccctgt

SEQ ID NO: 316 - DNA, 606 bp, Gossypium hirsutum
  unsure (1)..(606): unsure at all n locations
  Clone ID: uC-gsronu33B012f05b1
ctctttttattttcactcacttcacctgagattttgttttcttttgtttttcagtaatggggaagattaagatcggaattaacggatttggaaggatcgggcgtttggttgcgagagttgctctccaaagcgaagatgttgagcttgttgctgttaatgatcctttcatcaccactgattacatgacctatatgtttaagtacgacagtgttcacggtcaatggaagcaccatgagcttaaagtgaaggactcaaagactctcctctttggtgaaaagcctgtcactgtttttggcatcaaaaaccctgaggaaattccatggggtgaggctggtgctgaatatgttgttgagtctactggtgtcttcactgacaaggacaaagctgctgctcacttgaagggtggtgcatagaaggtgattatttctgctcccagtaaggacgcccccatgtttggtgttggtgtaaatgagaaagaatacaagcctgatcttgacattgtctccaatgctagctgcacaaccaactgccttgctccgttggctaaggtcatccacgacaaattcgtattngtgagggtcttatgaccactgtccattcaatact

SEQ ID NO: 317 - DNA, 553 bp, Gossypium hirsutum
  unsure (1)..(553): unsure at all n locations
  Clone ID: uC-gsronu33B012f06b1
tccacgcgtccggaggccaggccttaggcaaaagttttgaagtgttgatcaggttggccttggtccatgggtatctctgctaacaggtgggtatggtgagaattctcaagtttcaggtaaagtaacttttataagcatactagaggagccctctatttgtcataagctgactggactatgtagccttatgttccatgatgctcttgtagtcaactgtgaagctttgttgcacggagttatatttgataaatatgacagttccatcattttcgtttcttctagattcaaacaaattagcaaggccagtatacatgttcattttgtaattgtgatcaccattatcgtcatcattgtcatttaattactagctgggcatccgtgttcagataatttatttcattatgtgtagtgtcaacttttctttttgttgtgagttatacgttaagatgtcaatttatggctttttgcaggaagatatttggtgtttttggttgcagaacagtggagtgcaatctaaagatggcaaagatatgattcttttgngaggtatatc

SEQ ID NO: 318 - DNA, 463 bp, Gossypium hirsutum
  Clone ID: uC-gsronu33B012f08b1
tctctcttccatatccaacactatctcacacacacaaacaccaaaaatgccgtttaagagatacgtcgagatcgggagagtggctctcgttaactacagcaaagactactgctagttggtcgtgatcgttgatgtcgtctaccagatcagggcacttgttgatgccccggatatggtaagaggccaaatgaacttcaagaggcttacattgacagatataacatttgtcatttcgcgtgttactaacatgaagacattgatcgaagctatggagaaggctgatgttaagaacaaatgggaaagtagctcgtggggtagaaagttgattgtccagaagagaagagcatctctcaacgacttcgacaggttcaagcttatgttggctaagatcaagaggtctggagtcatcaagcaagaacttactaagctgaaaaaggagaatgcatgttcaatttgatattga

SEQ ID NO: 319 - DNA, 343 bp, Gossypium hirsutum
  Clone ID: uC-gsronu33B012f09b1
tgttgattaattgattggatcaccaaagatactagctctaggaagctgtccatgttcttctctgacaccacgcactgttcatactattcgatcttcagatccggattctcactattcatccgggtctcactccatcgaggctgttttcttctgcaaggtggttgattccacagaccatttattggaccatgctgattcgcatctagtcaatatataagcccatattacatgtatagtgtatgtgccgtactgagaacaactacagcaattaatggagcagtcgattaatcttgaagtttacttcaaacgccatagctcagatacatgtaattgaattggggat

SEQ ID NO: 320 - DNA, 585 bp, Gossypium hirsutum
  Clone ID: uC-gsronu33B012f10b1
tccacgcgtccgaaacagcgcctgcaatagggaaaacaaagaaaaaaaccgaacatcaaagatgaacacagacataacagcttcggccaaaccagagtacccagttatagatcgaaaccctcctttcaccaaagtcgttggcaatttcaacaccctcgattacctccgtttcactaccattaccggcgtttccgtcaccgtcggctacctctccgggataaaaccaggattaaaagggccttcaatggtgacaggagggttgattgggttaatgggtggatttatgtacgcgtaccagaactcagcgggtcgactcatgggatttttccctaatgatggcgaggtcgctcgataccaaaaacgtggactcaaaaactagccatttctctctttttctattctcgtctattcacttttatgtttttaggacaatttgaataatcttcattgctgtctttgatttcctgttgttcatttaaggcatttgtattgctgcttaaaatatgacttatatgggtctaagatcccactgaaatgaggttgtctttgataactgttagaggcaccaacctttgatgcatgatg

SEQ ID NO: 321 - DNA, 518 bp, Gossypium hirsutum
  Clone ID: uC-gsronu33B012f11b1
ttccacgcgtccgctcagcccatgacgttttcgttggcaactggaaaccaaccaagaacgacaccttggccaagagggttccaggttttggaaccaccatgaatgttctttatggtgaccaagtttgtggtcaaggtgatagtgattccatgaacaatatgatctctcattacctttattaccttgaccttttgggagttggccgagaagaagctggtcctcatgatatgctcacctgtgaagaacaagaacccttcactgtttctccctcatctgcaacatcatcatgaaaaaaggaaacaaactctagtatatgcggatttatttcaatttgcgtgaatcccacaatggattgctcttaacaattgtggagtttacagcagtttgtgttggttgtataaaatttgagattttctttttcttgtttttactatcaaattgtagctaatagtatgtgattgagtggtgtatatgtctattgcccaacatggaatataaaattgattttttattttccg

SEQ ID NO: 322 - DNA, 511 bp, Gossypium hirsutum
  unsure (1)..(511): unsure at all n locations
  Clone ID: uC-gsronu33B012g02b1
tccacgcgtccggtcctccattttttttctctttgatttttcattgctttacactatttgatcaatcagaagctcaaccctaaaagtttcattagaatgaacagtgttaacctttctcatcaatatcctcgaacatcaagctttacttgtcttaactcttgcttgacagaacactggggtgatttgcccttaaaagtcgatgactctgaggatatgatcatctacaattcccttcatgaagctcttaacttcggttggtcaccgacgacgacgggttcaacggcggcaactacaattaaacctgagccgaaagatgaatcagcagagatcatggaaaacgcgaagccaatggagttgactaaaaagtggtgaaagggagacattaccgtggagttaggcaatggccgtgggggaaatttgcggcggagattagggactcagctaggaatggagcagagtgtggntgngtacgtacgagacagctgaggaagctgcttggcttatgatcgag

SEQ ID NO: 323 - DNA, 517 bp, Gossypium hirsutum
  Clone ID: uC-gsronu33B012g03b1
tttttgcgctgctaaaaaccctgattctattccctttgttttcatcgatcaaaatccccttctcataaattttctctcttgatggaagagacgcgatgtgcaatttgactgttccaatttccttttcaatgttcaattaaaaccctagcctcttccttttgcttctattggggggggggaaggaatcatgtctttcgatctcatatgctgaagccgtcctgcagctgctttggatcctcccaagatctgtacggttgaggaccaaaagaagaaagatgatgacgatttggtgagtggccgttcgggatttcgccctcgctggttctctacaccgcaaatccgtacgctcttccctttttttattttatttccttttgaaaaataaaattttaaatctatattcaaatcttaattctttttattctaatatagattatttaatttcttgtttatcttcgtcttcattttggtgtacgtatataaaattattatggatttctctttatttgtaattttt

SEQ ID NO: 324 - DNA, 593 bp, Gossypium hirsutum
  Clone ID: uC-gsronu33B012g04b1
gcgagatgtgacccctgagttcacaatctttgttggagacttggctgctgatgttacagattacatgcttcaagagaccttcagggcacactttccttctgttaagggtgcaaaggttgtgattgataggatcactgggcgcacaaaaggttatgggtttgtcaggtttggcgatgaaactgaatataatcgtgccatgactgagatgaatggtgctttttgttcaactaggcctatgcgcatagggccggctactaacaagaagactggtgctgcacagcaatatccagcagcttcatcgcaagggactcagaacgagaatgatccaaataatacgactatatttgttggtaatttggattctaacgtgactgaagaccatttgagagaggtcttcagcccatatggtcagttggtgcatgtgaagattccacataacaagcgttgtggatttgttcaatttgctgataggagtcgctgaagaagcactccgaatactgaacgggactcagttgggtggacaaagtattcggctttcatggggtcgtagcacatcatacaagcatgcccaagcagatccaaaccagtggaac

SEQ ID NO: 325 - DNA, 581 bp, Gossypium hirsutum
  Clone ID: uC-gsronu33B012g05b1
tccacgcgtccgcccacgcgtccgcccacgcgtccgggaagagctttcctttttttctctctatattttctcatctccttttccaccgccgtcgatctcgatccttatccccgttttcaaaaaagctccaaaaagatggccaatgctgcatcgggaatggctgtgcatgatgattgcaagttgaagttcttggaacttaaggcaaaaagaacccaccgctttattgttttcaaaatcgaggagaagcagaagcaagttattgtggagaagcttggtgagccaaccgagagctatgaggattttactaaatgtcttcccgctgatgaatgtcgttatgctgtgtacgattttgattttctaacggccgagaacgtcccaaagagcagaatctttttcattgcatggtctcccgatacataaggatcaggagcaaaatgatatacgctagctccaaagacagattcaagcgagaactggatggaatcccagtggtattgctagcaacagatccaccgagatgggtctcgatgtcttcaaagccgtgctaactgatacagttcttttagctttgcatcgggagc

SEQ ID NO: 326 - DNA, 652 bp, Gossypium hirsutum
  unsure (1)..(652): unsure at all n locations
  Clone ID: uC-gsronu33B012g07b1
gtgatatcctctgaattggatcctgatgtcctaactaaagacaatgatgaagtgcaaaagcagaatctaaatatggaaactgtggacaaggatgaaactgagttttgaaaaaaagataggtgcggcttatatggccttccatcgaattgattagccaagccattacaattgaattgttgagttcccaagtggcataagtaggatcagccatggttggtcgtgggatttctccattgatgtaccctaatttgccacgaccacgaatcaccataagaaccgattgagaccattgcaagaagttcttcccatttagccgatgattggtgattataagggaggaattaatttcaccttgagtgattccctgattgatattctgagttatttgtgatgtctcagtttcagagaaattctcattgatatcacccattggaggactaaaccacagaaatttttagttagggaatctagagaaaaaattaggattcgatgaatnctataaccctgatgccatgtaaaaacactcagaggaaaattctggtatattgctactgcttagttacagcttataagagaaaatatcatttaaaggaattaatctaatcctagaatcagtatgatatctaattctaagatagtactgagatagtct

SEQ ID NO: 327 - DNA, 589 bp, Gossypium hirsutum
  unsure (1)..(589): unsure at all n locations
  Clone ID: uC-gsronu33B012g08b1
cccacgcgtccgtctgaatctggttaaaataacagaagaacaatggaagagctgaaatcagctgtggaggagcacatggaattaatggcggatctagttcagaagctatcctcggagcttcgttcgggcctccgacccgcctatgataactttatgggcttcttccatgcaatcgactggaaggagccatggttaatgtgcttactggcattccatgttttcttattgatagtaacaatcttctcgaggaagaatactaacttccagatgtgtttgttccttctggcattgctcggtgtttattttgcggagttactgaatggattccttggtgacaactggaagaaatttgcaaaccagaactattttgatccaagtggactttttttgtcagtactctggtctggtcctcttctcattatcgcaatcatcatcttgataaatactctcttttccatgtgttacctaatagttagatggaaaaaggccgagctccagcaccgtgcatggcttgctcgcaacagcaggatngaatatgccaagttccgctctttagcacgataggcnatgcatacatattatctcatta

SEQ ID NO: 328 - DNA, 408 bp, Gossypium hirsutum
  Clone ID: uC-gsronu33B012g09b1
tttcgtccgttagtaaaaaccctgattctattccctttgttttcatcggagctaatacaattctaaggactagattctctaggtggaagagacgcgatgtgcaatttgactgttccaatttacttttcaatgttcaattaaaaccctagcctcttacttttgcttctattaatcctgaggcactttgatatttttattgtctttttttccttttgccatctcttttgcttattatttattcttcaattctccttcggttggtatcctaatgtagaaatatgatttccattttgttgaggggtcgttcgttattttgcccttttttgttcttctacaccgcaaattcgaacgctcttcccttttatttatttaattccctttggaaaaataaaatttttaactttgttt

SEQ ID NO: 329 - DNA, 415 bp, Gossypium hirsutum
  Clone ID: uC-gsronu33B012g10b1
gaaaagcgaccttatgttgataaggccgagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaggcagtggagacgaagatgatgagtaggaaaaatccagggaggatagcataatcaaactaggctgtgatagtgtttgatcatcttatgttaatgctttttaaatgcaaatttcatttaagcaaaaatgtaactctggatgctgttggtttcttttgacgtttcgaaattaatagttgtagatgggtacatttgttgctacatgtactttgcatttgaagttgaatggcgtaagataggtaaatccttttctaa

SEQ ID NO: 330 - DNA, 594 bp, Gossypium hirsutum
  unsure (1)..(594): unsure at all n locations
  Clone ID: uC-gsronu33B012g11b1
ttccaacactcatttctgacaattttctattggacccagagctccttgagtctaatatcactgaaaaatcaagattgttgattctatgctccccatcaaatccaactggatctgtttaccctaagaaactgcttgaaaaaattgcagaaattgtagcaaagcatcccaggcttctggtgctatctgatgaaatatacgaacatataatttatgctcccgcagctcacacaagctttgcatcattgccaggcatgtgggagcggactttaacagtcaatggcttttccaaggcttttgcaatgactggatggcgacttggatatattgctggacctaagaactttattgcagcatgtaataaaatccagagtcagtcgacttcaggagctagtagtatagcacaaaaagcaggagttgctgcattaggcttgggttatgctggggnggaagtagtttccaccatggtgaaagccttcaggaacgtcgagatttcttggtaaaagtttggagaatgaaggtgttagatattgaacctaggagcttctattatcatgattcagtctactacgaanagtgagggttgtaaatgaaatc

SEQ ID NO: 331 - DNA, 589 bp, Gossypium hirsutum
  unsure (1)..(589): unsure at all n locations
  Clone ID: uC-gsronu33B012g12b1
tgaaggttgccccagatgttattgctgagtatactgtccgtgccttgcagcgaactgtccctgctgcagtcccagctattgtattcttgtctggtgggcaaagtgaggaggaggctaccctaaaccttaatgccatgaacaagctccagaccaagaaaccatggtcactctcattctcattcggacgcgcccttcagcagagcactctcaagacctgggcaggaaaagaggagaatgtgaagaaggcacaagatgctttgctcgttaggtgcaaggctaactcagaagccactttgggtacatacaagggtgatgcagagctttgtgagggtgccgcagagagccttcatgtcaaggactacaaatattaagaaattaggcttgtggtcaaatatgtgatgtttagcagagtaaattccggtattgatattagggttctaggtgtttttttcttcttctattgagtttctgccgttgctcatcgactntagtctgtggaatcagacaaattacaataaggtttgggagccttgtgctcgttgagtattttggtttctgttatttcatttaaacaaaatcttgttagtga

SEQ ID NO: 332 - DNA, 274 bp, Gossypium hirsutum
  Clone ID: uC-gsronu33B012h02b1
cccacgcgttcgcccacgcgtccgctttggagcaggtccatggtttaatgtcacaggtcatcaaagacattcttttcaactctgtacgacaggcgagtgggtcccataacgatcagtctgctcctgagcctatgatggatacctaattctaacatcctgccggatgaaatggttaccttgagcgtgagacaccagttttttacaagaatggaaatatatattggattccaggctgcatagttttgtacccttccctgcactactgatgatagcc

SEQ ID NO: 333 - DNA, 555 bp, Gossypium hirsutum
  Clone ID: uC-gsronu33B012h04b1
gtcccacgttactcttaactctgaatcaccacccgctgcccccgcccaggaattgtctgcggttgtcgagaagcctcaagttactgagaaagagccacaaccctccgcacctgctcccctgccggagcctgaggttcccgagaagcctgctgttgctgctgttgaagaagaagctgttgaagttgagaagcccaaggttgaagaaaaggaagaaactaagataacccagtctgtttccttcatagaggaaactaatatcgctggtgaacttcctgagcctcaaaagaaggcccttgatgagcttaagcagcttattcaagaagcccttaacaaccacgagttcactgccaaacccgaagcagaagaaaaacctgtagctgagcctgagccaaagaaagaagatgaagaaaacatggaagagaagaaagaagaaaaagaggaagagacacctgctgctgcaatttcagaagaacccatgatagtaaccgatgcacccgccgctgttgaagtaaggtagaagaaatactcctcctcaccaccacagccaggctctgc

SEQ ID NO: 334 - DNA, 530 bp, Gossypium hirsutum
  Clone ID: uC-gsronu33B012h06b1
cgacagcattttcttctcattttcgagaacatttttttaaagattttttctatatattctttgaagatattaatcagaaaaatggcgctggtttctttcatcggaagggttctttttgcgtcagtgttcatcctctctgcttggcaagagttcaatgaatttggcgtcgatggtggtccagcggtgaaggagctgaggccaaagttcaacgtcttctcaaagactgtctcatctcacacagggttgcaagtgcctgaatttgatatcaagtatgtggttgctgctgctgtagcctttaaaggtgttgggagtattctctttacctttggcagcaccatcggagcttatcttctggttttgcatcaactcattcttactcccattgtttatgacttctacaattacgagaaggagaagaaagaatttggccttcttttacgaagttctcacagaacttggcgctgttaggggcattgctgttcttcattggcatgaagaactcaatccccacaagacaactgtagaaaaag

SEQ ID NO: 335 - DNA, 397 bp, Gossypium hirsutum
  Clone ID: uC-gsronu33B012h08b1
tcgttcacgcgtccgcccacgcgtccgggagcatgcagtgactgtactttggagcgtttgttgtttgtttagagaggagaaagcgcaagaagcagtggtgggttgtagtaacgggctgaccaagtttttgttgctgatgcaaagcgattgttcttcagccactaggcaaatgtcggcggatttgctaaagctttctcggttaaattccaactcttgtttgtcaagttacgatactaagactacccatattatgccctgttgatgaattttgcttcagctttctctgttctttttttttccttcgaaggggggaaattacccaaatgttgtaaatcgttagaaaattttgttagatcaaattacccaagaatattgaatgaatcaatttggttttcgt

SEQ ID NO: 336 - DNA, 509 bp, Gossypium hirsutum
  Clone ID: uC-gsronu33B012h09b1
tcaacactgcctccaaagccaccagtctaccccagtccaccaatagtgaacccaccaacaccggcgattctgccacctcctattgtgaatccaccaacaccgtcgattctaccaccaccatcaccacctattgtgaacccaccaacgcctcctatggtgaagccaccttcaccgggaacaccgtgtgctccaccaccacctccggcacaacaaacatgccccatagacactctcaagctaggtgcatgtgtggacgtgttgggtggcttagtacacatcggcataggtagcagcgccaaagacacttgctgccctgtactacaagggctgttggatttagacgctgccatttgtctctgtactacgatcaaagccaaccttttgaatatcaatattataatccccatagctcttcaggtcctcatcgactgtggcaaaacttcacctccagggttccaatgtccagcacaatgatgaaaaacatataaaccccatgttttttttttctt

SEQ ID NO: 337 - DNA, 571 bp, Gossypium hirsutum
  unsure (1)..(571): unsure at all n locations
  Clone ID: uC-gsronu33B012h10b1
ttcacgcgtccgcccacgcgtccgcccacgcgtccgcccacgcgtccgcccacgcgtgcggagggatcctggaagataccgagactattcacctccttataatcgagggccaggtggtgagcggcaacacagcaaccggcgttttgatggaactggttatggtcctggacctatcggaggtgaaggcatgactcgaaataatcctaatgtacgccctagggaaggtgactggatatgtccagatcctttgtgcgcgaacttaaactttgcaaggagagaatactgcaacaattgcaagagatttcgctatgcgcccactggaagtccccgtggaggctaccctggtcccccacctccacatgcccctcccaggcgctttcccggctcacccgtggatctatcaccacctggcaggaacataaacagcaacttcaggtctcctnctcgtagttgggctagggaaggtacacgagactgtagagctgctggtccaccaccttcaaggcatgaaggcaggttttttgatcatagcatgcgtagagaccgacttgatatctagacgatgactaca

SEQ ID NO: 338 - DNA, 504 bp, Gossypium hirsutum
  Clone ID: uC-gsronu33B012h11b1
tccacgcgtccgcccacgcgtccgggaagtgctcatggttgggatgttttgttttacatattcagtttcttgaaagggatcatgcttttcacgctcatcgttttgatcggcaccggttggtcgtttttgaaaccttatttgcaggacaaagaaaagaaggttttaatgatcgtgattccacttcaagttgttgctaacatcgcccaagttgtcatcgatgaggcctccccatttggtcaagatagggcgacatggaagcaactgtttttgcttgttgatgttatttgttgctgcgctgtgttgttccctatcgtttggtcgattaagaacctgcgtgaggcggctcgaacggatgggaaagctgcggtgaatttgatgaaattgactctgtttaggcagtattacgttgtggtgatctgttatatttacttcactcgtgttgtggtttatgctttggagacgattacttcgtatagtatctatggaccgctgtgttggccggag

SEQ ID NO: 339 - DNA, 549 bp, Gossypium hirsutum
  Clone ID: uC-gsronu33B012h12b1
gtccaacaagtcctaaatattggcaactatgtcgtccgggtaaagattggcactccgggtcagctcatgttcatggtattggacactagcaatgatgtggcttgggtcccatgctccggctgcaccaggtgctcagccaccactttctcacccaacacttcttccacctatggttcgttggattgcggtttgccccaatgcgcccaggtccatgggctgtcgtgcccggctacggggtctgcggcttgctcttttaaccaatcctacggtggagattcatcattttcggccaacttggttcgagattccttaggattagccaatgacattgtcccagattttgcttttggatgtataaacgccatctctggtgggtcagtaccaccgcaaggactgttgggtttgggtcgggggcccatgtcacttatttcacaatctggggccctctatctggtgttttctatattgtctacccagttcaagtcctactacttttcggttctctaaactcggccagtggacaacccagaacattcgaccaccccactc

SEQ ID NO: 340 - DNA, 407 bp, Gossypium hirsutum
  Clone ID: uC-gsronu33B014a03b1
aagcgccaaagaggggaggcttagttctcaaacgaagaacatgttgtagaaacaaaacgccataagtcttacaatcacatactctctttgcttgaagtcgaagaggatgagcccagccaagacttgtcccccctaatcaccactttacagcaacagctctcctcggactccgttttggatgcccctttccctctttgtgaaccagcaacaccatcgccctcgaacccagacaaggaaaccgccaccaccgtcctcagcttagaagactgcacatcagcaacttgttccttgaaagaagatgatgatgatgatgataaagtgcaagtcataagacatttgcttgaagcctctgatgatgagctggggattccaaatagagaagatggcgatggagatgtagcggtggt

SEQ ID NO: 341 - DNA, 389 bp, Gossypium hirsutum
  unsure (1)..(389): unsure at all n locations
  Clone ID: uC-gsronu33B014a05b1
cattcttcagaccagatgtgtttactggtggcaaaggagacagacaacaaaggatttacctttggtttgacccaacaaaagaataccactcctactctgtcctctggaacatgtatcagatagtgttctttgtggacgacataccaatcagagtgttcaaaaactgcaaagatttgggagtgaggttcccattcaaccaaccaatgaagatatactccagcttatggaacgccgatgactgggccacagggggntggtctcgaaaagaccgactggtccaaagccccattcattgccaatacaagagcttccaatcgacgctgcagctgttcgtggaagccaagttctgcgccacacaggaagcggtgggtgggaccaaaaggcatttc

SEQ ID NO: 342 - DNA, 241 bp, Gossypium hirsutum
  Clone ID: uC-gsronu33B014a06b1
ctcgctttgctaggatgacgtgagggaataacctaagctttgcttcaacaggacctggctgctctgtggcgcctctatcgtggcctctacgcccgttttggtgggaggcatggtgaaagccgcgaaggcgtgaggccatttgaaggccgtgttataaacaccgaatatttcagtaggggtgctgactattagtgcgaggcaaggaagagatactccagctaatgggacgtccaccactgga

SEQ ID NO: 343 - DNA, 98 bp, Gossypium hirsutum
  Clone ID: uC-gsronu33B014a07b1
gggaagtcgaccactactggtcatttgatctacaagctaggtggtattgacaagcgtgtgattgaaaggttcgagaaggaggctgctgaaatgaacaa

SEQ ID NO: 344 - DNA, 258 bp, Gossypium hirsutum
  Clone ID: uC-gsronu33B014a09b1
gtagctatgccccatgagggcacctttctatcactaatactctacactacgattatgaattttcttaccgcaagtaataacacatataaggctaatttaggtaagaaaatcaaaatgctcaaaagcattgctagagactatggaagtggaatgactggctctagaaatcgtatgaaaggaaattcatattctatagacagaaccagcaacaccatcgccctcgaacccaaacaaggaaaccgacaaccaccgaccaag

SEQ ID NO: 345 - DNA, 263 bp, Gossypium hirsutum
  Clone ID: uC-gsronu33B014a10b1
gttgttgatagcagggacggcgacctggtggttgcggcccgggatgtgcttcatcgtatgctaaatgaggacgagctgagggatgctgtgcttcttgtgtttgcaaacaagcaagatctgccgaatgctatgaatgctgctgagattactgataagcttggccttcactcccttcgtcagcgccactggtatatccagagtacttgtgccacctctggcgaagggctgcatgagggactggactggctgtccaacaacattgc

SEQ ID NO: 346 - DNA, 336 bp, Gossypium hirsutum
  Clone ID: uC-gsronu33B014a12b1
acgcgtccgcccacgcgtgttttaatttccaatgactcagacccaaaaattttagaaccttgaaggactcgacctgaaatttttagggcactgcccccaaatttagaagttaaattgttgtgggtactgaattttgtagagattgtaagttaggcttaaataaatgctaagattttgaatttttattttattttatttagagataaatatcgaatttatgtttaatatgtaatttgacatttaaactttaatttggtacaattatatgctttgaaacttaaattatggtttatatatggaaatgaaaatttgattttgattcagttgtagatattt

SEQ ID NO: 347 - DNA, 272 bp, Gossypium hirsutum
  unsure (1)..(272): unsure at all n locations
  Clone ID: uC-gsronu33B014b01b1
ctaattgggagcttggctgtcattgtttttgacaaacccacctccactccgcttggggcttctgatcaatttggtaaggttcctctctatnggggaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagagga

SEQ ID NO: 348 - DNA, 92 bp, Gossypium hirsutum
  Clone ID: uC-gsronu33B014b02b1
gaaggcgccgcgacacgtgctcacatcttaaaacaaaggtggctggtggcgactagcagcttgagttctggctaatttttgcactgcaggtg

SEQ ID NO: 349 - DNA, 383 bp, Gossypium hirsutum
  Clone ID: uC-gsronu33B014b06b1
ggaagaccaaggtggggttgtttacttctacaaggattcttgtcctcacgctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgttttcgttgggaggcccttatattcctctcaaaatggaagaagagacg

SEQ ID NO: 350 - DNA, 438 bp, Gossypium hirsutum
  Clone ID: uC-gsronu33B014b10b1
taacatggaagaacagcttaattagcttcggagatgcactcaaatcgtggagttcattagatgctactccatgcagatggtttgggattcattgcaactcacaaggcgaggtagttgagataaggctgaaagcaatagagttgcaaggctcattgccttctaatttgcagtctctaaaatccttgaagacccttgtgctttcatcaaccaatcttacaggcacaatccctaaggagctcggtgatcagtatgagctaagttatgttgacctcagtggcaattctctcactcgttgccttgatattggcatctctgctctccgctctaatgtccccgccattgacgtccgttgaactttgttgtgagagaactggaaacagacccgctgttcaactccgggcgtgtgtctgctcttaggagaaaggaacagtagaaatg

SEQ ID NO: 351 - DNA, 282 bp, Gossypium hirsutum
  Clone ID: uC-gsronu33B014b11b1
gttctcttttcagtgccggcaatgctggtggcactggccaactgccaggaatcgttgaagccattggtgaagatggtaaagggcatgaagctgtttgacaaagggtggcagtgctatggcatgcatgtgatgcttcactgctgctggacttcacaagaaggagcttgtctgactatggatacagactggagcttttggcctaaggaattttctggtacacttgagactcatctaagaagcttgttgaaagggattgtcctggagtttgtttttgtgctgata

SEQ ID NO: 352 - DNA, 446 bp, Gossypium hirsutum
  Clone ID: uC-gsronu33B014b12b1
catcacattcactggattgattctttctattgtttttcccttttcttatcttgggataagtctcaaagaaacttagaccccttcgtattctccgctcataccccaaatccccataccccttctgttcaacagcaaagatggcaactgtgcgggttacctcctctagtatcgttcaagcttcaatcccgaaccgattcacgagtgccattgtcaaggccccgacttctcttggatcttttaagaacatctccaaatcttttggcttgaaatgttcctccaatcacaaaacattaatggcagcttataagattaagcttgtaggaccgaatgctgtggtgtgcgagttttaagcccctgaccatcaatacattttagatgcagccgaggaagcaggagttgaactgccatactcttgccgagctggagcttgctccacatgtgccggg

SEQ ID NO: 353 - DNA, 318 bp, Gossypium hirsutum
  Clone ID: uC-gsronu33B014c01b1
cttttggctaagctgcttgtctagggttcatttatctttcgcctccctctcttttcttttttcaatcccctccttctttcaggtaaaatgcaacgggcagttcgagctttttcggtgcacggaaatactgtgaaaaatgcgatcttgcatcgcattcgggttgtcaatccggttatacgacccgttatgttttccagatcacttacatctgctagtatgcaagaacatggcttcgagagcaccactatttcagacgttttgaaagccaaaggcaaaggtgcagatggatcctggctttggtgcactacggatgactct

SEQ ID NO: 354 - DNA, 234 bp, Gossypium hirsutum
  Clone ID: uC-gsronu33B014c02b1
taccttcctcgatggggggattattcaagggctcgccacatgtcgttcatcatgagaagaaaggaaacaagcgacaacttgctgaagaaagcttctttacctggtttgctgatgctcagcacaaagatgacatggatgaaattcatgatgaggtagcagagattatcaaggaggatttatggcccaatcctctcacttatttcaacaatgaggctgatgaagaggattttgacg

SEQ ID NO: 355 - DNA, 128 bp, Gossypium hirsutum
  unsure (1)..(128): unsure at all n locations
  Clone ID: uC-gsronu33B014c03b1
ctttcttcagcctgccaggaattcggaagaagaccatcttttcagccacnnnttaatggagaattccgtggtgggaaaatttggccttctttttgagatttgctgatgattcatatgtagaaagttac

SEQ ID NO: 356 - DNA, 179 bp, Gossypium hirsutum
  Clone ID: uC-gsronu33B014c08b1
aacttgctgaagaaagctgagacacccggattgctgatgctcagcaagatgctgacacggatgaaatttaggatgaggtagccgagattatcaaggaggatttatggcccaatcctttcacttatttcaacaatgaggctgatgaagaggattttgacggacatgagggggatgttgag

SEQ ID NO: 357 - DNA, 159 bp, Gossypium hirsutum
  unsure (1)..(159): unsure at all n locations
  Clone ID: uC-gsronu33B014c09b1
cgaggaacttgctggctgggatgaatagaccagacccgcggtgcactcgaaaaagatgctncctatcaatcgattgtctctaaattatcatatggagacagtcaaaagcttgacaaagcatgttacgaggaggaagtgaaaaggccttgcttagctttc

SEQ ID NO: 358 - DNA, 230 bp, Gossypium hirsutum
  unsure (1)..(230): unsure at all n locations
  Clone ID: uC-gsronu33B014d03b1
accaatgaggcttttcgaatngctgcggatggttcgaacggttcttaccaccgncgtgcaacaaacgttagtgctaggctggatgcccagcagaaaaagcttaatctgccagtccttcccaccacaaccattggatccttccttcaaaccttggaactcaggtgagttcgttgtgaattcaaggcttacaagattctctgaggaccactatgtttaagccttcaaggagg

SEQ ID NO: 359 - DNA, 338 bp, Gossypium hirsutum
  unsure (1)..(338): unsure at all n locations
  Clone ID: uC-gsronu33B014d04b1
acggtccaagttcgggaggtngatagatagtttctggacggtgtccttccgaaaactggagttnaatcctactggtatcaataccatggttcaagtgaacgacctcaagaattcacctggacctggttaaaaggaacttagacaagctaccaaccaagcccttaacttgcttcaagataactatcccgaatttgtggccaaacaagtgttcatcaacgttccatggtggtacttggcttttaataggatgattagttctttcctgtctcagagaatcaagagtatgtttgttttttcaagttcagccctatttgttgatacccctttttcaatattat

SEQ ID NO: 360 - DNA, 134 bp, Gossypium hirsutum
  unsure (1)..(134): unsure at all n locations
  Clone ID: uC-gsronu33B014d09b1
tcttcgaaggatcttcgannaactcgggtcggaaacggtcggggacttaccacagggagatgctgacgtgggtgtctgtttggaggccatggagacaacggtttcagatgatttccttacccggaggaaccgtg

SEQ ID NO: 361 - DNA, 337 bp, Gossypium hirsutum
  unsure (1)..(337): unsure at all n locations
  Clone ID: uC-gsronu33B014e01b1
aacacaccctaaagagacagtttgatagctgctagccttcgcctttcttttcttcttcttttgggataaaacattagctcaaatagctccggcgccgccgttaaaggtggacaacatcacttccatcctcgaaaaaggtggccaattcaccactttcatcaagctattgaaagccacacaggtggctgatcaactaaacaaccagctaagcacaccggaccctaacgacgggataacnggtgtttgcaccgagtgacaacgcgttctccggactcaaaccggggacgttaaactcactttccgaccaagagaagcttcagtgggttcagttccatat

SEQ ID NO: 362 - DNA, 337 bp, Gossypium hirsutum
  Clone ID: uC-gsronu33B014e04b1
cttcattgatttctgcttgcagctacgctggtctttttctccttctccggcgacgatctcaattcaccggaagttctcgccctaaggattacctctatcatatccttcgacatcttgtgattcagcatattctaacttgtcgccaccatgaatcccgaatatgattatctgtttaagcttttgcttattggagattctggtgttgggaaatcgtgtttacttctgaggtttgctgatgattcatatctggaaagttatatcagtaccattggtgtcgacttttatatccgcactgtggaacaggatggataaactatcaaacttccaaaatgggaca

SEQ ID NO: 363 - DNA, 245 bp, Gossypium hirsutum
  Clone ID: uC-gsronu33B014e05b1
ctccccctcaggccagcaagacactagaggatgaaacgcacggtgacatcataaaaaggggaaacttggttcgcaataaggaacgatctgttaaaagaaggcagcgccttgtggggccaaattcttcgactttgaaggcacttgaaatattgacaagctgctacattcttgttcagggaaacactgttgctgctatgggttcatttaaaggtttgaaacaagtcaggaggattgttgaggacctg

SEQ ID NO: 364 - DNA, 142 bp, Gossypium hirsutum
  Clone ID: uC-gsronu33B014e06b1
ctctgaatgtaaaccgaaatcgcggttatgctcttgtcttgtactacaacaatgcctgcgctgattattcaaggcagaaaatggcaagtgcaaattttatgctgtatggctacaaccatactgttacatggtgctgatccaa

SEQ ID NO: 365 - DNA, 267 bp, Gossypium hirsutum
  Clone ID: uC-gsronu33B014e07b1
gtttgggataaaacattagctcaaatagctccggcgccgccgttaaaggtggacaacatcacttccatcctcgaaaaaggtggccaattcaccactttcatcaagctattgaaagccacacaggtggctgatcaactaaacaaccagctaagcacaccggaccctaacgacgggataacggtgtttgcaccgagtgacaacgcgttctccggtctcaaacccgggacgttaaactcacttttcgaccaagagaagcttcagttggtt

SEQ ID NO: 366 - DNA, 161 bp, Gossypium hirsutum
  Clone ID: uC-gsronu33B014e10b1
caacaatttgattgttcggacacctgcgtgggaaacaaccggtttctccaatagtttaagcataccaacttatattcctttgaaaacccaatcctttatcagtcctagatcgaaggcttttagtgttcttaacaaacccagagaagtcctgttttcggatt

SEQ ID NO: 367 - DNA, 402 bp, Gossypium hirsutum
  unsure (1)..(402): unsure at all n locations
  Clone ID: uC-gsronu33B014f12b1
taatcaagttcagttggnggaaggtaagatggagaacaagcgttgcatgccaangaaaggaagtatgaatccttggattgatatgaaggcaatgtcaatgagcacctgatgatgcacatgggttattgcggacggcccaagcccatgggctacgattcgtgggacgtcgacctggaaaggagggatatgatggtcttctagaacctctcttcctccgattgatcccttcttagttttcttcttggaaactcggtcgatgtttgtgcgagaccatttttgtagggctctatgatactctgcaatgccgaggatgactaaagagcagatgaactccgagtgttttcctttttcatggaaatggtaagcatgaacttttgaaatgttgctctttttgacacactt

SEQ ID NO: 368 - DNA, 84 bp, Gossypium hirsutum
  Clone ID: uC-gsronu33B014g02b1
caccactcccgacagtccgtcctttggattttttgatttctgggtgaagtgcggaaagagttggctttcctaaagggttcagat

SEQ ID NO: 369 - DNA, 67 bp, Gossypium hirsutum
  Clone ID: uC-gsronu33B014g07b1
cggcggagggtgcttttaggactccgccggcaccttatgagaaatcaaagtctttgggatccggggg

SEQ ID NO: 370 - DNA, 413 bp, Gossypium hirsutum
  Clone ID: uC-gsronu33B014h06b1
ttacattgagagatggtggcaaatcagaggagacccaatcgaataggcttgaaaaccaggtagataatggaggaggaggtgcttgggagtacctttgccttgtgagaaagctcacagttaggcgttcagagaaagtcttgaaatatgggttatccatcttaaatgatcccaagaaaagatctgctcttggccctgaagaatggactttgtatgagcaggtagctattgctgctatggattgccaatgtctcaacgttgcaaaggattgtataaaggctttactgaaaaaatttcctgagagcaaaagggttggcaggctggagggcatgttgcttgaagcaaagggatcgtgggctgaggctgataaagcttactcaagtcttttagaggacaatccatttgttcaagtaatt

SEQ ID NO: 371 - DNA, 595 bp, Gossypium hirsutum
  unsure (1)..(595): unsure at all n locations
  Clone ID: uC-gsronu33B015a01b1
cccattcgttcgcccacgcgtccggttctagatcgcgattccttccagtgaaggcaacttcagatttgcttcttgttcagtctgacctttacaccttagttgatggatttgttatccggaataaagatagagcgaatcctacaaacccatccatagaattggggcctgaattcaagaaggttggtaacttcttaagtcgattcaagtcgattccgagcatcattgagcttgatagccttaaggtgactggtgatgtttggtttggtgctggcattgtgctcaaggggaaagtgagtatcgctgcaaaacccggggtgaagttggagattcctgatggagctgtaattgagaagaaggaaattaatgtccccgaagacatctgagagaggcctgtctaccagcttaagtttccccgattttggtgtgttgcagtagataacgaacgcatcttttatataaataggaagtaaaataaaataaaaaaacctggaacagaagtagtatttggcgtttatatcacatatatatgtngtatgtcttgcgggagtttcccttgaatactattttcgaggatgatgaaaacagtgttctgatg

SEQ ID NO: 372 - DNA, 573 bp, Gossypium hirsutum
  Clone ID: uC-gsronu33B015a02b1
agcaatttacgacatatgccggagatccctcgatatcgagaggccaacttacaccaatttgaacaggctgatttctcaaaccatatcgtccttgacgacttctttaaggtttgatggagccattaatgtagacattacagagttccaaaccaatcttgtgccatatcctcggatccatttcatgctctcttcttatgcgcctgttatctcagctgagaaagcataccatgaacagatatcagttcctgagatcacaaacgctgtgtttgagccctcaagcatgatggctaagtgcgatccaaggcatggcaagtacatggcttgctgcctgatgtatcgaggagatgtggtgcccaaggatgtgaatgctgctgtcgctaccatcaaaacgaagaggaccgtgcagtttgttgactggtgcccaactggtttcaaatgcggtattaactatcagcccccagctgttgtccctggaggtgatcttgctaaggtgcagcgagctgtttgtatgataagcaataacacagcagtggcagaggtgtttgcacgcattgaccacaagttgatctgtgt

SEQ ID NO: 373 - DNA, 564 bp, Gossypium hirsutum
  unsure (1)..(564): unsure at all n locations
  Clone ID: uC-gsronu33B015a03b1
cgctgttgaacctattgaccaactagaaattttttatcatattagagatataaaggatcctgaacatccctattctttggaagagcttaaagtaataactgaagatgctattgaagttgataacgagcgaagttatgttagggtcacatttactcctacggttgaacattgtagtatggctacggttattggtctttgcttgagagtcaaacttatgaggagtcttccttctcgctacaagatggatataagggttgcacctggaactcatgcaactgaagctgcagttaataaacaactgaatgataaagaacgtgttgcagctgcgctagaaaaccctaaccttttggaatggttgatgaatgtctggctccatcctatgcttgaattttttattattaccagacgtggtgaactagatttggttttcttcatacaataaactttactntggctctttgnatatttcattntattcgnatgaacttccctactttggttcataattacagattaaagttgtatttttaaggcataatgcccaaaatacccctacatttgact

SEQ ID NO: 374 - DNA, 172 bp, Gossypium hirsutum
  Clone ID: uC-gsronu33B015a04b1
gttctagatcgcgagcgccgccctttcctttttatcatttttctctatttataaatattcaatccttcggtgttagcttatgcttattatcaggatgcactgatttttcacattgcgtgcagtgtaaatctctttaagaatttagataattgattccttagtgtcgtttctt

SEQ ID NO: 375 - DNA, 460 bp, Gossypium hirsutum
  Clone ID: uC-gsronu33B015a05b1
ggagtcatgtttgaaagtgttccaaaaggagacgccatcttcatgaagtggatatgccacgattggagtgatgagcactggtccaggcttgtgactaggtgctacgaagctttgccggacagcggaaaagtaattgttgcagaatgtattctcccagattacccagatcctagccttgccacaaagttagttgtccatattgattgcatcatgttggctcacaatcctggtgggaaagagaggactgagaaagaattcgaggccttggcaaggagtgctgggtttcaaggttaccaagtaaaatgctgcgcgttcggcacatacatcatggagtttgtcaaaagggtttgaactttgaatctacgtgtcttggttacatgcttcacactgttacttgggcgattgtctcaaaggtggcttgcaaataaggacgagattttgtgctgcttatgtatgataa

SEQ ID NO: 376 - DNA, 436 bp, Gossypium hirsutum
  Clone ID: uC-gsronu33B015a06b1
cccactcgttcgataggctttcaggttttttgaccggaatcgagttggctacgttagggtgagatctaaatcttaatacttattctggtatattcttttacaatggtgatgattggtggacgctggtattatacaggtcgaagatatgaggttgatgattcatagcttgggaaagtttctatctcatagggatgtcaaagtaggattcacgattctatgattctttctgcagttgtttgtcataatttaactttttatatggtactcttgcattatgggtactcatggcattgtttacctgcatcaggaactacagcaaagtgcattgttagagagcaacacaggaagggacgatcacattctttacgataagctggttcgtatgtctgacatataaaagcctttggggtccaataagatgttataatctgttttg

SEQ ID NO: 377 - DNA, 78 bp, Gossypium hirsutum
  Clone ID: uC-gsronu33B015a09b1
ttcattgtccgagcccctgccattataggtggcttgaattaaaaaacaatgcatgtctattgattcaaagacttaaag

SEQ ID NO: 378 - DNA, 493 bp, Gossypium hirsutum
  Clone ID: uC-gsronu33B015a11b1
gtccttgcagagagtgaggtgttgggagtaccgtcaacacccttccattgtgcgagttaaccacccaactcgtcctgacaaggctcgtcgcttgggatacaaagccaagcagggttatgttgtctatcgtgtccgtgtgagacgaggtggaaggaagagaccagtacctaagggtattgtgtatgggaaacccacaaaccagggtgtcactcagctgaaatttcagcgcagcaagcgatcagttgcagaggaacgagctggtcgaaagcttggaggccttagggttgtaaactcatattggatcaacgcggattcaacatacaaatactgcgaggtcatcttggttgatactgcccacaatgctatccgcaatgacccacgaatcaactgggatctgtaatccagtgcacaagcacagggaactccgcggactcacctttgctggaaagaaatataggggtcttcgtggctagggacacttgcactcacaggc

SEQ ID NO: 379 - DNA, 717 bp, Gossypium hirsutum
  unsure (1)..(717): unsure at all n locations
  Clone ID: uC-gsronu33B015b01b1
gctattcttatgcagaggcatgttatggttgatgggaaggttaggacggataagacctatccagctggtttcatggatgttgtgtccattcctaaaacaaatgaggacttccgtctactttacgacaccaaagggcgatttcgtctccatgccatcactggcgatgaaaccaagttcaagctctgcaaggttcgatctgtccagtttggccagaacggtattccatacttgaatacatatgatggtcgtactatccgttaccctgatcctttgatcaaggctaatgacaccatcaagctagaccttgaaagcaacaaaattgttgatttcatcaagtttgatgttgggaatgttgtcatggtcactggagggaggaacagagggcgagttggagtaattaagaatagggagaagcataagggcagctttgagacaatccatgttcaagatgctgctgggcatgagtctgcaactcgtctcggcaatgtctttaccattcgaaaaggaacatagccatgggtgtcccttcctaagggtagggtatcaagtatccatcattgangaagctaggagaggcttgctgcccaaatgctgcctaaacttagcatagacatcagatatgatngctgcagagttttttaagataactggagtgtatttatgagtgtgacaaatttgagactattactctgcaatatttttttctgggatgtctac

SEQ ID NO: 380 - DNA, 475 bp, Gossypium hirsutum
  Clone ID: uC-gsronu33B015b03b1
gttcccaccaagttcaaagatgtggatgagaacctgaagagtgtggagttctcctcaaagaagctcttggacttgggatttgagtttaaatatagcttggaagacatgttcgtaggagctgtcgagacatgccgagaaaagggactgcttcctctttctaatgagaagaagaccaacaacatagactgaaaaatatgaactttcaacaattgagtgcctacccgtctttcatttctagtggtgaaaacaatatagatttaaatctattatctgtttcctggtattgaaaaatttttaattgcaaacattggtaatgtaatttggagtctattttgggcaaaaaaaaaaaaaataaaaaaaacaaaaaaaacccaaaaaaaaaaaaaaaaaacaaaaaataataaaacaccaaaaaaaaaaacaaaaaatattttaaaatctaaactgggggcggcccttttaggggatccaagtt

SEQ ID NO: 381 - DNA, 559 bp, Gossypium hirsutum
  unsure (1)..(559): unsure at all n locations
  Clone ID: uC-gsronu33B015b04b1
gggctctctactctggtgttttctcatattgtctacccagtttcaagtcctactacttttcgggttctctcaaactcgggccagttggacaacccaagaacattcgaaccaccccactcctaaaaagcccacaccgaccttcactttactatgttaacctaaccggaataagtgtaggccgggttcaagtccccattgccccggaatacctagcgtttaaccccaacaccggggcagggaccataatagattcgggtacggttgtaacccgattcgtccagcccatttacaaggcaatccgagatgagtttgtgaagcatgtgaaagggacagttactgccattggagtatgtgacacatgctttgatgctacagcagaagctgaggcacctttaataacattacatttcgaagccttgtcgatgccattgccaatggaaaacagcttcttacacaccagtgccgggtctcgggcatgcttggccatagcaccggtcccccacaatgtgaacgccgncatgaatgtgatagccaatttgcagcagcagaatcataggat

SEQ ID NO: 382 - DNA, 466 bp, Gossypium hirsutum
  Clone ID: uC-gsronu33B015b05b1
cccacgcgttcggttgatccgttgatcaggcaagtaacggacggtcaagatgatggagtggagacacagcctttgaccgctgagcatgacttctcgctgttcaaggctcggttcaagaaatcgtacggctcggaggaggagcatgattaccggttcaaggttttccgggcgaacttgagacgagcggcgcgtcatcagaagcttgacccgtccgcgactcacggtgtgactcagttctccgatttgactcccggtgagttcaggaagaggtttttggggttaaggaggggtgagactgcctaaagatgcgaaccaggcaccgattttgcctaccgataatgtgcctgaggattttgattggagagaaaaaggagctgttacgcccgtcaaaaatcagggttcatgtggatcatgctggtcttttagtacaacaggagccttggaaggtgctaattttttggcactg

SEQ ID NO: 383 - DNA, 485 bp, Gossypium hirsutum
  Clone ID: uC-gsronu33B015b06b1
ggaagagcaattgctgtcaagcaattgtctgcagtatcccggcaaggcaagagccagtttgttacagaaattgccactatatctgctgtgcaacaccgtaaccttgtcaaactatatggttgctgcattgaggctgaacaacgtctcctcgtttatgaatttctggaaaacaagagtctagatcaaatattgtttggaaaaagtttggatctcaactggacaacacgctatgatatatgcttgggagtagcacgcggtttagcttatcttcatgaagaatcaagggttcgcattgtgcacagagatgtcaagtccagtaatattttgcttgattctgatctcaccccaaaaatctccgattttcggtctagccaaactttacgatgataagaagacccacataagtacccgtgttgcagggacaattggatatcttgcaccagagtatgccatgcgtgggcaccttacagagaaagactgatgtg

SEQ ID NO: 384 - DNA, 553 bp, Gossypium hirsutum
  Clone ID: uC-gsronu33B015b08b1
tgaacccgtcggctgccggcgcactgctcgagctgctcccgcggcgagagcgggtcgccgcgtgccggccgggggacggactgggaacggctccctcgggggccttccccgggcgacgaacagtcgactcagaactggtacggacaaggggtgaacagaaatggcgaagtcaaagaaccacactgcccacaatcaatcttacaaggctcacaagaatggcatcaagaaacccaagaggcaccgccacacttccaccaaagggatggatcccaagttcttgaggaaccagaggtatgcaaggaagcacaacaagaagagcggtgagtctgctactgaagaagagtaaatttttaatggcaaaagatctagctttgattagtgttttccaattgttgtttttccccccggtggaattgagtgttcgtttactataatcaccttagttgaaatgttattttgggattgttgaatctcattttcaaaagagatttgaagctgtgagcttataatattaagaacatgtttgagctaaaaaaaaaaaaaaaagggcggc

SEQ ID NO: 385 - DNA, 555 bp, Gossypium hirsutum
  unsure (1)..(555): unsure at all n locations
  Clone ID: uC-gsronu33B015b09b1
ggccagccccatgtgcccatgggtttgacaacgatccgtccgccgcatccctaaaaagctctttcaccaggcctagtatacgacatctcgaccgaagaatacatcacattcttgtgctcactcggctacaccgtcgaccatgtcaagaccatagtgaaacgccccaacattacatgttcgacgaaattcaaggaccctggtgaactcaattacccatcgttttcagtcttgtttgggggcaaaagggttgttcgatacactcgtgaattaacaaacgtaggccctgcaaggtccatatacaaagtcacagtaaatggaccatcgacagtagggatctcagttaggcccaagacactcatctttagatccgtgggtgaaaagaagagatacacagtcacctttgtagctaaaagaggaacaagcccaatggctaaacctgaatttggttcaatagtatggngcaatgctcaaaaccaagttaaaagcccagtgtccttctcatggtcattgatgtgagagtgtcccacagtttatatataattctgggtattcttt

SEQ ID NO: 386 - DNA, 478 bp, Gossypium hirsutum
  Clone ID: uC-gsronu33B015b12b1
tccacgcgtccgggaatcgaaggtagaagcaaatgggaatgacttcaggtatcttccatttggtgttggaaggaggagctgtccagggattattttggcactgccaatcctagggatcacattgggacgtttggtgcagaattttgagctattgcctccaaaggggcagtctaagcttgatacatcggagaaaggtggacagttcagtctgcatattctgaagcattcaaccattgttgcaaagccaaggatgatttgatttaacaagtctttcgaaaatatgaacttgcatttagctttgttgggtattaatttgtaacatccatgcatgcacgcattgtttgataaaatcaatctcttcataaagcttttatgtattgatattttagttttcatggtgtggaaacacagacccgatcatggtcaaatatgttttggaggatgagcataattggttcagttctattatttgattact

SEQ ID NO: 387 - DNA, 91 bp, Gossypium hirsutum
  Clone ID: uC-gsronu33B015c01b1
aaaaaaaaaaaaaaaaaaaaaaaaaaaaaaaaaaaaaaggggaggcggttttttgggagcacaatatttatgggcggggggccttgcgggg

SEQ ID NO: 388 - DNA, 548 bp, Gossypium hirsutum
  unsure (1)..(548): unsure at all n locations
  Clone ID: uC-gsronu33B015c03b1
caccaccctttctcccgttgccactccaccaccaaccaccatgacccctcccccagccatgactccaatgtcagcacccgcaccgtcaatccccatggctcctaccccttcaactactccaatggccccaaccccatcctctgtcccagaggcaccaaccccatcaatgaacagttcaccaccggcacctccacctgtgacgcctccatctatgacgcctaattcagaacctacagctacagctccacctccagccatgacccctggggagggcccaccaggttccgctgcttctacacgtgaatacaccatgtccttgttagcattgcttggaggagttgcactctttgtttaggacacttctttttttggtttcgtttactttgatgtagattaagctatttatttgngtattcttttttccttggtccattttctctctcttctcgtcgattcttggagctgatgcttttgtgatttgtgagggctcttttgtagcatttttactttagcttaataaagagagactttgtgattcttggtgtgtt

SEQ ID NO: 389 - DNA, 494 bp, Gossypium hirsutum
  Clone ID: uC-gsronu33B015c04b1
cccacgcgttcggttaaggatgagattgttttggatggtaatgacatcgaacttgtatcccgatctgcagctttgataaaccagaaatgccatgtgaagaacaaggatattagaaagttccttgatggtatctatgttagtgagaagggacgggtcgctgaagaagaatgattaccatctccttgaatcatagttatagtgctgctttatttttttgtcgtggtaatatcttgggactccgttttttgtctcgtctttcctgtttccctggattgcaactgttacagaggacaaggatgttatctttatttgtttgcagaattttggatatctgtttaatctttagtactctaattattcccccattttaagctgtgtgttgatttatagaactgttccttaatgaatctcatttttctgcaatttgcttacgtgctgagtatgttactggaaatccggacttggatattttgaagtttaatcagtaagttgat

SEQ ID NO: 390 - DNA, 270 bp, Gossypium hirsutum
  Clone ID: uC-gsronu33B015c05b1
gggttatctctttgtacaatttcctgtatagtaagccgcttcttttgacttcccattattaaatatattttactgtatatgagaggctaaatttggttttaaattcatggccctcctttctttccttgttgattgatttttctaatggcatttaggtgtgagtttgttacagttaattgttatttcatcaatcaagatttctgggatattttgtaagcaaattgttggctgagtttcatcttcaccgaacaacgatcaacaatttgactg

SEQ ID NO: 391 - DNA, 417 bp, Gossypium hirsutum
  Clone ID: uC-gsronu33B015c06b1
cccacgcgttcgcccacgcgtccgaactgctccatcctctcctctgtttttcaagccgaactccccccttccaacttcgatttagacgaagagaattaaagatgtcgacggcgcgcctcttttggatgaacatgcatgatggatgcgaggaatcgctgaacgtggggtgatggggccgttgctgcagatggagaacgtgcgagcggcgcgatctgcagtttatgcttccattgctgttgaaaacatgttgtgggctagggttaactttgggccattagggccaaatgtatttggtttattgggctgtgcaaatggttttgggccccgggcaacaattgggtatcacatatcatacacgtggattttcacgtagcatttaattattttttaatttaaaaataattttatatttttaaa

SEQ ID NO: 392 - DNA, 579 bp, Gossypium hirsutum
  unsure (1)..(579): unsure at all n locations
  Clone ID: uC-gsronu33B015c07b1
gactttattacctctatatccccttccgccactccttcgccgtccccttccgtttccgagtggtggaaaaccgtttctctttacaccgaccagaccggagccaacgtttcccggactctcgttgtagctaaagaacactccgatacgcgttactcccatgggtatcacctcacgcgcctttctgttcaacaagtcatcgccactgccgtcaaagctgccccgttccccgtcgaccaccgcaacggaatctacttaatcctcacctcccacgacgttaccgttcaagacttctgtcgtgcagtttgcgggttccattacttcacgttcccatccatggtgggttacactatgccctacgcttggatcgggaactccgggaaacaatgccccgaggtttgcgcttaccctntcgccgtccctggctacatgggcggcggtggtccggnggcgttgctaccgccgaacggagacgtcggattggacgggatgatcagtgtgatagcccacgagctggccgaactgacgacgaatccgctggtgaacgcgtggtatgcaggggaggaccccactgcaccgact

SEQ ID NO: 393 - DNA, 107 bp, Gossypium hirsutum
  Clone ID: uC-gsronu33B015c09b1
atattgatcagaggcgtgactacaccaccaaccaccatgacccctcccccagccatgactccaatgtcagcacccgcaccgtcaattcccatggcttctaccccttc

SEQ ID NO: 394 - DNA, 389 bp, Gossypium hirsutum
  Clone ID: uC-gsronu33B015c10b1
ttttcaccatagctttccttctaactcttatatacaccagagagtcgattactactaaaactactgccccaagcacaactgtcaccggccctgcaggctccgtcattggtggtccgccgttgccaaacaccgtggtcaacaccctcctccactatgcttcaaaatccaacgatagttaccacatggcatactcagagctcaagccaatctccgatgtgctgaggaaatgttcttccccttgcaacttccttgttttcggtctaacacatgaaacccttctctggaagtccgtgaaccacatcggacgcacagtgttcatcgacgaaaaccggtattacgccgcttattactaagagttacatcccgaaatcgatgcctaccatgtacaa

SEQ ID NO: 395 - DNA, 350 bp, Gossypium hirsutum
  Clone ID: uC-gsronu33B015c11b1
ttttctttgtcgttataaaggaggaaaggctaagttcagtcggggatggtatgaatttacattggagaataatttgggagaaggggatgtctgtgtctttgaactgctcagatcaagggaaatcgtgctcaaagttactgtatttcgtgttaatggaaagcggtggactaatgcaccgggctcaatgaaatgtctgcgaagttgggccatcttagattatatggttgcaaagttcaggaaagtctggtgtgggcttagggtaaactttgggccatttgggccaaatgtatttgggttaattgggctgtgcaaatgggtttggggcccggggaacaattgggtattacata

SEQ ID NO: 396 - DNA, 473 bp, Gossypium hirsutum
  Clone ID: uC-gsronu33B015c12b1
gaaattactttgaaaaacacgctagaaagtttcagccagttttcctgccagacaaacaagtccaccagtcctctcactaggtttcaatatagaaaattttttctcctttttctatcgatctgtacatccgctgattccttagtgctctttacgatgccttctcgccgtagaaccctcttgaaggtcatcatcctcggcgacagcggggtagggaagacgtctttgatgaatcaatatgtaaataagaaatttagcaatcagtataaggcgacgattggagctgattttttgacaaaggaagtgcagtttgaggataggctttttaccttacagatctgggacacagctggccaggaaagattccagagcctaggtgttgctttcattcgcggtgctgattgttgtgttcttgtatatgatgtcaactcaatgaaatcgtttgacaaccttaacaactggggagaagaatttct

SEQ ID NO: 397 - DNA, 522 bp, Gossypium hirsutum
  Clone ID: uC-gsronu33B015d03b1
gggttctattcctcttccacgcagcttattccacaattcagtatagggggctattgaagattatggaggaggagttttctggtccgcccatgaacgtggttttagagttgcttctagggtttgttttctgtatttcagctgctctaaccgtgcccgggaattttctctccatacatcctgattctgaggagaataggattgtttctttatcagcaaacttggactttatgatcttcaatcacagagcgaaagcacttccttcagaaactgatatgaagctgaagcattaagatcaaagaagcttcatagtcctttgattaaggagattagcactgttggcaggtctgttgaacgtaagagtagagagcctatgtcttaggtcattgtcgattgttttctgaagtgatagtgttttttaacctttcattacttgctagaatttggattttggctctcttgtttacttttatgttactttgcctgacatactgaaccaggccagccattcaatatattattctt

SEQ ID NO: 398 - DNA, 583 bp, Gossypium hirsutum
  unsure (1)..(583): unsure at all n locations
  Clone ID: uC-gsronu33B015d04b1
gacatcatgctatctttgctgaacattcttcttctgctactcatccatgccaatatatagcttactttgggccaacgattcatccctcttcctcaaattccagtggaagtatttcagatagttctagcttcaacggtcactggaatggtccatctgtgcctagtgagatacctccatcttatgcttttcctgcaatgaatctccattatcaaggttgggagcaccattcccctccattctctacatctaaccgtcgaattggtggttccggtcaaccttcaattccacctgtcagtcaaaggtctgccaggaacagttcagatatgccaagtctgggaacttttatgcatccatttgttgctagccacagttctggtactagaatagcaagtgcagttgcttcctcatttatccctccttaccctggtagcaatgcccgggctcgtgatagagttcaagctctccaggcatattatcaacaccaccaccctagcaccttgccagcattacggacacccatngtttctggctcccgaggctgggcagccatagaagtcatggtcatggtcatggacatggtcat

SEQ ID NO: 399 - DNA, 503 bp, Gossypium hirsutum
  Clone ID: uC-gsronu33B015d06b1
gagctattatatgtagacattacagagttccaaaccaatcttgtgccatatcctcggatccatttcatgctctcttcttatgcgcctgttatctcagctgagaaagcataccatgaacagatatcagttcctgagatcacaaacgctgtgtttgagccctcaagcatgatggctaagtgcgatccaaggcatggcaagtacatggcttgctgcctgatgtatcgaggagatgtggtgcccaaggatgtgaatgctgctgtcgctaccatcaaaacgaagaggaccgtgcagtttgttgactggtgcccaactggtttcaaatgcggtattaactatcagcccccagctgttgtccctggaggtgatcttgctaaggtgcagcgagctgtttgtatgataagcaataacacagcaatggcagaggtgtttgcacgcattgaccacaagtttgatctgatgtactcgaagagagcttttgtgcattggtatgttggatagggcat

SEQ ID NO: 400 - DNA, 579 bp, Gossypium hirsutum
  Clone ID: uC-gsronu33B015d08b1
tccactcgtccggccaccaaaaaacatctttctgttcaattcaatcctcctttttctattcaaccataatgtcttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaaggaaggctggtgtcctccctggcatcaaggtcgacaagggtaccgttgagcttaacggaaccaaccgcgagactttcacccagggtctggatggccttgcacagcgatgccagaagtactatgaagctggtgctcgctctgctaaatggcgtgctgtccttaagatcagtgctaatgagccaaccgagcttgcaatccaagaaaatgccaacgggctagctatgtatgct

SEQ ID NO: 401 - DNA, 450 bp, Gossypium hirsutum
  Clone ID: uC-gsronu33B015d11b1
tctctctcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctc

SEQ ID NO: 402 - DNA, 463 bp, Gossypium hirsutum
  Clone ID: uC-gsronu33B015e02b1
ataacaactcatttattcctggtgttgtgtttggtgacttggaggctggcgccgtcttttcttcttcaatagagtcagaatgtcttacgcttacctcttcagggacataatcatcggagacactggagtggggaaatcatgccttgtccttcagttcaccgacagacgggttcagtcggaacatgatcttaccatcgggggtgaataccgagccaggatgatcaccatcgatgacaaacccattaagctgcgtatctgggacaccgtaggtcaagaatcctctagatccatcacaagatcctactacagaggagctgctggagccctgcttgtctatgatatcaccaggagggaaacttgtaatcactgggctagctggttggaggatgccagacagcacgctgatgctaacatgactattatgctgattggtataagtgtgaccttgctcatagaagggctg

SEQ ID NO: 403 - DNA, 564 bp, Gossypium hirsutum
  Clone ID: uC-gsronu33B015e03b1
gaatttaggtcaccgccgtgcccattccgaaatcataactcttcctgatgatattaacttcgacggtgatctcggcgtcgttggggcagccgacgggccttcctattccgatgaaacggaggacgatatgttgtctatgtatctcgatatcgataagttcaattcttcttccgtcacctcaatgtttcaggttggcaagtcgttgacaacgactgctccaaattctggtccatcggctgcggtgagtatgggagcagggacggcaacgtccggtgaggaaaatgcgagtgttggtgttgggtcttctgagaagcctagaattaggcaccaacatagccagtcgatggatgggtcgacaagtattaagcccgaaatgctcctctctggttcggatgaggttacgcctgctgattctaagaaagcaatgtccgctgctaagcttgctgagcttgctcttattgatcccaagcgtgctaagaggatctgggcgaataggcagtctgctgcgaggtcaaaggaaagaaagatgcggtatatagctgagcttggacggaaaatacagac

SEQ ID NO: 404 - DNA, 562 bp, Gossypium hirsutum
  Clone ID: uC-gsronu33B015e04b1
cccactcgtccgcccacgcgtccgcccacgcgtccgcttcagggtggagtgagcaaataagggtttgctccgcgacgtcattagaggggcctctggatgatggatattgctggcgaaaatatgggcagaaagatattcttggatccaattttccaaggggatattatcgatgcactcatcgtttctcgcaaggctgcttagccggtaagcaaattcaaagatcagacgaggacccaacaatcttcgaggtgaaatatcgtggaagacatacctgtaaccaagtctctcacttggttgctacgcccaaagagaaaggcaatcattatcgggaaaagcagcaagttgaagagaaacaaaagcaatccgaggaattgttgttgagttttgaaacagggcttaaggttaatacagaggacttggacaacagagagaacatatttccttcattttctttccccattgagtcagaggaagttcaaaatgggttattgcgtaattccctaatgaaaaacatatctccggcatttgtgtcaccagctacatctgaatccaactattttca

SEQ ID NO: 405 - DNA, 388 bp, Gossypium hirsutum
  Clone ID: uC-gsronu33B015e06b1
cccattcgttcgctcttcatatggggcttcaataaaaacaaaaaaaaaaaaacacggaaagccgcataggatcttgctactgatttacataggatattactgtctcataaataagttagatgtgttgtctgtatggggtttttgttttctttattaccttctgtcttaaaacttttttatcagtttactaccatgatgatgtttggtaggcatctgattgtgagtgttttgttgggtacatatggtttgtattgaaatgggaactcatttgtcagttaatgcatcttgttggttatacccatgtgaggtatagacccacagtagttaatggatgatgatgatgatgtttaaaaaaaaaaaaaaagcccataaaaattctaataagttg

SEQ ID NO: 406 - DNA, 505 bp, Gossypium hirsutum
  unsure (1)..(505): unsure at all n locations
  Clone ID: uC-gsronu33B015e07b1
tccactcgtccgcccacgcgtccgagatgttgaaggcactgatggtggtgatggtagtagtggagaaggtgtcatagattttcatttgcctcttgatgatgacgtagaacaaaacaactccggtggcggcgaagagtgggattgtaactttcagaacttggaaccgccgcctgctaatgttctcgccggcatgtcttccggattttctggtgattttttcaatgatagttcgccgaaatgccttacgggttcttgtgatggatcttctcagctaaaccagtggtcgagcgttacagaagcatcctccggcagaagtgttaccctacacagtgagtccaccggtgtcaaaggttcaatccggttccagacctccagtcctgtatctgtgcttgaagcagtagtacttgctctgctgcaaacccggtacctattaaccctnaactcggtttcctggtgaaacgaggtcgaagcaagcgcagacgagcatctgcctttaatgtgcact

SEQ ID NO: 407 - DNA, 559 bp, Gossypium hirsutum
  Clone ID: uC-gsronu33B015e12b1
tctacttatgcttccgccgcgaaaggagatgccccattttcatgaaggattgactttgctgctacgattttaccctcctgctccttgaccacaaggcctgacgccgatctgttatgttatgagtcgaaagccgcatcgaagaagatggccatattttctctttgttgtctctgactagtctttgtattctttactaaggaatttatttctgcttgtccaaagtatccatagcccatagctgaatccttgacactgttcagttgttccttcgctgaaaacccaggacaccgttgaaagacgtggttactatcttctgtttcctgtccacacctcaagcatcgatcctcagttattactcttctcagttttaagttggagaaagttggaatgtaactccacgcaattttccatactgtaatcttaacttttgtaggcagatctaaattcataatttcctgaaaaaattatttgtatgggtctgtaaataatcatttagctctgtagtagattcctgtaatagtttataggcgcttctcactataaagactcccgtcgcctc

SEQ ID NO: 408 - DNA, 565 bp, Gossypium hirsutum
  Clone ID: uC-gsronu33B015f02b1
gttcactgttgcatcctcaaagtaattatagacagattcactgttgagctgacttctcgatcttctgatttgattgatcatcataatcgttataaaaagccgaaagatttacattatgacaacgaagccgagcttaaagatattcgcaaagaagaggatgccaaaaagagaaactctcgtcagagaacatacatgaaacgaattatcgttcatccttctttccataacattgatttccgcaaagcagaaaagattctttctgatggtgaacaaggcgaagccattataagaccttcttcgaaaggcaacgatcatcttactctgtcctggaaggtctatgatggtattcatcagcatgtggacattcgggaagaaggcaaaaacaacgtcttttcacttggacagcaattatttattggcaatgaaacttttgaagatcttgatgaaataattgctcgatacgtgcagccgatggctggattcgctcgtgatatgactagctttcagtattttcgcgatctaaatggtgaccgttcagcggcttgaaggttattaatgatgaaaa

SEQ ID NO: 409 - DNA, 557 bp, Gossypium hirsutum
  unsure (1)..(557): unsure at all n locations
  Clone ID: uC-gsronu33B015f04b1
cccacgcgttcgcccacgcgtccgctttgccttcatagttccattccattttccctaacaaatttatttagatctgatcagatttaactcagatccttttgtatcgagtcttctaaattccagatctttacttattttgaccttaggaagaaagaaaaagaagagatgagagagattattagcgtccacattggtcaagctgggattcaagtcgggaattcttgctgggagctctactgtcttgaacatgaaatccatcctgatggaaccatgcccagtgacacctcagtcggtgtagcacacgatgctttcaacactttcttcagcgaaacgggttcaggaaagcatgtaccgagagctgtctttgttgatctggaacccactgttatcgatgaagtgcggactggcccttatcgccaactnttccaccctgagcagcttatttctggcaaggaagatgctgctaataactttgccagaggccactatacaattggcaaggaaattgttgatctctgccttgatcgagttaggaagtagctgataactgactgtct

SEQ ID NO: 410 - DNA, 404 bp, Gossypium hirsutum
  Clone ID: uC-gsronu33B015f05b1
cccactcgttcgggaggaatacaaaagcttcgtgattacaatccaaacttcccccaagagcgacggtaaaggcagtatagtgcactggactctggattatgaaaagctgcacgagggtattggacatcccgagtctctgctccagttctttatcgaactcacagcggacatggctgctcatctccgcaaggaaacttaattaatggatagaccatggcaagaaaatcccatgtcgaatcgtctgctattactattactatcagtactgatctaagaataaaactggcagctttgtactgtgttttcatttgaatatttgtatgctaggtttgattatgctgttatgagtgcgggagcgcagcgttctgtttttatgtaatgaattaaatctactatgtgctttt

SEQ ID NO: 411 - DNA, 558 bp, Gossypium hirsutum
  Clone ID: uC-gsronu33B015f06b1
cccacgcgttcgagaatttactgataaagcagagctaagaaacgaagaaatgttgaggtccattgcaaaacgagccacgctcttaaagccacgagctgattcacctataatccctcccctcatctcttcccaatccaagctctattcttccaagaacgcaaaggcctcccacgggaaatccaagaaaggcgatcccaagtccaagaccaagtccaagaacggcggttcctcttcctccgttgcctcctccactggtgatgacttcgattctgccggcgccgacgacttcgaggctgctcgagcccgccgcctggtcgaggacgagaatgacccttctctagatgtgggacccaatggacgtcccttgttcacttccactgccttactttccctgctcactcggaaagactgttgctcgtacatgaagttcagtgagaagggattgaaccaagtgttgccggagggtttgccgacgggaatggtgaccgagtttaaggagtcgatgaggcccgcactccttgttcgacagagtttcttggatcttcgtgataatttaga

SEQ ID NO: 412 - DNA, 552 bp, Gossypium hirsutum
  Clone ID: uC-gsronu33B015f08b1
agactgataaattttcatgtttagtgatggagttctgccccggcggtgatttgcatacactaagacagagacaaccaggaaagcattttactgagctagcagtgaaattctatgtagcagaggttctccttgctttggaatatctccacatgcttggtattgtatatcgtgatctcaagccagaaaatgttcttgttcgagaagatggacacataatgctttcagactttgatctttccctccgttgtgctttcaatccaacactagtcaagttgtccacacctgagtctgaaccattgcgaaagaattcaacttattgtgtacaaccagcttgcattgagccctcctgcatccagccatcatgtgtggtacctacaacatgtttttcacctcgcttcttttcatcaaaatccaaaaaagaccgcaagccgaagaataaaatgggaaaccaagtcagtccattgcctgagcttattgctgagccaaccaatgctcgctccatgtcatttgtgggacccatgagtacttgggctccgaaattatcaaaggtca

SEQ ID NO: 413 - DNA, 182 bp, Gossypium hirsutum
  Clone ID: uC-gsronu33B015f09b1
ctcttcaccttgttcttcgtcttcgtggtgggttctaagccttaaggtcttccttaatgtgggttttctggttttacgtgaaggattgtgccctttgatggccttttaaataatttctagtctttgtttaccggttgcatctatgtatggtttctctttgaatggaatttgcatatttacct

SEQ ID NO: 414 - DNA, 539 bp, Gossypium hirsutum
  Clone ID: uC-gsronu33B015f11b1
ttcattcgtccggtgcaaggttggagatgataacggcagcttgatgttgatatgggaagatggattttgcaaaggaagggttacaacagaatgtttggaagagattgaaggagaagatccagtgaggaaagctttcagcaaaatgtctattcagttatataattatggagaagggtgggtactgggttggagatgataacggcagcttcctcctgaatggactgatcaattggattcaggcattcaggttctcctcttatattgttgaagatgcagatgttctttctaccatgttgatgttgcatcccccctcgcaatgttgaagtctttcaccatattgaggttgtaaaagtcttctcactgtgttgatgttgcaaaacttagaattgttccccctctcactatgttgaaattgtaaaaggctttccggcattcgaaacagatccaccttggtcatcacgaatgccacccaccttgctatatgcgtcgatgttggaaaaaaaaataaaatgtcggtcttgtgaaaagtaaaatttttt

SEQ ID NO: 415 - DNA, 198 bp, Gossypium hirsutum
  Clone ID: uC-gsronu33B015g01b1
gttaatgcttgagtgaagagttacatttccatattgacccaaataatcagaagtttagaggtgttgtatttgaatatttagttttctgtgcagcataaataggaaatagttaaatgtaacaaggtgttttactagaagtacacgcttacagctttgagtactgattatttttgcaatttttatacgcttttctcagat

SEQ ID NO: 416 - DNA, 468 bp, Gossypium hirsutum
  Clone ID: uC-gsronu33B015g02b1
cccactcgttcggtttcccactgttgtctgactttccaaaaaacctaactgaaaaacaaaaacaaaaattcgaaactaaagactcaaattgaaatcaaagagagaagctaagctaaagattgcgaattgctctttcggaagttttcaagcttatggtgtccgtgaaccccaacccagctcaaggtttttacttcttcgatccgatgaatatgggtcttcctggtgttaattcagccccgcctgccaataaggtggcgccgccgcttcatgttccacctcctcctgccacctccggtgctggtaatactacagtgtatccggaggatcccagtaagaaaatccgaaagccttacactattaccaagtctagagagagctggactgagcaggagcacgagaagtttctcgaagctcttcaattatttgatcgtgattggaaaaagattgaagcttttgtcgggtcaaaga

SEQ ID NO: 417 - DNA, 455 bp, Gossypium hirsutum
  Clone ID: uC-gsronu33B015g03b1
cccacgcgttcggtcgctgccccatttgaccacatccaacatgcctcgccgaagctctggaagatctgcttctcgcccagcccctcgtcctgctccggcacgtagcccaccgcctcaacctgctcaacatgctcctcctccagctcctgctcagagtggaagtgggggatcccttcttggaggcataggctcaacaatagctcagggcatggcttttggaactggaagtgctgtagcccacagggctgtcgatgctgttatgggtcctcgtactattcaacatgaaactgttgtttccgaggctgcagcagcccctgccaatagttttaccggctctgatgcatgcagcatacactctaaggcattccaagactgcctgaatagctatgggaacgaaatcagcaagtgtcagttctacatggatatgttgtcagagtgcaggaagaactctggat

SEQ ID NO: 418 - DNA, 603 bp, Gossypium hirsutum
  unsure (1)..(603): unsure at all n locations
  Clone ID: uC-gsronu33B015g04b1
agcattactaggtgttggcatgcaacatcatgcagcagatggatattctggtctccacttcatcaacacatggtctgatatggttcgtggtcttgaccttacaattccaccattcattgatcggacccttcttcgtgcccgggaccccccacaacctgtgttccaccacgtcgaatatcaaccaccaccggcaatgaagattccaccccagtccaccggtcctgaaagcacagcaatctccattttcaaattgacccgggatcaactcaatgcactcaaagcaaagtgcaaggaagatggtaacgatgttaactatagttcatacgagatgttgtcaggtcatgtgtggagatcagtctgcaaggcacgtggacttgaagatgatcaagggactaaactgtacattgccactgatggaagggcaaggttgcgccccccactcccacctggttactttgggaatgtgatcttcactgctaccccaatagcagtggcaggggatctactgtcaaagccaacatggtacgctgcgagccgtattcatgatgcattggttcngatggatgatgaatatctaaggtcagcccttgattacctggaact

SEQ ID NO: 419 - DNA, 396 bp, Gossypium hirsutum
  Clone ID: uC-gsronu33B015g05b1
atgactctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggttttatctgttgttaaaatcttataaaaatatatatcgattgctgctcttggtttgtt

SEQ ID NO: 420 - DNA, 501 bp, Gossypium hirsutum
  Clone ID: uC-gsronu33B015g06b1
gtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgactt

SEQ ID NO: 421 - DNA, 319 bp, Gossypium hirsutum
  Clone ID: uC-gsronu33B015g07b1
tcctctcgtccgttaaaaaaaaaaaaaaaaaggggaggatttatattaaaagggggggatattatagataacaaaaggttggttgctttgctggttcattggatacttgctttttgtggtccgctttgtcttttttctgtggggctttgttgtacctttttgttggtgcgtttctgcggtttttcccctgtgtttccgtgtggggcttccctctttctcgctttgtggctttttccctttggcccccttggcgttttttttttcttggctttgtcgcttttgttttttgcttcggtctgtgcccttttgtttgggtgtt

SEQ ID NO: 422 - DNA, 516 bp, Gossypium hirsutum
  Clone ID: uC-gsronu33B015g08b1
ttcattcttttcaagacgcatcccaacatgaacaaggagttattttccaatgagaacattctagggttgaaggaccctaataggcctttccccactggttctgctggggatgcagctggtgttggtctcttgaaatggagaatgcaaagtgcagatgagtcaatggttccattgaccatcaactgttggccttcggtttctggaaatgaaacttatgttagcattgaatatgaagcttctgccatgtttgatctgcgaaacgttgtgatttatgtacctctcccagctcttcgggaggccccaaatgttaggcagattgatggtgaatggagatatgactccagaaattctgtcttagaatggtccatacttctcattgataactctaaccgcagtggatcaatggagtttgttgtgcctccagcagattcatctgtgttcttccccatttctgtccgtttttcagcaacgagtacatacagtgacctgaaggttgtgaacatcattcccctgaga

SEQ ID NO: 423 - DNA, 502 bp, Gossypium hirsutum
  Clone ID: uC-gsronu33B015g10b1
tccacgcgtccgcacatatatacagcacgcccctctttcatttctctccatctctatatctctcagctcttttcttctcttgtgacactgctaatattttttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataatacgcgtccactagacacgatttacagcaattttattgatg

SEQ ID NO: 424 - DNA, 523 bp, Gossypium hirsutum
  unsure (1)..(523): unsure at all n locations
  Clone ID: uC-gsronu33B015g11b1
tgaatgcacaatcagggggttcttgcattgatgaactgacagcaatagctaaacttcacagtgctgaacttctcaaaaccctggttaagttacagagccagcttgaagggttcaaatatgcttattacaatttgtatcagtcttttactgaaaggttgaacaacccttcaaaatatggtttcaaagatgcaacgacagcatgttgcggctctggtccgtacggaggagtttatagctgtggagggaagagaggatagaggtgtatgaactatgtgataaacctggtgatcatttcttctttgattcatatcatccctcggaaaaggcctaccggcaatttgcggagttaatgtgggctggcaatactgatatcgtttggccttacaatcttaaaatgctatttcaagacaatgcattttacccgtagaataacttttttttttatttcgtattaattccaaaaataagatatcgngtattcgtataattatattatataaaatgtcttacttcaatattttaa

SEQ ID NO: 425 - DNA, 285 bp, Gossypium hirsutum
  Clone ID: uC-gsronu33B015g12b1
ttcactcgtccgcccacgcgtccgaaattaagggggggtattattattaaaaatgggtgggtattcttaaaatttattgaattttaagtatattttttattatttgggtggtctgttttggggggcctggcttttttgggcttgcaggctgcgttccgggggcttgctggggtcactttgttttctttggttgcctcgttgtttccccggcccggcgggtcccccccgggggttgcgctttttcttgggtttgccgccttttcctcttttcccctctggccctct

SEQ ID NO: 426 - DNA, 377 bp, Gossypium hirsutum
  Clone ID: uC-gsronu33B015h01b1
cccactcgttcgtagatcgcgagcggcgcccttatgggttattttttttttattttgttttttttttttttttttttaatggaaaaaaagaaagaaagatgttatatttagaagataaagaaaactggaaatagaaaaaaaaaacaactaaaaaaatttaaaggttttagaaaaaaaaggaaaaaaagaaaaaaaaataaaaaaaaaattgggaagaaaaaaggaagaagaccaaaaaaaatcaataaaaaaaaaagaaggaaaaagggggaggggaaaaaaaaataataaaaatggaagacaaaaaggaggacaaacaaagccagttggatattaaggggcaaaaaacaaaagttaaaaaaaaaaagggcaactac

SEQ ID NO: 427 - DNA, 485 bp, Gossypium hirsutum
  Clone ID: uC-gsronu33B015h03b1
cccacggtccgaagcactcttgagcagcaacagaggcttcattcagatcacatatcagcagccatggtgaagtattcgaaggaacccgataatcccaccaaatcctgcaaggcaaggggctctgatcttagggttcatttcaagaacacaagggagacagctttcgccattagaaagttgccattggttaaggctaaaaggtatttggaggatgttatggcccacaagcaagccataccgttccgacgcttttgtggtggtgttggacgtacggcacaagcaaagaacaggcattctaacggacaaggtcgctggcctgtaaaatcggcaaagttcattctagatttgctgaagaatgctgagagtaatgccgaggttaagggtttagacgtcgatgcactccatatttctcacatccaggttaaccaggcccaaaaacaaaggcgtcgtacttaccgagctcatggaagaatcaacccttacat

SEQ ID NO: 428 - DNA, 529 bp, Gossypium hirsutum
  Clone ID: uC-gsronu33B015h05b1
gatcgattctaccatcaatcccaacaagacacgtgttttcttcactactatgtcctctatacattccaagagcaaagactggggcagggaagatgggcttaaatgcttcaacgaaacgaagccagtgatgaagaagaaattctggggaagcggttccaacaaggatatgatgagcgtggtggctggtgtgatcaacaaaatgaaagtccccgtttcggttcttaacattacgcagctttcagagtacaggatcgatgcccactcatccatttataccgaaactgggggacggcttttgaacgacgaggaaaaagcagatccaggccgtcatgccgattgcatccattggtgcttgcctggtgttcccgatacttggaatcaaatatttttagcacatttgtagatttttattttcattttttcactccacagaaaccgagaagggaattaatctgctttgtatgcgttaattcaaagttcttttgattggtatattgcaagttgtattcttaagcaaattttgtgcata

SEQ ID NO: 429 - DNA, 447 bp, Gossypium hirsutum
  Clone ID: uC-gsronu33B015h08b1
ttagatcgcgggcggccgaattggtatcaggtattgggactggtcttattgcttattccttagaatgtaggaataggtaaaagcaccttttacagtgttaaaaaccatttcgctatgggcagaatgtgactgctcattagactttataagttcttttcttttctttttgtcattttcatctgttcttatttttcttggtttttcttaatgagaaagagttgacaagggaaaaaaaaagcttaagcagaaaagtttagtcttaaaaaaaaaaaaaaaaaaaaaaaaaaaaaaaaaaaaaaaaaaaaaaaaaaaaaaaaaaaaaaaaaaaaaaaaaaattaaaatttacaaacccctaaaacccggtttttttctaaataaaaataaattttaatcctcttattttactttattttaaagggggggcctttttaaggaaaccaaatttt

SEQ ID NO: 430 - DNA, 492 bp, Gossypium hirsutum
  Clone ID: uC-gsronu33B015h11b1
tccacgcgtccgggaagatagacttggtgtatggtgggggaagtgttgggttgatgggtttgatatcccagacagtgtatgatggaggttgtaatgctcttgggataattccaaaagctcttatgccttctgagatatcaggagaaacggtgggagaagcgagaactgttttagacatgcatgagcgcaaggctgaaatggcccgagaagcggatgcctttattgctcttcctggtggatatggaacaatggaagagttgctggagatgataacatggtcccatcttggaatacataagaaaacagttggtttgctaaatgttgatggttactacaataatttgcttgctttattcgacaacggtgtcgaagagggtttcatcaagccaggtgctaggcatataattgtctctgctccaacggccaatgaacttttggagaagatggagcaatacacaccttcacatgaacatgtggctccttatgaaagct

SEQ ID NO: 431 - DNA, 476 bp, Gossypium hirsutum
  Clone ID: uC-gsronu33B016a03b1
cccactcgttcgcggacgcgtgggtttttttttttttgaaacaaatataaattaacttattttttcatccaattatttcactgatttgtaaggtacataatttatggattggaaggcgagaaggatatactaaagggtagagggtggttgtattatgataaattggcgaaatcagggtggaaaggtaaggcagagattatggagacggaaggtgaggatcatgtgttccatatctttaatcctgattgcgacaacgccaaccgcttgatcaaacgtttggcttctttcttcaaccaagggaagcttccttttcaatggaaatgtgaaagcgaggtgcttggttagtaagtaaactaaaaaaagaagggtgagattgagatataacctattgtcaacatgccctgcatctgttggtatttcctttccattatacaatttgtcttaactgaatgctgccttaagaaattttcatttta

SEQ ID NO: 432 - DNA, 315 bp, Gossypium hirsutum
  Clone ID: uC-gsronu33B016a04b1
cccactcgttcgcccacgcgtccgcagcatctgaatcgcttattgctgctatctttgcgatttacagactagtattgctgctttgttttttatcaataattttcagcagtcaggttcgcttctctcacacatttagcttacaaatgtgggagcaaatgttaggctgcgaatctatttattaaagtatgcctcttgtactttttatcatgtgggatatttggttgtgtgtatgtgaactctgttgatgcaaaaaaaaaaaaaaaattggttaaatgctttgctcccttgagtcaaacaaaggggaacttttctatg

SEQ ID NO: 433 - DNA, 429 bp, Gossypium hirsutum
  Clone ID: uC-gsronu33B016a05b1
gtggtgattgagagatggagtggagggctagatgtttggatgtgatattggtgccattaagcatgctcatccccattgcttatcactgctggttatggcataaggttaggactcagcctctggctaccatcattggaatcaataccaccggacgacgctactgggtgtctgccatcatcaaggacaacgcgaaaaagaacatcctggcagtgcaaacgcttcgaaacaccataatgggatcgaccctaatggccacaacatccatcctgctatgtgctgggttggcagccgtcatcagcagcacttacacaggcaataagccactcaatgactctatattcggagctcacggggagttcatggtggctctcatgtacgtcacaatcctaagaatcttcctcttctcgttttcgtgccacaccttatcta

SEQ ID NO: 434 - DNA, 151 bp, Gossypium hirsutum
  Clone ID: uC-gsronu33B016a06b1
gcagtatctacattctcttttgctttgagccttgctattctctcaatctgggccggtgatgctggtcaccaccatgcgacagggccatccccttcttcttcttaaaaccccccttcctccaccgcggactggtcgactctgatactgaaca

SEQ ID NO: 435 - DNA, 479 bp, Gossypium hirsutum
  Clone ID: uC-gsronu33B016a07b1
tccattcgtccgcccacgcgtccggtcaaagaccctgatttgaaagaggaactcaaaatacctgaaggctttaaccttgatgtctacggaaagcccgacatagatcaagtggtgggttcttctacttcgattctcttctctggctattcctgcaggtattttggatatcttgtttctcggaaaaaatacattatctctgtagacgatgactgcctcccagctcgagaccctaagggctttttggtggatgctgttgcccagcatataagcaaccttaccaacccagccacaccattcttttttaatactttgtatgacccttatgctgaaggagctgattttgttcgtggctacccattcagtcttcggggtggggtgaaatgtgctttgtcatgtgggctatggcttaatctggctgatcatgatgcacctactcaagcccctaaggcaaggcaaagggaattcccgatatgttgatg

SEQ ID NO: 436 - DNA, 465 bp, Gossypium hirsutum
  Clone ID: uC-gsronu33B016a08b1
gattataaaaacctggtccgatcccgactcgaccgtgattcagcccgagttaacacgctcaccaccgaggtactactcgctgtcaatggggttcgcaaaactgagctgaagcctgttgttaccgagttagaaccagaggcgctttccacccctgttatttccggtacgagccaagggagtggggagtattttacccgggtcggagtcggtaacccggctaaacaattctacatggttcttgataccgggagtgatgttaattggatccaatgtgaaccatgtacggattgttaccaacaatccgacccgatttttgacccgtcggcgtcgtcgacttacagtccggttacttgcgagtcaaggcaatgttctcttctacgacaatcggcttgtcgtggcgggaaatgtctttacaggtgtcctacggtgatggatcttacacgtaggggatttcgtgactgaaac

SEQ ID NO: 437 - DNA, 482 bp, Gossypium hirsutum
  Clone ID: uC-gsronu33B016a10b1
ttatttcgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccggccgccatgtttcgctcgatatagcgacggattgtttcagtgctttctccgttgtgtcgttgatggggttcttctttatggagaaaagaaaggcaaggaaatctcagcagtagtgagatatattatggttttaagaaccctaattaaacctttgaaaggatttttatagtaatgggtttgatttgcatgtcttatttactttctttggggttttaatcctagatgatgggagataaagaggtaagctgatgg

SEQ ID NO: 438 - DNA, 408 bp, Gossypium hirsutum
  Clone ID: uC-gsronu33B016a11b1
ttgttatgaagaatatgacaggggtaagaggaagaagataaggcaaaataagcacaagttcggcggtgcaaatcttttccaacaaatcggcactaagaaaacacagtttaagaaggctaagttagaccattctaaatcagaaaacctaccattcaggatatgaagtaaatccattatcaatttggatcaattttgacctctctgtctgctgttatagtttatgcagcaattcttgctgtcttgttgacatgagcgaaattgtattttgtaaccaggagaatgtctaaagtggagaaaaaaaaatcagataattgtagtttttcccattccttttccttttctggagtttcttcattatataggtctagcttgggacacacggacgaaaaggacctgttctatggaata

SEQ ID NO: 439 - DNA, 447 bp, Gossypium hirsutum
  Clone ID: uC-gsronu33B016a12b1
ttggtaccaaggctgccaaacagtggggagctcagctccattctttctgcgttggcctagagggttcaccagatttgaaggcagcaaaggaggttgcagactatctgggcaccgtccatcatgaatttcatttcactgttcaagatggaatcgatgccatcgaagatgtcatctaccacatcgaaacatatgacgtcaccacaatcagggcaagcactcctatgttcttgatgtcaagaaagatcaagtcactaggtgtgaagatggttatctctggtgaaggctctgatgagatctttggtggatacctgtacttccacaaggcaccagataaggatgaattccaccggaagacattgtcaggtggggagtttggctggggcggcacatctgttaaaagataacgcaagtgtcctaagatgagctcaacgagaacagaaatctcgt

SEQ ID NO: 440 - DNA, 507 bp, Gossypium hirsutum
  Clone ID: uC-gsronu33B016b02b1
gggattagccctgaattttgttagttccattttgatcttgtattcatagtgtagtcctgttaataatatttccagggtttgttttgtaaattgacttgtactcggttttgggatgtcctgtggattggttggtttctccaatgtggttcccaacactgatacaacatgatttgagctttgtaagcttcgatgcagtttgcaaagacaaatccttggcctgcaatacaacagatgaagggttaggtttagttccagtctgatttgctattagaattgaggccccatattatcctgtcctcacctccatgcatagatcaaccagcaagattaagcataggtctatgtgagacattaaccacattgtttgagttgtcaacttgacaattaacacgtttgccactggtagagaacttcctaacccagcgaggtatttcagcttcagaaaaaaggaatcatattgttttcattctagcagtttgaccactccaaaactgccgtttatacctt

SEQ ID NO: 441 - DNA, 510 bp, Gossypium hirsutum
  Clone ID: uC-gsronu33B016b03b1
gaaaatatttcaaatctcctcctcctcctcagaaatcttagtatcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaaaactgagtggctcgacggacagcacgttgtgtttggacaagttgttgaaggcatggatgtggtgacagccattgagaaagtt

SEQ ID NO: 442 - DNA, 562 bp, Gossypium hirsutum
  Clone ID: uC-gsronu33B016b05b1
tggaaaaattgtacttttgtcaaagggtgcagatgaagcaattcttccttttgcttatgttgggcaacaaacaagaacatttattgaagctgtagaacagtatgctcaattggggcttcgtactttatgcttagcttgccgtgaattgagagaggatgagtatcaagagtggtctttgttgttcaaagaggctagtagcacattagttgatagggagtggaggattgctgaggtttgccaaagattagaacatgattttgaggttctaggtgttactgcaatagaggatcgtctacaggatggtgtacctgaaacaattgagacactcaggaaagctggaattaatttttggatgctgaccggagacaagcagaatactgccatacagattgctctttcttgcaattttatttccccagagccaaaaggtcagcttcttctaattgatggaaaaactgaagatgaggtttgtagaaagttagagagagttttgcttacaatgagggtaacatctttcgaacctaagatgtggcaattgtgctgatggatgggctcttgaatt

SEQ ID NO: 443 - DNA, 497 bp, Gossypium hirsutum
  Clone ID: uC-gsronu33B016b07b1
tccactcgtccgcccacgcgtccgcaaatccatgaagttcaaagacggatacatgatttcttctggtcacccagtgaacgagtacattgactctgctgttcgacatgttcttctgagacagggagtactgggcatcaaggtgaagatcatgcttgactgggatccaaagggtaagcaaggcccaacaactccactcccggatcttgtcaccatccaccctcccaaggaggatgaagttatcaaggtggaagcacctgtgccgaccgagattgaacttccgccagtggcttaaagccaatgataactgttatgatagtcatctatttgatatttggagcatgttaagtgtcttagattttgtagtttttaagtttggcacctaaaatgaacttatgctggatgcttttttctgaattttccttttgtgtttctcaaattttgttatacttaaaacttattacttgataattttattcaaggattttttattcctttct

SEQ ID NO: 444 - DNA, 488 bp, Gossypium hirsutum
  Clone ID: uC-gsronu33B016b09b1
gtgcattggagtttctatcaacctgcaagctgacaaacttaacggtgaaggcggagctaggttgctgcttgcttcataggagtggaaggctaattatagatgaatgcatacttcagtgtgaatcaaacccgttggactatctgtcatgcccgatcatgagtacagccggaagtggggtgtttccctccaacctgaagagtgatggtgatagcatttctgtatcgcacactcggattgaaggaggtgcaaaggcttttttgacgagtggagatctagcactacagcaagttcgagtcatttatgctcgaacttgtctctatttctggttcgacgttggttgtagataattggattagggaattcaatttaattcctgaatgttgttttgttttctgtaggaacaatatctaatgtagccatagccatagccatagccaaaggcattgtatgttatcagaccatttgcaacaaacgttccttttctattt

SEQ ID NO: 445 - DNA, 461 bp, Gossypium hirsutum
  Clone ID: uC-gsronu33B016b10b1
ttgaattccttcaaagaatgctagtttgatatttccttgttttcttaatgttatgatggtcctaagccttcgattttcaactaaaaaaaatgaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaggggggcgcccgtttaaaaaaaacaaagttaaatccccggtaaaaaaagcaaaaaattttttttaaggggcaccaaaaaaaaaacaccgggccaactattaaaaaaatcggaaaatgaaaaaacttggaggccaccaaaaaaaattctttgggaaaaaaaaccttttttcaaaaggggggttaaaaaaaaaaaaaccccaaagaaaaac

SEQ ID NO: 446 - DNA, 304 bp, Gossypium hirsutum
  Clone ID: uC-gsronu33B016b11b1
tccatcacgacgaccaaaaagggagcaatccctgcactaccaaccgaggccgatgcccttgccttaatcaatggagcttagattttaagcaacttgaataatttgcacattgttttgcctcccgtgattatcctttcatttcaaagagttctcaatttattcccctttgatatgcgacctttgttcccccaacgcccaattgcttgtgttctaatgatggaaaagactttgtggttttaagcgtgtaggaaattcttttccctcttttataattttgcaatgtgattatcgaacttgttctgtc

SEQ ID NO: 447 - DNA, 497 bp, Gossypium hirsutum
  Clone ID: uC-gsronu33B016c01b1
gaaaatatcacaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagttcttcatttgcacggctaagactgagtggctcgacggaagcacgttgtgtttggacaagttgttgaaggctggatgtggtgaaagcca

SEQ ID NO: 448 - DNA, 449 bp, Gossypium hirsutum
  Clone ID: uC-gsronu33B016c02b1
actttttgagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaaggctataactatgtctctgtctgtgtcttgtgtaatagaagctttgtttgcggcgaaaataatgta

SEQ ID NO: 449 - DNA, 439 bp, Gossypium hirsutum
  Clone ID: uC-gsronu33B016c04b1
gatttatggatgatcattatccagttcgaagtgctttttcgcttctcaaccagattctagatgaatatcagaaaaattttggggagtcttggagaaatgcacaagctgatagcactcaaccttggccgtatctgaatgatgctttgaccaaatttcaggaccctgcagaggcggataaattattgaaaattcagagggagttggatgaaactaaaatcatccttcataaaactattgatagtgtgcttgcacgaggtgagaggctggacagtttagttgagaagagttcagatctgagtgctgcgtctcagatgttctacaagcaggctaagaaaaccaatcaatgttgtaccatactgtaaacttgcaagagaaagcaacaatgttgtgatatgggattcgcttatgttggccttaaagctgatgatgattgatgact

SEQ ID NO: 450 - DNA, 552 bp, Gossypium hirsutum
  Clone ID: uC-gsronu33B016c05b1
cccacgcgtccgaaaaaattaagaacatgggtgtcactatcaatgctgagattgagtttccagccattgagtttcgttcatcagatttgaagcgaggaaccgatggatggcgccatttgtgcaaaaaggttcaagaggcttgtgagaaattcggttgttttgaggtggtgtatgatacgatatcgacgaaagttcgagaagagacttttgggttgatgaaagaattggttgaggtcccggtggaacggaaacaaaagaacactagtcccatgccttaccatggctgggttggaccatgcgagcaagtttctttgttgtatgaaggcttcggaattggaaatgcctccaactatgattgtgttaaaagttttactcaacttatgtggcctgaaggtcacccacacttttgcgacactatatataccatgggaacacaaatggaggagctaaacaagctaatctggttaatgctaattgatcgctatggattaggagatgactcactgaagttgaactacacaacattggtgcggatgatgaaatacatggctc

SEQ ID NO: 451 - DNA, 572 bp, Gossypium hirsutum
  unsure (1)..(572): unsure at all n locations
  Clone ID: uC-gsronu33B016c06b1
cttttccatctaagccgccaacttatcctaaaccacaaaggagcctagtggctgttcagggcgttgttttttgcaagtcatgcaaatacgctggatctgacaccctgttgggagcgacgcctattttgggtgccactgtaaagctgacatgcaagaacaccaaatacaagcaagaggccactgcgaaaactgacaagaatggctatttcttcctgcaagcaccaaagaccgtcaccagctttggagcccacaaatgcacagtgtctctagtatcatcgccaatggctaaatgcagcaaaccatctaatctccatggtggattgaagggggctaccttgaggcccgagaagccatttactgcgaacaagcttccgtttattctctacaccgttgggccatttgctttcgaacccaaatgctactagaaacttagattccactcttttcctttgttgctcttaatgtgttaccagtgcttacaagttccncagcttattgtaatcgcatttttgtcagtgtattgctttgtgtgaaaatagattacagacgaataatcaatcgatttctacttt

SEQ ID NO: 452 - DNA, 545 bp, Gossypium hirsutum
  Clone ID: uC-gsronu33B016c08b1
gtgaccagggtcatatgtttggttatgccactgatgaaacccctgaattcatgcctcttagccatgtccttgcaactaagctcggtgcacgtcttactgatgttaggaagaatggcacctgcccctggctaaggcctgatggtaaaacccaggtcactgttgagtactacaatgacaatggtgccatggttccagttcgtgtgcacactgtcctcatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaattggtggtcctcacggtgatgcaggtctcaccggacgtaagatcattattgacacttatggcggctggggagcccacggtggtggtgctttctctggaaaggaccccaccaggtggacaggagtggtgcttacattgttaggcaggctgccaagagcattgtagcaaatggacttgcccgcagatgca

SEQ ID NO: 453 - DNA, 333 bp, Gossypium hirsutum
  Clone ID: uC-gsronu33B016c09b1
cccactcgtccgcttcaccgtatgctaaatgaggatgagctgagggatgctgtgctgcttgtatttgcaaacaagcaagatctaccaaatgctatgaatgctgctgagatcactgataaacttggtcttcattccctccgtcagcgccactggtatattcagagtacatgcgctacctctggtgaagggttgtatgagggtctggactggctctccaacaacatagctaacaaggcttgaggcggttggtagaaggtcggtgacatttacatttggggtagcaatctttgtggaattcggatatgtatatttctattttatgatacgttgcgt

SEQ ID NO: 454 - DNA, 562 bp, Gossypium hirsutum
  unsure (1)..(562): unsure at all n locations
  Clone ID: uC-gsronu33B016c11b1
aaacccctccattcattatttacgttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttcaactcatcattcccccgcccaactctttcaannatccgtggtaatggtgtggagttcctaaatcgtcacctttcggcaaattggtccatgacaaggagagcatg

SEQ ID NO: 455 - DNA, 442 bp, Gossypium hirsutum
  Clone ID: uC-gsronu33B016c12b1
tttcctaaccgttgattattccggtggcatctccacgtatccactcttggttttgcaggtcacatatttcaaatgtggtggagcatcactaggtgttggcatgcaacatcatgcagcagatggatattctggtcttcacttcatcaacacatggtctgatatggctcgtggtcttgaccttacaattccaccattcattgatcggacccttcttcgtgcccgggaccccccacaacctgtgtttcaccacatcgaatatcaaccaccaccggcaatgaagattccacccgtgtccaccggttctgaaagcacagaagtctccattttcaaattgacccgggatcaactcaatgcactcaaagcaaagtgcacggaagatggtaacgatgttaactatagttcatacgagatgttgtcaggtcatgtgtggagatcaatctgc

SEQ ID NO: 456 - DNA, 198 bp, Gossypium hirsutum
  Clone ID: uC-gsronu33B016d02b1
gaaagggcctggtaacactgcagtttggtgaagcgttagattcttggaagaacttgaccactaatagagagatagaacgggactcactggaaaagtcgaaagaactttgtagtcactctccaagcttttccctaaaaacaaagggcgggggacaccaattgcactggtctgcggaacaccagaaaccgcacccccgga

SEQ ID NO: 457 - DNA, 567 bp, Gossypium hirsutum
  Clone ID: uC-gsronu33B016d03b1
caattatcttaaagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatacttctcaagtatctcaccggaggattgaacactccgggtcacacattagcaagtggaatggggttccttcaggtgttatatgggagattattctcacattcgcattgctgttacagtgtatgccaccatagtagaccccaagaaggttccatcgatggct

SEQ ID NO: 458 - DNA, 155 bp, Gossypium hirsutum
  Clone ID: uC-gsronu33B016d04b1
cccacgcgttcgtgtgaaggagctttgtgtctgtaaacagaatagaatgttgttttccagtttatctcatcatgtttgtgattggattgatgctattgggatggtttatttaatgtaataaatatttcaccatgaaatcctagttatttttactt

SEQ ID NO: 459 - DNA, 541 bp, Gossypium hirsutum
  Clone ID: uC-gsronu33B016d07b1
gcattatggaaaggctaaagtctcaaagcagctagttgaagcgatagatcctagtaagaacttgatcactttcagagagatagaaggagatcaactgaaagagtataagagctttgtagccacgcttcaagcttcgcctaagaacaagggtagtggcagcatagtgcactggactgtggaatacgagaaactgcaccacgggattgcacatcccgagactctgttgcaattcttggtggatgcctccaaggacattgacgctcacctcacccaaccaaactaaaggatcgattaagaacatccgatgtccgtactgctcactactactacctgaagcagtactaatctaattaagaataaattgacagctaccttacttctttgtttcaattcgaatatgtatacacgtttggatcaatatgctgtcaaggagagggagctttattttcttagtatttggtggttaattatgtaccaggatgaatgtatgaaccatgtgccttgtgtgttataatttgcaatataaaagtatggtttgggt

SEQ ID NO: 460 - DNA, 408 bp, Gossypium hirsutum
  Clone ID: uC-gsronu33B016d08b1
gtcaattcatggtggctgctgaacctgcagatttcgttcacgtgtatagtacgcgtgctgattacgagaaaagacaagagattgacttctttggggagatttcgggagtatctctgagtccagacgatgaatctttgtatataggaatatgggacagaacgtatgcaagtttgctgcaatacaacaaaagacacacatatgcatacttggattcgtacttgtgataatgtcaactgcgtgctgttgtagttatggcgctctcttttgtgctctgttttgtttgtgtagggtgatatgaatgaagattaaatattatatgacagtataataagtgtatgttgtgttagaacttttctagaaaggtgcatgtacagtacaatatcatcctctaaatcatatgctatttgt

SEQ ID NO: 461 - DNA, 530 bp, Gossypium hirsutum
  Clone ID: uC-gsronu33B016d10b1
cccacgcgtccgcccacgcgtccgtcatgctcgaatatgttcaatcatcaggagatctggtaaagatgtggaggagctgaagaatgggacattagtattggagcataaggatgagcgcgatttggggctccatttgctgcagtttgctgaggttgttgaggaggcttgtaccaatttgttaccgaatgttgtgtgtgactacctctatagtttatccgaaatcttctccaaattttacagcaaccctgagtgcaaggttatcgggtcagataaggaaacaagtagactactattatgtgaagcaactgcagcggttatgagaaaatgcttcaatctcctgggaatcacacctatttacaagatatgattgtactttgaaagctttacatataaccttttcttgagcagggtgggttttatattaggtcatataaaattctatgtaccatttacaattgtattcagatctcattactttatttatttggacaggtctgattgcaattatgtatttagctatgaatttattc

SEQ ID NO: 462 - DNA, 537 bp, Gossypium hirsutum
  Clone ID: uC-gsronu33B016d11b1
tagtgtacaagcaactcaatgatgagaagcagtctatgatcaaagaactgaattcgtatgtagctatgaggaaaacatacatgaatacccttggtaacaagaaaattgaactctttgatatgggagctggagtcagtgaacctacagctgatgaaaatgttaaaatggcatcatcaatgtcaaaccaagagcttgttgatcatgggatgaagacaatggatgagactgatcaggccattgaacgctcaaaaaaggttgttgaacaaacaattgaagtaggaactcaaactgctggtactctaaaaggacaaactgatcaaatgggccgtattgtaaatgagctggatacaattcagttttcaattaagaaggccttccaacttgtgaaggagaatggtaggcaaggagccactgataaatgcatcatgctatttctttttcttatcgtatgcggggttatagccatcatagttgtgaagattgtgaatccgaacacaaagattttagagatattccagattggcacctccagcacct

SEQ ID NO: 463 - DNA, 425 bp, Gossypium hirsutum
  Clone ID: uC-gsronu33B016d12b1
tagggtttcaagctgatatagctgtatttaatcagatgggggaaatattgtgtgaaacttatcatactgagaaagcaaagatgcttatgaacataatgattaaaaggggtatatgcccgaagatggtaagcttcacatctgcaatcagctaatagtgcaggagtggggatgctgcgtcatgagactcataatgttactcagtgacttggaacttatttgatttggctgagcatttttgtatcagatgcatctaagtgctccaacgccaatatatacaatgttaacgtatgattcgcgtcttgaattgacatcctagatgatgtagttcacccgcctaattgtttatgcaataagatttgaatttcaatttcctcctaatataatggacaagcagaattcaccaatttattgcgtttaagtgcttg

SEQ ID NO: 464 - DNA, 538 bp, Gossypium hirsutum
  Clone ID: uC-gsronu33B016e02b1
ggcgtagatcttaggactttggtcattaaagaggctgttcgtgttactgaagcttttactctatgcacatttgttgatacatacaactccgtaccttcttttatgcgtagtctaatattcaatggaaatggagcgctggcgatgagcagtgctgaattgcaaagcatgatggagctccgggaccaagtctttcgaatctgggggcttctacggtcgtcagaaaactttgatccagcacttttgcagcctattttacaaatccttcaacaacccgaggcacgcagtctaggtggccgtgtagttggtgggatcactcagcgtctggcagctcgcttactgcaacaagttcttcgaatgccaatggctcctacttcaagtttatcagcattggacactcggtgagcaaacctgaaaatagacaaccattctttttttctcctgttagttattcaactaaaaggaataacattagagagattatagcaaaaagaatacccctttggggagtgtatcatctcatcgaatgaaaacagaagct

SEQ ID NO: 465 - DNA, 515 bp, Gossypium hirsutum
  Clone ID: uC-gsronu33B016e03b1
agttattggtggacgtgagataagaattgtttttgctgaggagaatagaaagactccccaagaaatgcgtctgactgcccgtgtaagtggtcgagataggggaagcaggagaacaccgcctaggtccccaagacgccgatatcgctcttactcttgctcaccttcacctgctgggcatgattcaagagacagggatcagagggggaaagattatcaccactcccctaggcggtctagatcaatttctcaggatcgtggtatgagagatgattatcgctctcccagtcggtccagatccatgtcaagggattgtggggcaaaagatgattatcgctctcccaggcgatctagatctgtttctcggtctctttctccacgttctccacatggtgacagggacagggaatacagaaccaagcagaggtcccctagtcctagggagaatggtcagagtctacaagatgagagagatcatgtgagcagcaagtcaaagagcccaaggcgtgtcaatcgca

SEQ ID NO: 466 - DNA, 527 bp, Gossypium hirsutum
  unsure (1)..(527): unsure at all n locations
  Clone ID: uC-gsronu33B016e05b1
cttttgcacccaccctgtttctatctcggctctgacgagaagccggcgccgacatggttcacgtcagtttctaccgcaactatgggaagacctttaagaagcctaggcgtccttatgaaaaggaacgattggatgcagagttgagacttgtaggagagtatggactccgatgtaagagggagttgtggagggttcagtatgctttgagccgtatccgtaatgctgctagggatcttctcactcttgatgagaagaaccctcggcgtatttttgaaggtgaagcacttcttcgtaggatgaataggtatggacttttggatgagagccaaaacaagcttgattacgtcttggctttgactgttgagaactttcttgagcgtcgtttgcaaacactagtattcaagactgggatggccaagtcgattcaccatgctcgtgtgttgattaggcaaaggcacattaaggctggtatgcaagtggtcacatcccatctttatggtgagggntgactcttaaaactattgact

SEQ ID NO: 467 - DNA, 520 bp, Gossypium hirsutum
  Clone ID: uC-gsronu33B016e09b1
cccacgcgtccgtgtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaagagtcaactctccaccttgtccttcgtttgcgcggcgggatgcaa

SEQ ID NO: 468 - DNA, 389 bp, Gossypium hirsutum
  Clone ID: uC-gsronu33B016e11b1
tcttccttgcgtgcgtccacgcggacgctttttggaagacaccacaaagccatcctccaatcctcaaaacccaaactcttcgtcatgggaactcgggatggatttaccagagtcaagcaactaaacaagagatttagttccgcagccgggcgcaatgaaatatatttaatggaaggagttagccactttgaaacggaaggccctgcttatgatgctgagatggtgaagcttattcttaagttcatttcctcattgtaagacatgtagccacttctttaaaaagattagtgctcgatgaattgctattaaaattacttccttaagctctgctgttgtttggggaaaaagatgccaattttatgtgataatatacaatgttatcatgtgcc

SEQ ID NO: 469 - DNA, 547 bp, Gossypium hirsutum
  Clone ID: uC-gsronu33B016e12b1
ttccactcgtccgcctcttctctcccgaaggaaggaaatcggggaaaaatgaaaatggaaggaatcgaaggcgacgcctcggtgggaggagcatggcgttacattttgaatcctacgcgaataaacagcgaggacataatattttgcgttgatgtggacgcagagtcgcttgttgaaatgaaaacagcaggagtcaccagattggattccataaagcaagctatccttctctttgtcaattccaagctctctatcaaccccgaccaccgcttcgctttcgccactctctccaaaaccgcctcttggcttagaaaagagtttagtagtgatgttgagtctaccattggtgctgatcgagcactctcggctaccactgtctctactgggcaagcagacctcaccaatttattccgcttagctgctcatgaagccaagaaatctcgtgcccagaaccgcattttaagagtgattcttatatactgcagatcatcaatacgaccccataatcaatggcctgaaaccaaaagctcttcactcggatgtgatg

SEQ ID NO: 470 - DNA, 419 bp, Gossypium hirsutum
  Clone ID: uC-gsronu33B016f01b1
gagattcatagcttactattctacatatatgacccccacccttaccctcaccaacgctttcaattttactattttgcatttttattccttgttctctttcttaccaaagaaaaaaaattcttttttttttcttcggtaaagaaaagtattttatttaaatttctggggtttttgattcttacccatttcaggttttccatagacttgcaataaaggaccttgaggaattaaccaagcatatgattttactcttttgatgcgtgaagatggattacaaagtgcaagtcggagtccaatcccaccttgaaatgggacccctagatgataggacaatggaagatctcgatgacgagtgtctctttccctctgaaatggatgctcaaaagacacaatctgttgatccaaatcaacatatttca

SEQ ID NO: 471 - DNA, 576 bp, Gossypium hirsutum
  unsure (1)..(576): unsure at all n locations
  Clone ID: uC-gsronu33B016f02b1
ggaaatgatgcttatggccctattccatgtggtgaccttgctcttcctcttgaagcttacgagtcagcttttagtcgagttgctctcctccaacagcggtctcccgtcgttaagggacgaatggttgaatttgccaaaaacttggcaaattttgctgctgcaagtggaaagaagcatgttgttctgctttccagcttggattttggaaagtggcagaaaattgacatgtcaagtggtccgcagatttattacctatccagcataaatcccgatggaagagatgacaactgtgaacaacttggatggaaaaggctgcaagaatacaatcctgctcaaagatgttggaagtaccttagcaccttagctgaaggaaatactatgctggaaagcaatttaccttttgaagatgagctggaagatgaagattattaccctagtttgccatttgcagcacttttttcttgtttgaaggccaaaggcttgaaggttacgtctttactatgctactgttcagaaggggataatatacaggatgcttttcatttggctgnagcagcatgcagacttttggggcct

SEQ ID NO: 472 - DNA, 500 bp, Gossypium hirsutum
  Clone ID: uC-gsronu33B016f05b1
gcttctttctatctatatccttatcagctttcaaagatggcaggaatcgcctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccatgtcaaccctgcagtaacttttgggttagctcttggtggccaaatcaccatactcactggcatcttttactggattgcccaacttcttggatccattgttgcttgcttcttgctcaaggctgtcactggtggtttgacagttcctatccacggtcttggagctggagttggagctattcaaggagtggtgatggagatcatcatcacatttgcattggttta

SEQ ID NO: 473 - DNA, 270 bp, Gossypium hirsutum
  unsure (1)..(270): unsure at all n locations
  Clone ID: uC-gsronu33B016f08b1
ttaattttaaataaaaaaaaacaaaaaaaaaaaaggacgaccagatatagagagtaacaagattaacgttacggtgcgggcgggcttgcggttctcttgtctagtgccccctactttccgnttggctgggccgccatttgccctctcccttggctggttaccccctggttggtccccgcgttctggcctgggagtaccttcccctttccccagttggcgtcatagtggtttggcccgttccgctcgccctccctatcggttgctcggcct

SEQ ID NO: 474 - DNA, 541 bp, Gossypium hirsutum
  Clone ID: uC-gsronu33B016f09b1
cccattccccactgtcgccgttctcaaacgaaccaacctccggcgttcgaaggcgcttcgggtcttagcctttcgccagcctcccgatttggagcggtgcgagtgtaggtttcaacggggaagcttcaaaggttcggtggccgtggagtgcgcccgtacgtggaggccgaaacgtgctgcgattgggcgttgggcgctgcgtgggtgctgttgcggcgctgaggcagatgcggctctccttactgcttagggttttttctgtgtaattttgatgtgttgggctgttagctgctaggtttaggggttattgggccacttatttgttgggccttagacgagtttaggcctgctgaaattgcctgctttgtttttgtttgggcccaggcaatttgggcttgtacacaggcaattaaaattcaagacacgtactagataaatctgtgataagtttaatacttctagatccaaatattccatgaactaaacaatctaatgttttaagggctgcatgggaaaaaaaaaaaaaaaaaagaaaagggcg

SEQ ID NO: 475 - DNA, 519 bp, Gossypium hirsutum
  Clone ID: uC-gsronu33B016f12b1
ccctcgcgtccgcccacgcgttcgtgaacatcggaagtgatgagatggttagcatgaacgagatggcggacattgtgcttagctttgaagataaaaagcttacgatccaccatatccctggtccagagggtgtccgtggtcgtaattcagacaatacattgatcaaagaaaaacttggttgggcccctacaatgaggttgaaggatgggctgagaattacatatttctggatcaaggaacagattgagaatgagaaggctcaaggcattgatctatctgtctatggatcatctaaggtggtaggaacccaagcaccggtccagctcgggtcacttcgtgctgctgacggtaaagaatgaattaaacttgctttggaaccaagttttattatgatatagctatgctaatggcattgaatccaaaaagtatcaaccaatatcagtttaagattatttatttctgtcggatttagtttgtgactatgatctttgtccaagggaagcttttatgttttcactc

SEQ ID NO: 476 - DNA, 502 bp, Gossypium hirsutum
  Clone ID: uC-gsronu33B016g01b1
gtgagtatatcttctaatctgttaagctcttgttttgcatctacattaattctgttacactagtgaaggaaccattgaattgtgtaattctttttgacataactaatctataacagctaaatttacaaggaaaaagacctttgaggaaatataaatctcccactgctgagttgtttttggttttggtgtgtcttattgttgtcattcttgcaattgtctgtcctaactcttaggtctttcaccatcacaacagagaatgactttctaagaaggttttgttaagtgaatttagggaatatcactgctattttcaccttgctcccccaatgtgtactatacaatcgaatatgatgatgtggtttgatttactagtgaagttacttgtgcatgtgtcttgttacaggataatcattcctaggcactgtaatgaatattttacttaataagttccctctttttcttatatataaaaaatacaaatttaactatttaattatagaat

SEQ ID NO: 477 - DNA, 329 bp, Gossypium hirsutum
  unsure (1)..(329): unsure at all n locations
  Clone ID: uC-gsronu33B016g02b1
attttttgctaacttacataacccacacaaagaagacggagaaggtggccagaaattcggattctgtcatcgggggaatcggcatttaagggtttttgatcgtttcatttttcttcatcatcgtgaagtgcaccattggcatccactcttgtatgggaacgggatttcagttcctccgaggagttgattacagaattttgtcgagaatgcaggatagttaacaaagggctgaggggggacctttgggaaataagcgtatagaagcattgcgtcttgtcaaagcgggggtgattcacttaaatctagatccacgatggtacgccnnanna

SEQ ID NO: 478 - DNA, 266 bp, Gossypium hirsutum
  Clone ID: uC-gsronu33B016g03b1
aaaacaaaaaaaaaaaaaaaaaaagaaaaaaaaaattaaaaaaattaaaaatatataataaaaaaaaaaaaaaaataacggtgttttggctttcctgggcccgctctttttggggggcccttttttaggtctccgtcttttcttcgcggccgttttccatttttctcctttttgtttttcccccgttttcctttttgggccccttttttttctgcttgctttgggggtttccccccttttccccctttgccccttgtgcccttttt

SEQ ID NO: 479 - DNA, 264 bp, Gossypium hirsutum
  Clone ID: uC-gsronu33B016g06b1
tgcattttgagaagagccggcctattagcaagaccaagactttcattgcggtggctgtaccaagtaggaatgggaagcaggagaaggaggaggcaggggagcttgggattccattggagtctaaacagactcaagagcagccgcaggcttagtgttaagcccttcgcgtgggctccttttgttgttggtaaatttgtgatcttttgcaagggatttcactgtttcaaaaactgcttttccttaatgtaataattgtcgtttttc

SEQ ID NO: 480 - DNA, 499 bp, Gossypium hirsutum
  Clone ID: uC-gsronu33B016g07b1
ttccactcgtccgcccacgcgtccgcggacgcgtggggaagtatttcaaggacccggcttcgtggacgagaaagaatagaagaaagggcatgcccgacccgagctactaggccagggcctgaggagaggaactatttcaagcaaggatgctatgacctcagacttgagaccgattcaaagatataggaatgaatgaatccaatgtcatctataccgtgtttttgggctgtcataatgtgacagtttcgacttctgtcgcctctgtctattccgtttagggaatgggcttattcattccgatttctgtaaatacttctgtgtaaatatctcccccagcctcggtctaaaaagctcatgccttcttgcttgctgagcccggtgcgaagcccgttcgttcctttctttctttgtcgggtcaaggagaatcgcttggttggtttcttagcttgcttattccacttttttagtgggaggactttcatcagtgcagcatgtgggc

SEQ ID NO: 481 - DNA, 485 bp, Gossypium hirsutum
  Clone ID: uC-gsronu33B016g08b1
tccactcgtccgcggacgcgtgggtttttgagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgggtcttgtgtaatagaagctttgtttggggtgaaaataatgtataagccatttggtt

SEQ ID NO: 482 - DNA, 413 bp, Gossypium hirsutum
  Clone ID: uC-gsronu33B016g09b1
ttggtgagggagcttatagttactatgggaagaaaccagaaatgaacgggctgatgcaaaaggcgatgtcgggagtttcagtgccattcatgagagcaatattggacggctatgatgggttgaaaggcgtgaagagattagttgatgtgggaggcagcgcgggggattgcctccgaatgattttgcagaaatatccccatgttgagggaatcaactttgatttgcctgaggtcgttgccaaagcacctagtattccgggcgtgactcacgttgggggtgacatgtttgagtcgattccagtagctgatgcaatcttcatgaagtgggtgttgacaacatggacagatgatgaatgtaaggcgataatggagaactgctacaggcacttcctgtgggagggaaattgatagcat

SEQ ID NO: 483 - DNA, 541 bp, Gossypium hirsutum
  Clone ID: uC-gsronu33B016g10b1
gagagacagtcacattggatatatttatattatcctcacccactacaatagaagaagagaaagaaaaagaaatgaagcctataatcgctactttgttgtgtgtttccctagttttgtgttcatcatttattcaactctcctttgcctgacctgctgctgctccttcacctgctcctccaagttactgtgatgggaagtgcggagagaggtgcgccaaggctggaatgaaagatcggtgcttgaagtattgtgggatatgctgccaagaatgtaagtgtgttccttcagggacctatgggaacaagtcagaatgcccttgctatcgagacaagaagaactccaaacaccagctccaagtgcccttgaactttaaactcttttggatcttttaaccttcatatatatatagatatattcgcatgtacgatttacctatttagcctgcaactctttatcgccttaagcttcttcttattataattcttttgccattacactatcacttctgttctgtttattgatgactgcttctggcacattt

SEQ ID NO: 484 - DNA, 502 bp, Gossypium hirsutum
  Clone ID: uC-gsronu33B016g11b1
tgcatctcgcacgctctcatcattttcctccgggaccgtcagtctccccaaacaccttctttccgagaaaaagaaaagctcaagagagaagaccatggccgatcaacttacggacgatcagatctctgagttcaaggaggctttcagcctttttgacaaggatggcgatggttgcattactaccaaggagctggggactgtgatgcgatcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagatgaggaagttgatgagatgatccgtgaagctgatgttgatggtgatgggcag

SEQ ID NO: 485 - DNA, 87 bp, Gossypium hirsutum
  Clone ID: uC-gsronu33B016h02b1
gttctagaatgcagagcggcgcccttcctctagatttttttaagtctcttttcgcatgctttcgtcgtctagcaaccctatcgggaa

SEQ ID NO: 486 - DNA, 505 bp, Gossypium hirsutum
  Clone ID: uC-gsronu33B016h05b1
cacacactttgaggcgacgaactctgaggcggaaaagttacacaaagatggagcaaacattcatcatgatcaagcctgatggcgtccagaggggtttggtaatgtttcttcttctttctctcttgcaattttcgggttttttttcagctgtattattcttttatccgatagtttgattctcttaactgctagaaattacaaataaaaaacgataaagaatctgtagtccttagtgaactcttgtagttaagctcgtagatctaatgtcttgaggcagggaatattggttcaacttagctaggcttcacagaatgagtactgttgtttctgtttctttttgaaatctattcttttgcatgctaaggctataaaatcaaagacttcgagagatgaattcttaaaaaaaaaagtatttatttgggacatatgaaaggctctcacgtttttctgatttagcaccttattttgttggattgtgggttcgaaatgagatacttgtgtttct

SEQ ID NO: 487 - DNA, 461 bp, Gossypium hirsutum
  Clone ID: uC-gsronu33B016h10b1
ttcatttgaaatcgcagggcttttttaacctctgcatctctatttagaaccctgagtattctttcataatgtctgataatatggcatctgaagccagacttctccttcaaacacagatcaaagatcatcgtaagaatccgggggatgggttctcggacgaatcgatggacgaaaacaacaactctgaatggagtgttacagaaataggaccacctgatactgtgtatgaaaggcgattgttcaatgacatgatgagcatgacgcccaaacatccaaacaggcatccaacagagagaatgacatcagaaaatttggcatcctaatagatatactgacggacgtggacgcatatcaattcttgatactccaggtgatgatccaaatggccaccagcttgcatgggagcgctggatgccagtccatacagtcaaaaggatagcattgagtttcatatcaatgct

SEQ ID NO: 488 - DNA, 619 bp, Gossypium hirsutum
  Clone ID: uC-gsronu33B016h11b1
ctccattcgtccgcccacgcgtccggtggctcatgcatttgccctcttcgttggggtgtccattgcagccaacatctcaggtggtcatttgaatcccgccgtcacctttgggttagctgttggaggcaacatcaccatcttaactactattttctactggattgctcaatgctttggctccatcgttgcttgccttcttctccagtttgtcaccaatggcttgagcgtcccagcccacggcgttgcttcaggaatgacggctgtggaaggcatggtgatggagattgtgattacatttgcactcgtctacaccgtttatgccacggcagctgacccaaagaagggttctctcggaacaattgcacctattgcaattggtttcattgtcggtgctaacattttagccgctggtccattcagtggtggttcaatgaacccagcccgttcttttggaccagctgtggttagtgggaacttgtctggaactggatctattgggttggcccattgattggaggagggctagctgggctgattatgttgacctctcattgggtctactcctcatacccagttctggagatatgcttaaaagtgttttgtgtcagggttcggtttt

SEQ ID NO: 489 - DNA, 232 bp, Gossypium hirsutum
  Clone ID: uC-gsronu33B017a01b1
ccctttctttcgggtggtgtcaatatggagaacaatcagtcgacttttaagtgatttttaccctttttttgtttttttctcgtccttggctgttttttggcattttctttgcctgactctgtaacttggacgtagcatgtgatcacaatgtttgtaataagatccaagatgtctcagtttgaagttatagttcatgtgatcataatattttgggtttaaaacacatagatgc

SEQ ID NO: 490 - DNA, 163 bp, Gossypium hirsutum
  Clone ID: uC-gsronu33B017a06b1
gcttgtttttttcaatcgtccctcaagagaaactgtcacgaaaaaagacattgggtcttcccaaatcttggctttgcattgatggcggagctcatgacagcaattctcattgcgtcttaccagctcagataggaactccttcaagatcgggcggtcgatttta

SEQ ID NO: 491 - DNA, 357 bp, Gossypium hirsutum
  Clone ID: uC-gsronu33B017a08b1
tcttctcgtccggccacgtgatgtgcgttcgctgtctttacaaggatcccgccacacaagatgtcgtgtacggcagagatcaagcgcttctcgtacctcggcccaacgacgttcgatcatcggctcctaaaatcgaacagttgagattctttttcatctcgactcgagccatagccgaggcgagaaggctgatagagtgcagtaacgacttgacaagcgcttaccatttgttgggctcggctcgagccttgttgatgcagtcgaattcgcagtcggccgaagagtatgccagagggttagaagttgagttggcggaattgcattggaggaaacagcagatgatggaaattcaacgac

SEQ ID NO: 492 - DNA, 405 bp, Gossypium hirsutum
  Clone ID: uC-gsronu33B017a09b1
ttcttgataaaaaggattttgctttgcctaatttgtaagctttgaggttgactgaaaaaactatggcggaagagggacaagtaatcgcctgccacactgttgattcatggaaccagcagctcgagatgggaaaccagtccaagaaactggtggtggtggatttcacagcatcatggtgcgggccatgccgttttatatcaccaatcctggtggatcttgctaagaagctgcccaacgtcatattcttgaagggggacgtggatgaactgaatactgtggctcaggagtgggctattgaggcgatgccaacttttgtgtttctgaaagaaggcaccataattgacaaggttgtgggtgcaaggaaagaaaaaattgcagcagaaaattggcctttattaatttaac

SEQ ID NO: 493 - DNA, 151 bp, Gossypium hirsutum
  Clone ID: uC-gsronu33B017a11b1
caatcgtccctcaagagaaactgtcacgaaaaaagacattgggtcttcccaaatcttggctttgcattgatggcggagctcatgacagcaattctcattgcgtcttaccagctcaaataggaactccttcaagatcgggcggtcgatttta

SEQ ID NO: 494 - DNA, 165 bp, Gossypium hirsutum
  Clone ID: uC-gsronu33B017a12b1
cggcttgttcttttcaatcgtccctcaagagaaactgtcacgaaaaaagacattgggtcttcccaaatcttggctttgcattgatggcggagctcatgacagcaattcccattgcgacttaccagctcagataggaactacttcaagatcgggcggtcgatttta

SEQ ID NO: 495 - DNA, 114 bp, Gossypium hirsutum
  Clone ID: uC-gsronu33B017b02b1
atttgctatttggtggataatttggtgtactatgtgcactattagcaataaaagaatctattaaagtgaaaaaccaataattaaaatagaaaatcctctccttgttgggtggct

SEQ ID NO: 496 - DNA, 430 bp, Gossypium hirsutum
  Clone ID: uC-gsronu33B017b04b1
gtccttctctccttgaggctcttgaccagatcaccgagcccaagaggccctcggataagccactccgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgtttaggatcttaaacgcggttttgttgcttcaaactccaggatgatccggccaaggaagctgccaacttcacctctcaggttatcatcatgaaccaccctggccaaattggaaatggttatgccccagtccttgactgccacacctctcacatt

SEQ ID NO: 497 - DNA, 271 bp, Gossypium hirsutum
  unsure (1)..(271): unsure at all n locations
  Clone ID: uC-gsronu33B017b05b1
ngtgctccttgtacgttggacgaagactgcctacgtattgattatagcacaggcatgcgcacatcttcaagcaataccacgtttgggaaagagggtaacaaattctagctagtgcagcatgagactcaaagctccacgtgagatattatgtgcagagaggactataatgagtgcgctccattgctcaggggcctgaggaaaacaaaggatatataggaggtggaagtcagcaggcgtccgcctcgaagagggtcgggacactgaggtccca

SEQ ID NO: 498 - DNA, 261 bp, Gossypium hirsutum
  Clone ID: uC-gsronu33B017b09b1
ttctcaagctgtagtggattgacaaaaagaaaaggttgtaattacttggttaagtatcagagacatgatggaagtacaaatgatttacaccatttgatcatctaatttatcattttctattcatgatttctgttggtaactggatttaggttagttttcatgattgtagttgatccctcatttgggttttagacaatatatatataggttgtcaaaagcacattgattcagtgattgagtttccatctattggattcaaaa

SEQ ID NO: 499 - DNA, 484 bp, Gossypium hirsutum
  Clone ID: uC-gsronu33B017c01b1
gagtaatcggagaaagcaaaggaggaggtaaaggatgagaccccggaggtgcagacagaaacagttacagaggaggccaaagtagagaccgaggaacccgcggtggaagcagcggtggaggagaaaccagcggaggaggaaaagggagatgaaaaagctgaagagattcctgttgagaaagttgaagaatagagcgaccaataccatacgtaaggtggcaaaagcttaaaggagcttcttttttctataggctgtatgtcatagttggcggagtcatactactattatttatgattactatgtcggatgtgggatgatgagggctttctttttctttaaggctgtttttctgctttggggtttgatatttagtattgaacttccttttgggtccaggggtcaacatgctgatggaaagaactataggttttccattttgaagtggtttgatgtatgtatgcatgtgtgcatgcatgcacgcacg

SEQ ID NO: 500 - DNA, 457 bp, Gossypium hirsutum
  Clone ID: uC-gsronu33B017c04b1
gcttgttctttatgtcaaaaagtgcaacaaagcttggtttctgctgcttctggacatgttttggccaaggatgatgattctcctgttactattgcagactggagcgtccaagcaactgttagttggctgctttccgaattcttggagggttggagtgtgtccattgttgctgaagaagatgtccaaacactctccaagcctgaagcggctagtttactttcagctgttgtcaatactgtgaatgaatgcttagctgaagcaccaaagtatggtcttcagtgtccaaagaaagttctcgggacttcacaaatccttgaggctatcagtcggtgtaactcaactgggggcccaactggaagacattgggtgcttgaccctgttgatgggacattgggatttgtacgtggtgaccagtatgctgtagcactaggcttgattgaggatgggaagctagttc

SEQ ID NO: 501 - DNA, 360 bp, Gossypium hirsutum
  Clone ID: uC-gsronu33B017c05b1
gtttttcctaacctaagactaccaacttgacactcattctaatatgacaacccgcttaagaagaaccgcaagaagcgcggccactacagcgctggtcacggacgtatcggtaagcatattgaagcatcctggaggtcgcggaaacgccggaggcatgcaccaccacaggatcctatttgacaaatatgaccctgggtatttcggtaaagtcggtatgaggtactttcacaagctccgtaacacgttttactgacccattgtcaacattggcatgctctggccgtttgtgccacatgacgcgaatgcaaaagccaaccaggacgctgtgcctatgatcgacgtgacccattttgggtactt

SEQ ID NO: 502 - DNA, 408 bp, Gossypium hirsutum
  Clone ID: uC-gsronu33B017c08b1
ttcttctctccatactaacttgtacattaggcgagatggcttcaaaaagaacagcatcgattgccctcttctctgccctgaacggtctctgttttactctagccaagtgctagcggttcttgcccttcccccaacccaaaaccaaagcctactccttaccgatgccccttcaggcaaacgcccccaagatacccttaagttaggtgcccgcgctgaggagctcggcccagccaaagtaaccggtggctacgcccccagtgcaaccatgctgttcccttttccaaggccttgctgatcttgaagctgaaggtcgtctttgcacagtactcatagctaacgtttcgagcatgacccttaatattccagggttcccctcagcttgtttctaaacgtctgctcaaagaaaga

SEQ ID NO: 503 - DNA, 427 bp, Gossypium hirsutum
  Clone ID: uC-gsronu33B017c09b1
ttttctcgtccgaaagcattagcaaccatagccatggcttcctcaccaaaactcttctctatgcctatcctcttcctttttgccctcttctccatgcaaatccatgctagagagtacttcagcaaattcccaagagttaacatcaatgagaaagagacaacaaccagagagcaaaagcacgagaccttcgttccccagaccacccaaaagccagaagaacaagagccaaggttcattcctgaaacccaaaatggttatggcctttacggccacgagtcaggctcaagccggcccagtttcaccaccaaagaaacctatgaaccctatgtcacccctgttagattccaccctgatgagccctataacagcatccccgaatcctccaacaataaagacacttactacttacacaagaatgcctacgagt

SEQ ID NO: 504 - DNA, 178 bp, Gossypium hirsutum
  Clone ID: uC-gsronu33B017c10b1
ttctctcgtccgcccacgcgtccgcccacgcgtccgcatatttggtcatattttcagtcttagcaaagctacacgtcctgttgggatgatctgcactgtttactcatttatgtcactataaactccatttcaactgttctgcacattcaacctttagaggactttgcagttttttgtt

SEQ ID NO: 505 - DNA, 419 bp, Gossypium hirsutum
  Clone ID: uC-gsronu33B017d03b1
ccctcttttccgcccacgcgtccgggatatgctttattttaatgtcttccttaagacttgggttcgatggttgtcgtattgtacataaaggaagagagcattttcggccttagaatggatgactacttgagacagcttcttgcagttctaaaaacttctgcaatggaatatgtaatttcatttataccatatacttagacattttggttaaatttaaaaaaaaaaaaaaaaaaaaaaaaaaaaaaaaaaaaaaaaaaaaaaaaaaataaaaaaaataaaaaaaaaaaaaaaaaaaaaaaataaaaaaaaaaaaaaaataagggggggcccttttaaaggacccaagtttacttccccgggcttgcaacgaaaaagcttttttttgggggcccctaaattaaattcccgggccggggttt

SEQ ID NO: 506 - DNA, 267 bp, Gossypium hirsutum
  Clone ID: uC-gsronu33B017d05b1
gatggtcctgtgacaacgcactgcggatctgccggacgagtatttcatggatgaggcgggggatataataacggaggaagccttgccaacgtaccagaccattgatcaatacactttattggggtgagggatgacactggggctagctacaaaccctgggtaatttgtactctggctagtactgttgaggaaaacaaacatggggattttttgaagactttcttgtatttatcagagagggttgatatgcttatgatcgagaggact

SEQ ID NO: 507 - DNA, 311 bp, Gossypium hirsutum
  Clone ID: uC-gsronu33B017d06b1
gccctggtctgatcaaatttcatattagaggaggtgtttggtaagaaagcatgtccggagctcccgccagggttggtcccactgacgggaactttgcaggaaccaagcctacccccaatgtaatggtggctcaagaaggggttggaatgtcttgaccattaatgacgcggtgcacatggtaggaaataaagaatgaatcaagggtcgttatatatgagaaaaaaggcacgcatgttgagaatgtgactcttgataaacacatgaggaatgggatgatttacggtgactggcaaacaaatactttaattccc

SEQ ID NO: 508 - DNA, 571 bp, Gossypium hirsutum
  Clone ID: uC-gsronu33B017d09b1
cctactcgtccgaccacgcgtccgattccaagttacattatggattccttcgtggcagtcatcgtctatgatgttgccagtaggcagtcctttcaaaatactacaaaatggattgaagaggtacgaaccgagcgcggtagtgatgttattattgtgcttgttgggaacaaaaccgatcttgtggacaaaaggcaagtctcagttgtggaagccgaagccaaggctcgtgacctcaacgtaatgcttattgaaactagtgccaaggctggcttcaatatcaaggctctttttcggaagatcgcagccgctttacctggaatggaaacactttcatcatcaaaacaagaatacatgtgtggcgttaattttaagtttacaaacgcaaattcatttcagttgcagcatgaagcccgaggatgtgccctggtgaggaacatacatacattacacttacttacacacattatttgatccgaggtatgcatgggttttttaaccattagtgttttctgtataaaggaaaaaagaaatttgttctttccccccccttttggtagcatggcaatatttg

SEQ ID NO: 509 - DNA, 531 bp, Gossypium hirsutum
  Clone ID: uC-gsronu33B017d11b1
gttttatagtaaaagttttaagagctaagatctttaggaaaagaaggaaagcgtccaaatggcaaagcattcagctgaagttgttgttgaaggattaaagaagattctcctcaatgtccaagaagagctggatgagaaggttcaaagcaaagttgagaagcttatcgccgagctccaaggcagagagcatcatcatcgtcatcatcccccttgtgaccatgatgctcaaaggcttgacgatggctttcacttcttcaagacccacatatttgacaaacaccgagaatgtttcaatgaacttgcaaaagctcagcatccaaagttcttggtgtttgcatgctcggattcacgagtaagcccttcagtcgttttgaatttcaaaccgggagaagccttcgtcggccgcaatattgctaatatggttcctcattttgatcgggtgagacacacttgaattggtttaatcatcgagtatgcagttaaagtcttgaggtggacacatatcgatatgggacatatcgttgggtggca

SEQ ID NO: 510 - DNA, 276 bp, Gossypium hirsutum
  Clone ID: uC-gsronu33B017e04b1
aatagtcctgcggcaacttatcgaaagaggggaaatgagatatgtttcaccgacaaaggatcttgctaacaggcccatttgtatattctctgctgaatatgtgatagttatacgacacctctatactttttttttgttgacttgaattgcacgaaactataaaatgaacagagtgcagtgtgatgtatagcaattaaatcatggatttccattgtaaattgaataggggcataatcttcttattgcttttgttaaggatccatatattaaacccat

SEQ ID NO: 511 - DNA, 222 bp, Gossypium hirsutum
  Clone ID: uC-gsronu33B017e05b1
ctttgttccgcgagatacagttgccttgggagaagaaggtggcctggtgcaccacaacgtgagctgctaacacccttcttgtgagattgttaatgccttattgctcaagaaattgaagctacgcattgctatcattggtcgaacaatatatacacggtgtggaaagagaaattcagtgtccttgccgggacagtcttcgtacccaacaacaacatgtgacat

SEQ ID NO: 512 - DNA, 384 bp, Gossypium hirsutum
  Clone ID: uC-gsronu33B017e06b1
ctctagggagttgacacagatctgagggggaggaggtgaacatgactctggcaaaaacagaggcaaagtagatggatgagaaaatgccaaacacagaatacagagaggacgaagacaaaagggtgttggctacaagaagcatggcacagatcaaagcaactctgaatgcactacaaaaaagaatatggaaatgacataaacaaggactagaagggtggccctaaggatgagatccttgcactactaaggaccacagtgaagtgcttgggatatccgaaaaagcattttgagaaggtttgtaagcatatcagaaatagacgaggaacagatgaaggagctcttacaagagttgttttgcaatagggctgaggtggatctaaagat

SEQ ID NO: 513 - DNA, 177 bp, Gossypium hirsutum
  Clone ID: uC-gsronu33B017e07b1
ttctctcttactgtagatgtagtagccagttgatggattggataaaggaacaagggccaacgtagttttttgggtaagtgcaccgtggagattagaataggtaagaaccttccagtggctctaaacgcttaaagaatgaatactgtgaatagatgtttgtttagatagagaaataca

SEQ ID NO: 514 - DNA, 321 bp, Gossypium hirsutum
  Clone ID: uC-gsronu33B017e09b1
cgtccggaaatatgatagagtgcattttagtttacatcggtcatgccggtatttaggtcggaaatgcttgctgggaactttactgtctagagcatggcattcagcctgatggtccaatgccaagtgataagactgctgttggaggagacgatgctttcaacaccttttttcagcgaaactggtgccgggaagcacgtccctcgcgccatctttgttgatctggagcctactgttatcgatgaagtgaggactggtacgtaccgtcagttttttcaccctggacaacctcatcgtggcaaagaagatggctgccaacaattt

SEQ ID NO: 515 - DNA, 461 bp, Gossypium hirsutum
  Clone ID: uC-gsronu33B017e11b1
ccctcgcgtccgcccacgcgtccgattctctctcccaaaactctcattctctcgctctctctctctctctctctttcttcacaagaaaagtttttctctcgtgaatccatgtcggaggaaaagggtcggccattgccaaaatttggtgaatgggatgtcaacgatcctgcatctgctgagggattcactgtgatctttaataaggcaagggacgagaagaaaacaggtggcaagcctgagtcaccggcaaagtctgattctaatgttaagcctggagctgatcctggcaaaacccaacctaaaaaatggttttgctgcgttcaagccccgcctgcggaatcttgacgacgccctactcgtataagacataagagcttccacaagtatattgaagccccaccatatattcctaaacaagatagggtctgtaaggcttgataagcccttctggatttttcttt

SEQ ID NO: 516 - DNA, 423 bp, Gossypium hirsutum
  Clone ID: uC-gsronu33B017f02b1
catccctattctttggaagagcttaaagtaataactgaagatgctattgaagttgataacgagcgaagttatgttagggtcacatttactcctacggttgaacattgtagtatggctacggttattggtctttgcttgagagtcaaacttatgaggagtcttccttctcgctacaagatggatataagggttgcacctggaactcatgcaactgaagctgcagttaataaacaactgaatgataaagaacgtgttgcagctgcgctagaaaaccctaaccttttggatatggttgatgaatgtctggctccatcctatgcttgaattttttattattaccagacgtggtgaactagatttgtttttcttcatacaataaactttactttggctctttggatatttcattttattcgtatgaac

SEQ ID NO: 517 - DNA, 271 bp, Gossypium hirsutum
  Clone ID: uC-gsronu33B017f03b1
ccctctcttccgaagaaggcaaggcgtggaagaaaatgttctgaccctagacatatgatatttctgtaaagggaaaagtaggaagttgcagatcatctaatttgtgttgttattgttgttgaggtgtgtgttcgtttgtgaaccctgttcatcgacttttaattattccccctcatttagtgcaacattagtcaagcatccttgttcgcttggtttttgcttgagtgttattattattattatgaatttgatattagtagtagtgtatttg

SEQ ID NO: 518 - DNA, 169 bp, Gossypium hirsutum
  Clone ID: uC-gsronu33B017f07b1
ttctattctttgatagaggtgatgaacttgagccttatgctgaattcagttgattactatcagatttcaaagctaagtatgattgcagttgtttgtgtgatggaatggatactacacagcatacactatttggacaaagtcaagattttctgtcctatgtctgttggtg

SEQ ID NO: 519 - DNA, 70 bp, Gossypium hirsutum
  Clone ID: uC-gsronu33B017f08b1
ttttttgcgtacgatggaaaggcggggaagaagatgtttttcttattttaaagctatatttgtgtcgggg

SEQ ID NO: 520 - DNA, 415 bp, Gossypium hirsutum
  Clone ID: uC-gsronu33B017f09b1
tttctctgttgcgttgggtataatctaagctcaagattcgtatatgtcagaaagaggaaagggtggcacgggactgggcaagggcggagcaaagcgccatcgtaaggttcttcgtgataatattcagggtatcacatagtcgtcaattctgcgtttggctcgtagaggaggcgttaagcgtctcagcggtctaatctactaggaaacccgtggggttctgaagatcttcttggagaacgtgattcgcgatgcagtaacctacaccgatcatgcgatgaggaagactgtgactgctatgtatgtggtttatgcactgaataggcagggcaggacattgtatgggtttggtggttagatgaattatggattaaatggttctgcttttacaacggttcttgactagttctcatgattt

SEQ ID NO: 521 - DNA, 483 bp, Gossypium hirsutum
  Clone ID: uC-gsronu33B017f11b1
aaattttattgtacttggtttttcttttttacttctattattattttgctgctgagttttgttttttatgaaggagaaacagttatgtttatgggttgaaagaagaagtagatgaacatgcttttttctctgaaccttccggtacaatgaggagtttctcaggttcatctgtggatgattcatggcaacttgcaccactaacaatgagctcctcttcctcaaagcagaggaactgttctggattacagagtgaatactcttacttgcagcttcaaagcctcactgatcacaacccgaaacaaaacaaacaggatgctgatgaacattcctatatcaaatatgaaatgactgatgaattggagaaaggcgaaccccaaaagacagtccatcgtttctttgatgaatggccaccaaaacatagagattcatggcttggattggatgataaatcatcaaacaagttatcagtttcaacaaccagac

SEQ ID NO: 522 - DNA, 456 bp, Gossypium hirsutum
  Clone ID: uC-gsronu33B017f12b1
ttctcgcgtccggtaccatgacatgtacatgaaggtgaagggtaatgtatttaagaacaagcgtgtcttgatggaaagcatccacaagtccaaggctgagaaggcaagagagaagacactctcagatcagtttgaggccaagcgagctaagaacaaggcgagcagggagagaaagatggccagaagggaagaacgccttgcacagggacctggtgtgaaagcagcacctgcagctgcaccgcaacaggccgagggagttaggaagtcaaagaagtgaatgaagtaatcttttgtttttctctgtaggagtttgaatgcaaaactcggtttccattctgtgttttaaatctttagttttatataattatagaattttgaagaaaccactgagctggtataagaaatggaagatggaagatgcttgtggtattggttattagtataatggactattat

SEQ ID NO: 523 - DNA, 360 bp, Gossypium hirsutum
  Clone ID: uC-gsronu33B017g02b1
gtttttgttgaggaaaagcgaatgaagtccctgcgatggccaattcatctcttggagaagagtatatggacgctcgatctcagccctggtggtgtttccaccattttccaggttagcgatctcaaaaactcgcctggacctggaaaaaaggagcttacatcggcaacaaaacatgctcttcaggttcttcaagataattatccacagtttgttgcaaaacaggtgtttattaatgttccttggtggtatctggcattctatacaatgattagtgcatttatgacccagagaactaacagcaagtttgtcattgcactgccatctaaatctgctgatacactttttccatacataccacct

SEQ ID NO: 524 - DNA, 246 bp, Gossypium hirsutum
  Clone ID: uC-gsronu33B017g03b1
tttatatctttgtgtatccactaattttcggggaaatcaccagccgtgttgtacccgacgcttttgttctgtatgcatccctttttagtgagattttcattggggtttttttcgacgacagtatgtttgtaagtttctttgtactttgcagacaaagaaaaaggttttcttgaggtttcttctatatgtttgtaagtttctttgtactttgcagacaatgaaaaaggttttcttgaagtttcttct

SEQ ID NO: 525 - DNA, 366 bp, Gossypium hirsutum
  Clone ID: uC-gsronu33B017g05b1
gagctctttctatgttggaagaatcaatgtcgactgtaccttcttcttccctttgggcctccattttcagctgggttacaccttctgcctgctttgtctgtcttaatatcactatcggtactatctttttcacttccaccttctcttccaacaattatggggccgccgcttctggcggtgtctgcgacggcccatcacttcacgaaggagatgaaacaaacgagcctagactccttccatctccatgtgttttacaaaggctcaaatccatctactggtacttttacggatcccaacaactcttttactacccacaccggcgccgtcgaaattccagattccggagccgtttttcatatctttttt

SEQ ID NO: 526 - DNA, 437 bp, Gossypium hirsutum
  Clone ID: uC-gsronu33B017g06b1
tcctctttctctccgataccctaccatataatcccaggccatttatggtcaccaatcttcacttatttatgttgtttctgacaagagcttgatcgtcagcttcagcccaagttaacatcacatgcagcgacaataattcatcagtgccatttgcctccctagttgccgttaatgatcccctcaggactggtcctgagcctgactcggagctgattggaaatgttcagggtattgcgctcctggctggaacgaatgcatcaagcacgcaatacatagattttggatccaataccggtaagtttaacggccgctctctaagcgtatttttaaggggagaacctgggcttgccgcggtcggaggaagaggacgattcatgatggcaacaggggctgcactatttaaccctattcctataatgccaccaatgttcatcatt

SEQ ID NO: 527 - DNA, 329 bp, Gossypium hirsutum
  Clone ID: uC-gsronu33B017g08b1
cttcatgaggaaagatgttatggccaagtgtgctcatttggcccaatttgatgaggaactttacaaggtgaccggtgaaggtgatgacaagtatcttattgcaactgctgaacagccactctgttcttaccacgtggatgattggatccaatcgtctgagctacctataagatatgctgtatattcatattgttcacgcaaagaagctggttcacatggtattgatgctcctggaaggtttcgggctcatcaatttgagaaagtggagtaattgtgcattaacagtccaaatggtaatgagttctgggacatgcttgaggaagtgatta

SEQ ID NO: 528 - DNA, 233 bp, Gossypium hirsutum
  Clone ID: uC-gsronu33B017g09b1
tttcttcgtccggttggaacaggatgagaataatatccatcatgtttaaagaaattgaccagtttttttcttttcattataatttttcttccaatatttctaaattagatttccgttgctgccatctcaaaatttatgatacttcgatgatggtggtggtgatgatgatgatgatgatgtaaccttcaactgaagttggttgcttaattgctattccaaatagcttcgttttt

SEQ ID NO: 529 - DNA, 463 bp, Gossypium hirsutum
  Clone ID: uC-gsronu33B017g10b1
tgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactcttcaccttgttcttcgtttgcgcggcgggatgcaaatctttggttagacgcttaccggaaagacgatcac

SEQ ID NO: 530 - DNA, 365 bp, Gossypium hirsutum
  Clone ID: uC-gsronu33B017h04b1
gtcagttctttttatttttttcctttgtaagtaaagttttcatattttgctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcccccccaaaaaaaacaaaattttccccccccggcaaagaaaaaaaaaatttttttaaaggggccccaaaaaaaaaaaaaagggccctggtttaaaaaacccgaaaacggaaaaaccctgggttaccccaaataaaaccccttgaaaaaaaaaccccttttccc

SEQ ID NO: 531 - DNA, 395 bp, Gossypium hirsutum
  Clone ID: uC-gsronu33B017h05b1
ctttgttcgtacaagtgaagtgatccacaatcttgatacagtaatacgttaggtagctttcatcatacttgtttgagtttattggtagtagataaagaaaaaatggctgaggagcataccaaggttggtggtgaggaagcagtggcgagcaaggagcgagggatgtttgatttcttggggaagaaagaagaggagaagcctcaacctcaagaggaggtggtgtccacccagtttgagaaagtcaagatagaagaggaacataaggaagatgagaagaaacacagtctcctggacaagcttcaccgatccaatagcagctccagctcttctagtgacgaggaagaaggtgaaggtgaaggcggagagaagaagaagaagaaaaaggagaagaaggg

SEQ ID NO: 532 - DNA, 514 bp, Gossypium hirsutum
  Clone ID: uC-gsronu33B017h06b1
gaatgatggaagcatagttgctatggtgggtgatgggattaatgattctcctgcactagcagctgcagatgttggtatggcaattggggcagggacagatattgccatagaagctgcagactatgttttaatgagaaataacttggaagatgtgatcacagccatcgatctgtccaggaaaacatttagccggatacggtggaactatgtttttgcgatggcgtacaatgtggtggcaataccaattgctgctggggttttgtatccatcattagggataaagttgccaccatgggcagctggtgcctgtatggccctttcctctgtaagcgtggtgtgctcttctttacttcttcggagatataaaaagcccagacttaccactatacttgaaataactgtagagtagaaacaaaatttgaacaactatttttctctccatcaccttctttaggtttgtgtttttataagaaggaaattgagggggtgcgagtgaatcataaattcccatttt

SEQ ID NO: 533 - DNA, 448 bp, Gossypium hirsutum
  Clone ID: uC-gsronu33B017h07b1
ttgtttaccacattgttttattcttctttctgctgctttcttcttctgtccagattcaagctagggagagcaagttctttagcaagatcttccaccttggggccaaaatttctcctctagtggtacctacaccaacgccagcaccagcatcggcgccggtactagcaccgacagtggcacctgcaacggcaccggctaacattggtatccaagatccttattatggcctctatggtcatggctctggcatgtttccccctgcaaaagagggtgtcaccactagcaacactcccaccgcttttgaaaacgatcttttcgccgaggaacttgcggatgaaaaatacgaaagcggctacgagaaaaacaactactattacaacaacaacaacaacaacaatggctacactcttagcagctacaacaacaatggctacagcgggcactacca

SEQ ID NO: 534 - DNA, 360 bp, Gossypium hirsutum
  Clone ID: uC-gsronu33B017h08b1
tcctctcgtccgcgcatttcggagaagtcgcagagggagagagagagttgaaacgatttcgtttttggtgatagaaaacaaatggcggtttcatcatgttcatttactcttagccctagggtttgtaatccatattcttcatttgagtgccgtccagatcccgatttctccagtgcgccgatcggggacaagcctcgtcttgcctccagccgaagggtgacggcttcgtcgctttacgccggaggtatcagtagccgaggtttgtcttctctgatctttcgtttcccgccgaatttcgtgcgccagcttagcatcaaggctcgccgcaactttagcaatatcggtgttgcgcaaatagtc

SEQ ID NO: 535 - DNA, 448 bp, Gossypium hirsutum
  Clone ID: uC-gsronu33B017h10b1
gtgtatctcaatactcatctccagaaaggaagtacggttcaacactgaagagcaacgaggcaagtctcgccaacattttaatttcatctgttcctcagtgtggcgagggctgcatttggaaagccgatttaataataagctttggagtatggtgcattcatcggatccttgatctttcgctgatggaaagccgacccgagctgtggggaaaatacacttatgatcttaatcgtctccagggtatcatagatccggcattttcgaaacctcgttccccaatgttaccctgcttctgccttaaattccggcggactaccagcaaagatcgagtcctccagttttaaacgggagtgttgcccccaaccgcgaaacctggccgggaaagtgttcaaatgcagccacgctcttgattataatcagagatgtggagatcgctttttttttgccg

SEQ ID NO: 536 - DNA, 454 bp, Gossypium hirsutum
  Clone ID: uC-gsronu33B017h11b1
tttttatctacatttcgccccagaaattaaagtacagcagagacaatgagaggaacattgatgttgagttgggttctgatcatctgcctctccctagtagcagtgcagagccaatactactcggagaccctaccatatcgtcccaggccagttaaggtcaccaatcttcacttctttatgcacgaatttacgggtattacagcagtccaggtagcccaagttaacatcacaagcagcgacaataattcatcagtgccatttgcctccctagttgccgttaatgatcccctcaggactggtcctgagcctgactcggagctgattggaaatgttcagggtattgcgctcctggctggaacgaatgcatcaagcacgcaatacatagattttggattcaataccggtaagtttaacggcagctctctaagcgtattttcaaggggagaacctgggc

SEQ ID NO: 537 - DNA, 511 bp, Gossypium hirsutum
  Clone ID: uC-gsronu33B017h12b1
tcctcgcgtccgctcatttcaagggagagagtgtatcagtgtttcttcccctctttacttaatttctctccgccatggctctctccgtcgagaaaaccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgttcttgcaacattttctctacccaagaccacgctgccgctgccatcgctcgtgactccgccgctgttttcgcttggaaaggggagaccctccaggaatactggtggggtactgagagagccctcgattggggtcctactgggggacctgatctgatcgtcgatgatgggggggatgctactttgtt

SEQ ID NO: 538 - DNA, 398 bp, Gossypium hirsutum
  Clone ID: uC-gsronu33B018a02b1
gcttttctcgccagtagtccgctcccagttactggtggttcggtatcatggccaagcagtttgaaaggttccaatcaacagaactcaccaaaatccaaacccttggagcctcaaggtgaaaaagatgatagtacacagggaagcaatggacaagctttggtggaagattggttgctgggagggaggacatcgagccaagaacttttccctcagctgaatgggctttcaccaaacatggatgaaagggaagaagtaatgagatgccaaagagaagagagtgctgacatgcctacttttcgtggcctgtgccaaggggggttgaatgtatcagccacattctcaatgcccgaagcccttctggctacagaatgtcaagagccctttgggggtatgctagt

SEQ ID NO: 539 - DNA, 301 bp, Gossypium hirsutum
  Clone ID: uC-gsronu33B018a04b1
atcttttaaagcaaaggaggaggtaaaggatgagaccccggaggtgcagacagaaacagttacagaggagttcattgatatcataaaatcagctgaggtgaagaagaatgcctaaggttttcggttggaagctttgagagtacttgcagtagctgatgcttgggaatggaaggtttaggatctgttccataataagagttttataaagaaaattaaatactaattttcaaggaataattcacgcctttattcacaccagtaccttaaactggattttctgtactattaacaattttagtgt

SEQ ID NO: 540 - DNA, 418 bp, Gossypium hirsutum
  Clone ID: uC-gsronu33B018a06b1
ggcatttttggcagctcagttggaaacattcaaattgttgaatgtaggatataattaaatcccttatcccaatggaaaaatgcaatgaagaaatgatgagtgaggagtggacccatatggtatatacgatagaaaagttgggtccatttggtaattgcagatttttttaggtgaaaataagcaaaagaaattgcaggtttggggttggtgagtggggtcaatattgctgtaatatttgctttacttgaggttgaagttgtagcattgggtctttagattaaatatttaagacatttctaaacatctctttaatggctgctttatgaaaattcgttgaagcattccacctttgaaagggtctttgatttgggtcaaatcaagaattaagtcccacctatatatatatacctatatttta

SEQ ID NO: 541 - DNA, 445 bp, Gossypium hirsutum
  unsure (1)..(445): unsure at all n locations
  Clone ID: uC-gsronu33B018a08b1
atgtacaagagagttctcatggagagcatccacaaatctaaggctgagaaggccagagagaagacgttggctgaccagtttgaagctaagagggctaagaataaggcaagcagggaaagaaaatttgctaggagggaagagcgtttggcccagggacctggaggaggagaaaagccagttgcagcacagcctgcggcagctgtgcaatcagccgtgggttccaagaagtcaaagaagtaaaaaaaaaaaaaaaaagtaagatttcttactgaagagtactgatcgaacgtgacttttagatatttagcaatggcttaagtaattttgttgagccaatgttgagtttttttgggcctgatatgaactttaggtcttttaggcggattaagctttaaatgtttattattattatcagnttactgatttgattttttttttcccttaa

SEQ ID NO: 542 - DNA, 254 bp, Gossypium hirsutum
  Clone ID: uC-gsronu33B018a10b1
tttatatcttcgttaagacgcttaccggaaagactatcactttggaggttgagagttttgacacgatcgacaacgtgaaagccaaaatccaagacaaggaaggcattccctcagaccagcaacgggtgatcttcgccggaaggcaactggaggacgggcggactttatccgattacaatatccagaatgaatcgactcttcatctggttctacgtgttcgaggtgggatgcagatcttcgtcaagactttgacc

SEQ ID NO: 543 - DNA, 420 bp, Gossypium hirsutum
  Clone ID: uC-gsronu33B018b01b1
cccacgcgtccgacaaaatccaaaaataagccaattgtcaatttttttaactatggcttcaaatcccaaggttttcttcgacatgacgatcggaggtcaaccggccggccggatcgtgatggagcttttcgcagacgtcactcctcgtaccgacgagaacttccgggcactctgtaccggcgagaaaggcgtcggtcgttccggtaaaccactccactacaaaggctctaagttccaccgcgtgatccctgatttcatgtgccaaggaggtgatttcacagcccgaaacggaaccggaggtgaaatcgatatacgggactaagttcgccgacgagaacttcatcaagaagcacaccggacccggcatactatacatggcgaacgccggtcccggaacgaatggatctcagatctttattt

SEQ ID NO: 544 - DNA, 452 bp, Gossypium hirsutum
  Clone ID: uC-gsronu33B018b02b1
gcccgtgcgtgccccgccgcggaattcggggggagccacacgcgcgcgcactcgcgcgcccacaggtgcggctgaaatgatggatgtttgatagagagagacatatgggatccacaggttaccgacccgtggcaacagctcgagcgattcaaagctgcattcattagagaagattccgattcatgctccactctcattgatgagactaaggttttgatgacacagtgaaggagctcttctacggtattagaaaacacccgtggatggggtcacgaaatgctcttagaatgggaacatgacgaacatgctgcatgcctcagtgttaagatcgaagatcaagatgcctttgagagggactttctccagttgaagcccttttataccgatgctggcagccgcatttcaccatccgaggaagagtacctgtttctaggccttaatcttttgagact

SEQ ID NO: 545 - DNA, 483 bp, Gossypium hirsutum
  Clone ID: uC-gsronu33B018b03b1
gtttataccgacggtcaacttgctgtttatcaaatagatagagttcttcagcctttacagatattcgatcctagacctccggcaccagcgcctgctccggcgaaatcgaagaagaagaaagatgatgatgtggctgatagtcctgctgatgattctactgataattctaaagctgtgaggttcactatgggaaacaatgttggtttatttggggttactgccatagtacttattgcattaatttctttgtgattatagtaaaataaaaattttaaatatgggattttgaggggaaaaatatggtgagattgagtgcatgtttttttgattatgcttttttttatattttgaggttttaaaaaaaatattaattatcctttaaattttctgctttttaccatatttttatcatataaatagtactgtcacaagagctaattgttatgattattgaattttgaggttgttgagtggtatgatgtt

SEQ ID NO: 546 - DNA, 427 bp, Gossypium hirsutum
  Clone ID: uC-gsronu33B018b05b1
cactgtatgttttacaatggtttcaagtcttccctccacagctttgggcagtcgcatatttcgaaggagtgcgatatggccacttcacactaggtgtgaccgagttgttgaataattgggccctcgaatgtcatgagctccctgttgtgcaaatgatggaacatattcgccttcaactaacctcttggtttaacaatcgtcgtgaaacaggaataagatggacctcaattcttgttccctccgccgagaagcggatttcagaggcaattgcagatgctcattgctaccaagtacttagagcaaatgaagttgagtttgagatcgtctcaactgagcggacaaacatagttgatattaggagtcgcgtgtgttcctgtcgccgttgggcagtatacggtttaccgtgcgcgcacgctgcaggtgcact

SEQ ID NO: 547 - DNA, 456 bp, Gossypium hirsutum
  Clone ID: uC-gsronu33B018b09b1
tttatatgctctttacactgtcacgttatttggtcgcgtcgctgacaatttcagaactagtgcacgggaacgaggcttccaaattcgtgattttgaatatagtccagaagcacaagaaagtcgtaagcaggaactagagaaattggtacaagaccaagatagcttgcgaagctcacttttgcaatggtgttacactagttatggggaggttttcagctcctggatgcatttttgtgctgtacgtatctttgcagagagcattctaagatacggtctgccggcgtgtttcctggcatgcgttttgtccccgtctacaaagggtgagaagaaagtgcggtccatccttgaaggattatgtgatagcacaaacagcacatactggaagactgaagatgaaagcggagcaatgtctggtttggaggtgatgccgacacctatccctatgtctgctttaca

SEQ ID NO: 548 - DNA, 421 bp, Gossypium hirsutum
  Clone ID: uC-gsronu33B018b10b1
tttacgcgtccgcccacgcgtccgcccacgcgtccgcccacgcgtccggtcaagtacggcgagtttttaactacctgggctaagaatgtcgatacttaccttcttaatgtctaattaaataattaaggaaactacatatatgaataatttgatcatatgtctcgttcttaaataaattatacaaataatcataataaacatgcatttaaatattttataatagctgattaagcattagcttagttggcaacgtttgctgagttcaaacgtacttatgaaagcacaagtatgtatgttattgtcatgaaaattaatgtaacctttgctttgtgtatgaaagtacatgcttctcctatgttatatgataattttcgtggtaaacacaaaaataaataaaaatatgctctttttttttgtcaca

SEQ ID NO: 549 - DNA, 490 bp, Gossypium hirsutum
  Clone ID: uC-gsronu33B018b12b1
cccacgcgtccgcccacgcgtccgcgactgctgtgtcaggcatggtggtggaaaacggtgcaagttcgagaattgtggcaagagtgcccaaggaagcacggatttatgcaaggcccatggtgggggcaaaagatgctcctggggagaaggcaaatgctagaaatttgcaaggggcaggagtggtctatgtgcagctcacagtagcatgttgcaagagaggcaggcaagcaagggagggctcattggagttttccatggtcttgtatcagcaacatcaaccacgggaagcagctccaacaacaatcactcatcttctggcaatagtgtcatttctgattgcatcgattcaccagacaagccagtgaaaaggcaacaactcataccttcacaggtattggttccaccatctatgaagtcatcagcctcatactcaagcttcttgagttccgagcagcaagatgaaagaataaacaggcatggcaatcacaat

SEQ ID NO: 550 - DNA, 356 bp, Gossypium hirsutum
  Clone ID: uC-gsronu33B018c02b1
ggattttctgatcgtctaaaaaaagctaccagagctgacgagttctgaaacttgcagccactaaatgatcggataaccaggaaagaggcttttttccccataactgaagctgataattcgttgcagatgcagccgtggggcctttacggagctctgtaatcataaaaagaaaagcttctctggggaacacctttttttttgtttccctcattctctcattactcttagaagctaatatgttttcagatcatgaaagtggcagccaaatggttcaagagtttattgctatttgtaattttgtagagaaaatggagtttgctgattatattaggcttttggcaaaatagccagtggca

SEQ ID NO: 551 - DNA, 182 bp, Gossypium hirsutum
  Clone ID: uC-gsronu33B018c03b1
cccacgcgtccgagtttactagctcttgaaatttgaccttagggttttttttctctctgtaatttggcggaattcgataaatttaggattagggttttatggaatcttaaattgttgttgttacccttgtgttggttgatgtggttttgttgtaattacaagttgctaatggaatttggagt

SEQ ID NO: 552 - DNA, 506 bp, Gossypium hirsutum
  Clone ID: uC-gsronu33B018c04b1
cctaccttcaggctgtgatcaaggagactttgaggttacgaatggcaattcctctactcgtgccccacatgaacctgcatgatgcgaaattgggtggctatgatatccctgctgagagcaaaatcttggtaaatgcatggtggcttgccaacaaccctgctaactggaaaaatcccgaagaatttaggcctgaaaggttctttgaagaggaagccaaggttgaggccaacggcaatgatttccgctacctcccctttggcgtggggagaagaagttgcccaggaattattcttgcattgcccatccttggtattactttgggtcgtttggtacagaattttgagctcttgcctccccctgggcaatctcaaattgataccacggagaaaggtggacagttcagtcttcatattttgaagcattccaccattgttgctaagccaaggcaaatttaacttggtctcttctatccattttagggaactcttggaagacagtatgaaaca

SEQ ID NO: 553 - DNA, 472 bp, Gossypium hirsutum
  Clone ID: uC-gsronu33B018c05b1
gcttgttcttgacttccactttcagacatcttctccctctcttcgcttctgatttcactttcagatggattggcaagggcaaaagctagcagagcagataatgcaggtgatgctattggtatttgcagtggtttcatttggtgctggttatgtgttgggatcatttcagatgatgatgctcgtatatgccggaggcgtgaccctcaccgcattgattactattccaaattggcctttcttcaaccgccacccactcaagtggttggatccaagcgaggccgagaagcatcccaagccacaggtagctgtgagttcaaagaagaaatcctccaagaagtagggtcattttgatttcatcttagcatcattagaaagttgctaggggtatgaattgatgttttctgccttctttccatctagtcggctaggtttctcaaagtttttgaactataataaacaattagtttgagag

SEQ ID NO: 554 - DNA, 179 bp, Gossypium hirsutum
  Clone ID: uC-gsronu33B018c06b1
cccactcgtccgcccacgcgtccgcccacgcgtccggtgggtgaatttgttggctgtaattacagcttttgcgaactttttagtatatttggttggcaaaagcttgaattcatcatctgtaattttagattaaatttacttttttaattctatcaattcaacattattttctatcaacc

SEQ ID NO: 555 - DNA, 396 bp, Gossypium hirsutum
  Clone ID: uC-gsronu33B018c07b1
ctttaattgagcgcttaacaaaagattcagaaaatcaaaaggaagctttcatgttaaagctgagggagtctgaagaaaagcttgggtccctaagtaaagaaagagatcaattgattaggcagagagacactgccatgcaggaggcacatatgtggcgtactgagcttgcaaaagctcgagagagtgctgtgatattagaagcagcagttgtgagagcagaagagaaggtcagagttactgaaatggatgctgaggcaagaataaaagatgcagcacagaaagaggctgctgcggtgaaggaaaagcaagaacttcttgcttatgtgaatgtcttacaggcacatcttcaaagacaacaagagtgacacaaagcaaaattttgaggagaagaccgag

SEQ ID NO: 556 - DNA, 450 bp, Gossypium hirsutum
  Clone ID: uC-gsronu33B018c08b1
atctcaagtaaaaaggtagaagatgcaaagctggctagagattttcagaacacgctccaagagttccagaaagttcagcaactggcctctgaacgcgagtctacttactctcctgcaccccctccaccctccttgcccgcaacgtatcagtctttcacatttaacaccatctatgtatatgtatgtatgtatgtatttgaggtcttttatagattggatgctttcgatgcagcagctctggctccgatgagtcgttgcctcaagagaaacaacgtttacttatggaacagagaaggtgagttcagttcatcgtttccttttctcccccaaacccttttgtcacttttcctttttcctcacctgtcatgcatagaacatcaatagctttaaacccatccttgaaatgattgtacttgattaaccattagttatatttttggcttactcttt

SEQ ID NO: 557 - DNA, 274 bp, Gossypium hirsutum
  Clone ID: uC-gsronu33B018c09b1
tttttccaccctcagcacccttctttgagcctagtgagttgacttcatggtcgttttaccgagctggaatcgctgagtacgtagctactttcctatacttgaacatctagggcttgaccgacattggagttgactagggcaattgcaacggtactactattgggagacaaggtattgcttggaaaggtgttggtctttccgttaaactagtttactataaaggcttctaaattgggcggcctgatccctgatttcatgtgccaaggaggtgatt

SEQ ID NO: 558 - DNA, 150 bp, Gossypium hirsutum
  Clone ID: uC-gsronu33B018c10b1
cgcgtttttatcagctgagaccagaggaacccagatgacactaatgaataaccctgttcttttgccccacatgaacctgcatgatgccaaattgggtggatattatatccctgctgatagcaaaaatctaggtgaaagcatggaggcttg

SEQ ID NO: 559 - DNA, 404 bp, Gossypium hirsutum
  Clone ID: uC-gsronu33B018c12b1
cccacgcgtccggaagtatagagcctttagatttgtgtaatgttcaagttccgtactatttcaggtgcccaatctcactcgaattaatgcgagacccggtaactgttagcaccggccagacctatgaccgaaccagtatcgagtcatgggctgctaccggcaacaccacttgtccggtcactcgagcaccactgtcggatttcactctcatccctaaccacacacttcgccggcttatacaagattggtgtgttgcgaaccgggcttttggtattgaacgaattcccacgcctaaacaaccggctgaaccgggtatggttaggttcgttgttgaaccaggcttcaacggtttcgaatcccgtttcgggtcgacattctgctttgggtcgactcaaggggttggc

SEQ ID NO: 560 - DNA, 398 bp, Gossypium hirsutum
  Clone ID: uC-gsronu33B018d03b1
gaattacggtcaaaaaccgatcaagggctcaccatacccacggggatattacaagtgtagtacggtcagagggtgtcccgctaggaaacacgtggagcgagcgaccgatgatccgtcgatgttgattgtaacatacgaaggggagcaccggcacggggaaggcgcggcgcaggagaacatggctccaggtgtggggctggtattcaagtcaacttgataaacaaataaacttaaaagagttttgtaatattttagtggttgagggggctgaatgtaaatttgttttttccttagatatattataaattttcctaatgaaaaaagtaaagcttaattaaattaattgttgattggtgatgacgatgaaaatagcaataataatatcttaataattctac

SEQ ID NO: 561 - DNA, 472 bp, Gossypium hirsutum
  unsure (1)..(472): unsure at all n locations
  Clone ID: uC-gsronu33B018d06b1
cctttttgtccggtgctagaaaggtatcccatcactacagaagatggagggatcattagacacaacaggaaatgcagagatgttgcatttcttgtcatttttatagcattttgggttgctatgatcgttaactctagctttggatttaaccaaggaaacccattaaggcttacatacgggctggactacaaagggaatgtatgtggtgacaagcatgctcatcctggccttcatcagctggaactcaagtattggttgaatccaaatcaggtttatcaaagtggtgtgacggatagccaattcaaattgtctaatgctcggagtatatgcttattggattgccctactccattagaagattcactaagttgngatctgtgattatccagagggggatatgcacctcttaatggatgactggatcgatagaaattatgattattatggaaatcttacatcggaaatgaaaaat

SEQ ID NO: 562 - DNA, 482 bp, Gossypium hirsutum
  Clone ID: uC-gsronu33B018d07b1
cccacgcgtccgcccacgcgtccgattcgcaagagtcttccctcctcttttggctactccatacctgccgcctcctacaattctatctccttttccataaagattcaatattgaagcctgcgccatcttggatcttacatttactttgtcggtggcggatcaaaaaccccaaaatttgcttaaagatctagctgtagctgttagatctttgaaatccctgtgttctcttttttttttttctgaatctgggtctttctctgatctgtaatgggtttgagatataaggctggcttgttcttgataggtaccgttgttgttatttgggtaacttctgcagaagtaacccaggatatctttgctgactataagcagccatttgcggttacatatcttggagcttctcttatggtaatttaccttccaatagcctttaaaaggattgggtatgtaacttgctaagacgtcgttcttctaaactgtta

SEQ ID NO: 563 - DNA, 529 bp, Gossypium hirsutum
  unsure (1)..(529): unsure at all n locations
  Clone ID: uC-gsronu33B018d11b1
tgtattttctggatctaaggaaaaaatatggatctgtactagctatcgatcttgtcaacacgactggaggtgagggacgcttaagtgaaaagtttgcaagtgcagtgcaacctatacttagtgacgatttaagatatattcactttgatttccataagatctgaggacatgttcattttgagcgcctttcgatcctgtatgatcaaattgcagattttcttgacaaaaatgggtacctcttgttgaacgacaagggtgagaaaatgaaagagcaacttggagttgtaaggactaattgtattgattgcttagaccgcaccaatgttacacagagcatgataggtaggaaaatgttggaactccagcttaggagaattggtgtttttgctgctgaagaaaccattagctcacacacaaatcttgatgaaaagtataaaatattgtgggctaatcatgnggatgacgtaagcatacaatattctggcacttctgcactgaaaggagaatttgtcccgtatggaagcgaact

SEQ ID NO: 564 - DNA, 664 bp, Gossypium hirsutum
  unsure (1)..(664): unsure at all n locations
  Clone ID: uC-gsronu33B018d12b1
attattttgatgctttcatctgcaatagcggtatgtgatctcttctattcaactattaaccctgaagatggtccctttgtaatgcgacttctattatcactcacacatcgagcaccgctggggtggtgaagggtagataaagacttagccacggtgacctgtatcggtttccgttcggactggactacatggggagtgtatggggagacaagcatgatcattctggacttaatcagctggaacttaagtagttggttgaatccaaatgaggtttatcaaagtggagtgacggatggccaattcaaattgtgtaatgcttggagtatatgcttattggattgccgtactccattagaagattcactaagttgnggtctgtgattattcagagggggatatgcacctcttaatggatgactggatcgattgaaatatgattattatgaaatttttacatcggaaatgaaaaatgctttttttcaacttcagggtccatgttaccccggttttttttccaagtgtgaatgtttattgcagttgccaaatttttggtgggttttaaatgcatttttggggcaattggaacaattggtggagtgggattctaagaagattttattctcgttaaacctttcaggttttttaattttggtcattgtttaaa

SEQ ID NO: 565 - DNA, 573 bp, Gossypium hirsutum
  Clone ID: uC-gsronu33B018e04b1
cccactcgtccgcccacgcgtccgcccacgcgtccgcgacgatgttccggcaagcgtcacgcctcttggctcgaactaccaccccatggaggggaagtcgagcattttcgtcagatgtaccagccacacccgctcaagattcgagcttcatcgaatcatggtccaaagtcatacccaacttagaccctcccaagacaccatcttctttcatgacccctcgccccgccaccccttctgctatcccttctaaactcaccgttaactttgttcttccttatgcatctgagctctccgctaaagaggttgacatggtaatagttccagcaacaactggacagatgggtattttgcctggacatgtccctacaattgctgaactgaaacctgggatcttgtcggtgcatgaaggaaatgatgtcacaaaatatttccttagcagtggttttgctcttatccatgccaactctgttgcggatatattgctgggaagcagggccagtcgaccgccttgacccaccttggccagagggtctgctgactttacttaaagcttgtcttggtacactgatctga

SEQ ID NO: 566 - DNA, 197 bp, Gossypium hirsutum
  Clone ID: uC-gsronu33B018e11b1
ggttctttgtgttatttaagtgtgtaatcaatagtttgtagtggaagttaatcatgaatgagaatcttcccttttgttggtgtaaaaaaaaaaaaataaacgaaagaaatacaaaaaaaaaaaaaaaaaaaacaaagggcgacaccaactaaaaaaaccaagcataacataccccctgcaatgccaacatggaaaaa

SEQ ID NO: 567 - DNA, 556 bp, Gossypium hirsutum
  Clone ID: uC-gsronu33B018f01b1
gggttttacaacctagtgataaatttctcatttttgcatcggatggactttgggaacatttgacgaatcagcaggccgtcgagattgtttccaactctccacgagcaggaattgcaagaaggcttattaaaacagctttaaacgaggcggctaggaaaagggagatgagatatgatgacctgaagaaggtagataaagggataaggcggtttttccatgatgatattacggttgttgtcatctttatagaccaggagtcgctgagtacgaagatgcctgttccggagcagtccgtaaaggggttcgctgactccattggaccatcaaacttcaacattctttaagtcttgagatgtaaatcaggaaatgcaagcacatgtggtctatcatcatctgaattaatagcttgccacttcaaataaacagtggggtttctgtatggattttacttcctttttttctttctccttaccaagcaagaaaagtttgaactaattttgattttactagtatcactttgattcccaactttatgatgataaccccctttttagag

SEQ ID NO: 568 - DNA, 423 bp, Gossypium hirsutum
  unsure (1)..(423): unsure at all n locations
  Clone ID: uC-gsronu33B018f03b1
catttatcctcctcttttcactctcttcttcgctaatatcctctctcgtggagttcggggggcatattaattacttcaccctcccctgcttgtcctttcttcttccatcattcctcatttttctgctttggaaatcttctaggcttgtagctaagctaagctaaactaaacttcgaagacatggatcttcttcactcctttagctcattagctcttattctgtatctcattgtcttaactctgaactctaaaggtgcattaggtgcttctttcacatttgtcaatcgatgggggtacacggtgtggcctgggatattagcaaatgcaggcaggcctacactcgacagcactgggttcgagctaccaaagngacttggctcggtcatttcaagccccaactggctggtcgggtcgtttttgggg

SEQ ID NO: 569 - DNA, 369 bp, Gossypium hirsutum
  Clone ID: uC-gsronu33B018f06b1
gcattatggccaccggtgaactcgcctgtacttacgccgcgttgattctccatgacgatggaatctcaatcaccgccgagaagattgctacattggtgaaggcagcgaacttgagcgttgaatcttactggccaagccttttcgccaagctcctcgagaaagtcaacgtcgatgatctcatcaccagcgttggctccggtggtggtgctgaccctgttgccgctgctggtgcttctggtgcagttggcggtggggctggtgaatgtgacccggcttgtgaggagacattggacgcagagaaggaagagagtgctcacaacatgaccgctagattggtcggctagacacaatccgttccagttcgtatat

SEQ ID NO: 570 - DNA, 412 bp, Gossypium hirsutum
  Clone ID: uC-gsronu33B018f08b1
gtttggaggctctccagattttgcatggccttggcctaatacattgtgatctgaagcccgaaaatatattacttaaaagctatagtagatgtgaggtgaaggtcattgatcttgggagcagttgttttgagacagaccatgtatgctcctatgttcaatccaggtcctatcgtgcaccagaggttatcctaggactttcgtatgacaagaaaatagatatctggtcacttggctgtatcttggcatgaactctggactggaaatgtacttttacagaatgattcacctgcgacattacttgcaagagtaattggaatcataggtgctatcagacaagacatgcttgccaaaggacgggatacgtacaaatactttacgaagaattacatgctttatgaacgttataggagac

SEQ ID NO: 571 - DNA, 539 bp, Gossypium hirsutum
  Clone ID: uC-gsronu33B018f10b1
tttacgcgtccgcttgttgtgaggaagaaaaacaagcgttactgcccaatatatttcaataaggaagatattgaaaaagaactttcaaaggtttcaagggcatcaagaggacctggtgtttctcagcaaatcatggttggaagcttggaagatgttctgaagaaaatggagatgagcgagaaaaactcgggctgggaagatctaatattcattccacccggtaaaagctattctcaacacctccaagatgtggtgaaagtatgaggcagttcggatgttacttctgcctgtccatttgataacataaaaaatgcgattacagcaactcagaagctcttgaagtagaattcggaatggaagagatgggaattaagagtgggatgtacactgtctgatgggttctccatatgttaccgggaaaaaaagaagagaaaagaaagaggcaagggaaacctaatagtgcggtcattgatatgcatatttatactttgaacgagttaaattggtggagaaagcttagttgggtcttggcttacatc

SEQ ID NO: 572 - DNA, 450 bp, Gossypium hirsutum
  Clone ID: uC-gsronu33B018f12b1
tttttgtacatcgcgtggctttcctatcttcatttcatggtactctacgacgaaaggctcgtttttgatctgagtttggaacctgatatggagattgaagatatgatttgaatgttttttttgtcaaaaccagaaaaaaatgaccaattgttacccaaccgttagtgaggagtaccaaaacgccgttcaaaaggctaagaggaagctaaaaggtctcatcgctgagaagaactgtgctccactcatgctccgtctagcgtggcactcagctggatctattgatgtcaagaccaagaccggaggtccattcacaaccatgaagcaacctgctgagctcgctcatgctgctaacaacggtctcgatattgtagttaggtttctcgagccgatcaaggagcagctccctatacttttatacgctgacttctatcagcttgctggtgttgttgc

SEQ ID NO: 573 - DNA, 597 bp, Gossypium hirsutum
  Clone ID: uC-gsronu33B018g02b1
atgttctggcaagcgtatgtagatgatcacttgatgtgtgatattgagggcaaccatctctctgccgccgctatcattggccaagacggcagcgtttgggcccagagctccaatttccctcagttcaagccagaagaaatcactggcatcatgaatgacttttctgaacctggatcgcttgctccgactggattgtaccttggtggcacaaaatacatggtgatccaaggtgaacccggagctgttattcgagggaaaaagggccccggaggtgttactgttaaaaagaccaacctgtccttgatcattgggatctatgacgagccaatgactccaggtcagtgcaacatgattgtggaaaggcttggtgattatctcatagaccagggtctttgatcactttggtgtaaccttaattgttgcaattcttcctggcttcttctatacaaaagtgcatctaccaccacctcttgtaatggttggctgcaataaataatagtattactagtattaagtcgtgtgaaccttttcagaacaataagcttggggtttgaatagtgatatgcttgggacctttgcttggttttggctgcttga

SEQ ID NO: 574 - DNA, 491 bp, Gossypium hirsutum
  Clone ID: uC-gsronu33B018g04b1
gtgaggatcaagtttcaggattggaaattgaggtcaacgacggccaatggatcaagttgaccaatctatctccttcttcttttgtttttgtagttggagatcctctcaaggcatggagtaatgggaggttgaaatcagtaaatcacagagtgatgatgagcggagacaaagatcgatactctatagcagcctttgtcattccaaatgagggtactataatcaggacacccgaagagcttatagatgaccaacatcctcggcttttcaaggacttcgatttcatggatttcttcctttttgccttttccgacccagcaaagcacatcgacaacgcgggagttgctccatgtctttgctggcctttcaccaccagtttccaattaaaatcatgcccatattgacaagtaaaatccagttaaatcaatgttacaaataattaactgagttctattctcgagatttgcgttcttgtattgtactactatgttatg

SEQ ID NO: 575 - DNA, 216 bp, Gossypium hirsutum
  Clone ID: uC-gsronu33B018g09b1
cgttcagactttattatgaaatctagggtacttaacatgaagtgctgagagaccttgctcttcatttgaacagatcaggggatgggaacctacgagagcggctgcttatatctagtaaagatactgaattatctagacaatgagaatgatacacactccgatccttcagtggatacataggctcaggacatacaggctaaatccggggaatgcact

SEQ ID NO: 576 - DNA, 423 bp, Gossypium hirsutum
  Clone ID: uC-gsronu33B018g12b1
gtttagccgtttattggagtgaactacggccaagtggcggacaacttaccgccgccgtcagccaccgcgaagcttctaaaatcgacgtcgattgagaaagttagattgtacggagcggatccggcgattatcaaagctttggctaataccgaaattgggatcgtaatcggagcggctaatggagatattccttctttggcttccgatccaaactcagcagctcagtggattaactccaacgtgttgcctttttaccctgctagcaaaatcatcctcatcactgttggcaacgagggtattgactacaaatgacccgaatttaataaaccaactgctacccgcaatgcaaaatatgcaaaacgccattaacggtgctttactgggtggaaagatcaaggtctcaacggttcattcatggcggtg

SEQ ID NO: 577 - DNA, 277 bp, Gossypium hirsutum
  Clone ID: uC-gsronu33B018h04b1
gtgtctggcggaacagtcaacttggacatcaagtacgacggcttcatcactgttgttaagaagactgaggacatctgctccatcggaaatggtgtgacctgccccatcccctctggctcctactctgagcaaatcaccgagatgatcccatcttccgtcccctctggctcctactccggccaagtgaccctcatggaccagaacaaccaagagatcacctgcatcaacctcgccttcaagctgtaattgttgtgtttctattctattgtgccactat

SEQ ID NO: 578 - DNA, 367 bp, Gossypium hirsutum
  Clone ID: uC-gsronu33B018h06b1
cgcgcatattaacacctacaagaaagcaaaccacaaaggagggctttttaaagagacccacattcaaagacaaaagaagaaagagaagaaagacagggtacggggggctatgtttaccggtccaccgtttcctttcattgacatgccagaacttaagttatgtattgtgtacccaaacctcatagctggggccatagtcactcaactctggctctgtgaaacccctggtgctgccaaagttaacaggatacaacaagatgcccgttatggcggtgggcttttgggcaaagggggcgctaccggtggccttttccaaaagctgggaaactggactggcgaaagggacggcccctgcattgacccttta

SEQ ID NO: 579 - DNA, 522 bp, Gossypium hirsutum
  unsure (1)..(522): unsure at all n locations
  Clone ID: uC-gsronu33B018h07b1
ctgtgaaatgtggcgcccgaagagttgaatagaaaggaaaaaagggacttaatcgtgggaagtgcaatggcgtattggacgactctggcgcccaatgttgaagactataacgggtctatagcanaggcaatagcatcggggtcagggtacgttgtgaaggggattttgtggtgcggcgatgtcactgttgataggttgaaatggggcaatgatttcttgagtaagaggataaagtcaggttcaacctctgagatctctccagaggccttgagaaggatgaaaagggttaagaagttaacaaagatgtcagagaaagtggccactggaattctttcaggtgtggataaagtgtctggattcttcacaggttcaattgttaactccaaagttggtaagaaatttttcaacctgctgcctggagaaaacgatcttggtttctttgatggaattaataaggtttgcgatgcatttgaagtagcaagaaggcatgtcatgttaccacatctgttgtgacaacaggac

SEQ ID NO: 580 - DNA, 80 bp, Gossypium hirsutum
  Clone ID: uC-gsronu33B018h08b1
cactcagtagagtttccagttacagaggcatgcttactgacatgggaggtgagggttgtgggatgggaagcaaactatcg

SEQ ID NO: 581 - DNA, 450 bp, Gossypium hirsutum
  Clone ID: uC-gsronu33B018h11b1
tttttgcacctccccgtaagcaaaccacaaaggaaagcttggagagagacccaaaaacaatgtctaaggaagttagtgaagaaggacagggtcgtaaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggtttgtttttggcccgtaaagtgtctttcatttgggctgtggcttacatggtgtcacagtgcttgggtgctatatgtgga

SEQ ID NO: 582 - DNA, 381 bp, Gossypium hirsutum
  Clone ID: uC-gsronu33B018h12b1
tctacgcgtccgaaagttaggaaaaggtattcgcatgttgacaaataaatgtcttttcttttttgcaccttttaatcaaataatttcgcataaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaggggcggccgttataagggatcaaagttatctaacccgggaatgcaaaagaaaattttttttaaggggcccccaaaataaaaaaaatggcccccgttttaaaaaccccagaattggaaaaacccgggcttaaccaaaaaaaattcttttgaagaaaaaccccttttcccaagttgggcg

SEQ ID NO: 583 - DNA, 634 bp, Gossypium hirsutum
  Clone ID: uC-gsronu33B019a01b1
ggatttttcagttgaaaaagatgggtcgcggagttagcagtggcggtgggcagagctcattaggttatttgtttggtagcggagaagctcctaaaccagggacaaacaactcccaagctgctccagctgaagcaccagctgtctccaaacctggccctgctcctgaaccagtagatatttccaagcaaattcctgctggtattaacagtatttccgcaaacaattacatgcgtgccgatggtcagaatactggcaatttccttacggatcgaccttccaccaaggttcattctgcccctggaggcggatcttctctggactacctatttggtggacctggaggtagtaaatgagattgtgccttaataacatctaataacatctttgataagggagagtattgtttgttgatttgggggaagcagtaaagctgtggatgaaatgctgttctataatctttgaacacagaagcaatgaaaacatgcctgtctcttgtggtgtaatattgccagtctggggtggttttttgttgattcaatcaatgagttctccgataggtgccaacatctaatttgcagagtgggtaaaaggacattgtatatattatgtatgcatggtatgtcgtttccttctc

SEQ ID NO: 584 - DNA, 441 bp, Gossypium hirsutum
  Clone ID: uC-gsronu33B019a03b1
ccatctcccaagttgagagatttgtatagcagcttctcctctcaacctccacgccaaacatgccttcacataagactttcagaatcaagaagaagctggccaagaagatgaggcagaacaggcctatcccttattggatccgcatgcgcaccgataacaccatcaggtacaatgcgaagcgtaggcactggcgccgtaccaagctagggttctaagctttatgtgctttatttgtagttttgtactcaagcaaagctctgtttttttgtttatttcatgacattttgatgtggccttgaacgtttttatgtgatggttgttgacgatatttagccattgtttcgactgttgtctatctaatgtcttgatttcgagctttgaatttttatgaaactgaatcattatgttctttggaattaatgaaaactgttattattcagt

SEQ ID NO: 585 - DNA, 500 bp, Gossypium hirsutum
  Clone ID: uC-gsronu33B019a04b1
ccctcgcgtccgaaatgggatgaagctatgtattatgtgctgggagatccaactatgaagccaaaagggtatgacccaatgacggaagctgtgttgctgtgggaaagagacaaatctgctactaagacaagatacaatcttaccccttttgcaatatccttaaatgaattaactcctgatttattggaaaaattgcctccaacggactcaagactgaggccagaccagagacacttggagaacggagaatatgaaatggcaaatgcggagaagctgcggttggaacagttacagagacaggcaaggaaattacaagaaagaggatggcagccaagatggtttaacaaggatgaagatggttgttatcgatacattggaggatactgggaagcaagagagaaaaggaaatgggatggaatccctgatatattcggccagtgtagcggtagtagtcataattcaccttcatgtttgatcgaagagtgagtaagctatatttt

SEQ ID NO: 586 - DNA, 514 bp, Gossypium hirsutum
  Clone ID: uC-gsronu33B019a06b1
aacctttcttatttggaaagataatacctgacaagtgcagatatgatgttttgtcaaccaaaattgaaattaggttagcaaaagctgaaccaattcattggacatcccttgaatttagcatggaagttgctgtgccccaaaggattaatgtatcttctgttgctgcaaatcaaaggccatcgtacccatcctccaaaccaaaaagggttgattgggataaaatcgaagctcaagtaaagaaggaggagaaagatgaaaagctagatggtgatgcagctttgaataaatttttccgtgacatttatcaggatgctgatgaggatgcaagaagggccatgcagaaatcctttgtggaatcaaacgggactgttctttcgacgaactggaaagaagttggtgtaaagaaggtggaaggaagtccttcggatggtatggaactgaagaagtgggagtactgagctcttttttctcaattgatgctgttttggactccattatccaaatgttggatact

SEQ ID NO: 587 - DNA, 585 bp, Gossypium hirsutum
  unsure (1)..(585): unsure at all n locations
  Clone ID: uC-gsronu33B019a07b1
ccctcgcgtccgcggacgcgtgggaaaaaaaatgggaattgtggcaggcataggggttttgttgccattcccattttactacttgttatggacatatccacagtcatgggtgaacctttgtgggaaaggaagggacccatcaaaggtgatggcccttgtctcccatttcatcaagctaattcagttcgtttctctcttttccgttccttcgttctcttggcctccccctctttacttttggcccctctttgccttcggtcagttcctcaacttcagggtgtatcaattgcttggtgaatctggcacttattacggtgtacgctttggaaagaatattccatgggtaagggaattcccttttgggttcattaaagatccacagtatgttgggagcatcatgagtcttgtagcttgtctatcttgggtaccgtttcaatatattctctttggtcgttgggctatctattatgatccacatcgaatcaactgngatgtgacacacgtgcaggcctttatctaaagtggagttgcagtcgcttttactatttctgaaaacgtttatgtgacattggctcctttgtgtgg

SEQ ID NO: 588 - DNA, 174 bp, Gossypium hirsutum
  Clone ID: uC-gsronu33B019a08b1
ccctcgcgtccgttctaattctttttcgtggaggggtttttttgtacttacaaatttatccaatgtaaaatctgtgtattcaaggtgcaaaagatcttaaagccaaaatgcaccgacatttgtaagatacaatattttaatcaaattaatgctaattgagcagctttcattttc

SEQ ID NO: 589 - DNA, 559 bp, Gossypium hirsutum
  unsure (1)..(559): unsure at all n locations
  Clone ID: uC-gsronu33B019a09b1
ctatagggttctttagattttcttaccagttccttttattaagaaaatggcctcccacattgttggatatccccgtatgggaccaaagagagagcttaagtttgctttggaatccttttgggataagaagagcagtgccgaggatttgcaaaaggttgctgctgatctcaggtcatccatctggaaacagatgtctgatgctgggatcaagtacatccccagcaatactttctcttactatgaccaggtgctcgatgccacatcgatgctcggagctgttccacctagatacggctggaatggtggtngagatcgngatttgacacttacttctccatggccagaggaaatgcctctgtccctgcaatggaaatgacccaagtggtttgacaccaactaccacttcattgttcctgaattgggacctgatgttaacttctcttatgcatctcacaggcagtggatgagtacaaggaagctaaggcgcttggagttaacacagtcccggtccttatcgccctgtctatacttgtgctctctaaccttgcaagggtgtgag

SEQ ID NO: 590 - DNA, 518 bp, Gossypium hirsutum
  Clone ID: uC-gsronu33B019a10b1
ctcagctgccgtagttaccactatcggttgctctctcgaaataatatcaccttatcatctgtacttgaaccctaagctcgtggttaagcagtatcaattctggcgcctcattactaacttcctgtacttccgcaagatggatttggatttcatgtttcacatgttctttcttgctcggtactgcaagcttcttgaagagaactctttcaggggaaggactgcagatttcttttacatgctcttgttcggagcttcagtcttaactggcattgttcttgttggaggaatgataccttatctgtcagcatcatttgccaagattatatttctaagcaattcattgacattcatgatggtttatgtgtggagcaaacagaatccttttatacatatgagttttctgggtctttttacctttacagcagcttatttaccctgggtgcttttgggattctctgtccttgttggtgctagtgcttggggggatcttctgggaatgatgctggtcatgcctacta

SEQ ID NO: 591 - DNA, 447 bp, Gossypium hirsutum
  Clone ID: uC-gsronu33B019b01b1
aagaggctttcagggtgtttgacaaggaccagaatggtttcatatctgctgctgagcttcgccatgtcatgacaaatctcggtgagaagcttacagatgaggaagttgatgagatgatccgtgaagctgatgttgatggtgatgggcagatcaactatgaggagttcgtcaaagtcatgatggccaagtaaggataaaaaatgggtaaaaaggggaacagggcagataagtttgctaagatctctatttatatcaatagggcatctatgtttttatgttactaccttttgttggattgttgactgtttctttgtacgcattatttcgtggactagaccctaatatctacctgtttgctctgttttttgttcattagtctgggttgttagtgtcttatttatctttctaatttggtgttttctttctattcttggtgccatgaaacct

SEQ ID NO: 592 - DNA, 571 bp, Gossypium hirsutum
  Clone ID: uC-gsronu33B019b03b1
aaaagccataattatgatgcttctcatctctttcttcttcctcatcttacctttagcttctttcctcctcctcctccctcttctcctccgacaccgccgtcaccgccaccgtcgtcaccatctccatccctcctctgggttttcctggaaacaactcagaaagcttccccaattcagattctcccacgaaacggaatccgtcgggtcggattcggattcttgtgtgatttgcttagatgggttcaggcaaggtcagtggtgtagaagccgtcgtgcgtgtggccatttgttccataggaagtgtttggatgggttggttaatcaaaggtgctgcttgcccaatttgtagaacgagggttcgatttgaaaatgatgataattgcaattccggtccttgttcgaggggagcagagtttcagggcttgtttgatgtggtagtttattgcaatttagtcccctttttatgtattataaaatgtacagctccctgtttctaataatcctcatgaagaatcctgcaatatgatcacagttggatggcttttaatagtgattggcttatttatttaaa

SEQ ID NO: 593 - DNA, 606 bp, Gossypium hirsutum
  unsure (1)..(606): unsure at all n locations
  Clone ID: uC-gsronu33B019b04b1
gaataaaacccagtattctgtcatcactatggaggccaaatggctgctatgttttacaatggcagcactaatggcagtgtcaaatggccaggaatcagtgaagccattggtgaagatagttaaaggcaagaaactttgtgataaagggtgggaatgtaaagggtggtcacagttttgttgtaaccaaaccatttctgattatttccgaacttatcaatttgagaaccttttcgctaaacgtaatacaccggtggcacatgcggttgggttctgggattaccattctttcattacggcggcggctcagtatcagcctcatggttttggtaccaccggcggtaagctccagagcatgaaggaattggcagcttttcttggacatgtcggcagcaagacttcatgtggttatggagtggcaactgggggaccattggcttgnggtctatgctacaacaaagaaatgagtcccagcaaattgtattgtgatgattactacaaatacacctacccttgcacttctggagttttttaccatggccgtggtgccttgcctatctattggaactacaactatggagaaacaggagacgcattgaagtggactta

SEQ ID NO: 594 - DNA, 537 bp, Gossypium hirsutum
  Clone ID: uC-gsronu33B019b06b1
gtttagtgccatattgcctttgttgaaacttttgtctcttacggtcataggattatttcttgcacatcccaaaactcaaatcattccaagagccacatttaagctcctaagcaagcttgttttcgccctattcttgccctgcctaatttttaccgaactcggtgaaagtattaccattgatagcattgctcggtggtggttcattccggtcaatgtgttaatcagtacttttgttggttgcttgctggggttgttggtggtcattatatgtcgtccgccacctgagtacaagcgatttaccatcgttatgactgcctttggcaatacgggaaatctatgtcttgctattgttggatctgtgtgtcacacttcgaattccccgtttgggcctcattgccactcgaggggtgtggcctatgtctctttcgcacaatgggttgctggtattcttgtctataccctggtttatcacatgatggaaccgcccgtgcagttctatgaagttcttgaagaagggactgaaattgaggaacaaag

SEQ ID NO: 595 - DNA, 616 bp, Gossypium hirsutum
  Clone ID: uC-gsronu33B019b11b1
ttcacgcgtccgcccacgcgtccgaacttttgccatgttgtttccaagcatgatatcatgccaaggctacttttagcagagattgtaaaccacattcctcatatacaagccctgctgcagttctggcactgctgcatggcttctcctcacctccctgttgcaggcctttcttctcaagtgcccagtgatctaaaacgtttactttttcttagtgttttaaaggacttggaattgttaacccaagctgacgatccatcagagagcctgttttggcctttcgggagctatgttttctgctgccaagagggtgccatttgtgtagagaatgttgcatcagttatgaagatgttgcatttgatgatggccactggctcaccgaaccaaagcattgaggatcatctcaagtatggagattatgttgccaaagtttctagacagtttttgcaggctagaaactttgaagaggggatacctgattctagctatgaagctggtgtcgccttggcattgcaatcatcagacctaaccgacaaggaaccagttgtggttatgggcaaggagtgcctgcaaaggctcacacagtgatagccaaacctgatgctgcaacctgcaataa

SEQ ID NO: 596 - DNA, 450 bp, Gossypium hirsutum
  Clone ID: uC-gsronu33B019c01b1
cccatacgaaaccctattttcctgtctgtaatctttgtttcgctcctcgcaatcgcctccgctaaagtattcttcgaagaacgttttgatgagggatgggaaagtcggtgggtaaaatctgactggaaaaaggatgagaacatggctggggagtggaattacacttctggaaaatggaatggagatcctaatgacaaaggtattcaaactagtgaagactacaggttctatgctatttcagctgagttcccagaagtcaacaacaaagataagactctagtcttccaattttctgtcaagcatgagcaaaagcttgattgtgggtggtggctaccatgaagttgctcaggcggtgacattgaccagaaaaaatttgggtggtgaaaccccatacagcatcatgtttgggcctgatatctgcggctatagcactaggaaagtgcatgctat

SEQ ID NO: 597 - DNA, 425 bp, Gossypium hirsutum
  Clone ID: uC-gsronu33B019c02b1
ctttctttcatcggcttctcaggggaggaaagatcaacagaggtggaaaacgaggccgagatggagaaaatggttctcctagaggacgtcctaatgaagctaaaagagctcgagcagcgtgagccagccatgagggtgatcgataaacttgaaataggttttgagatcatttttgtgccatagcttgaggaatgaactgtggctcttgtttatttataggtttaggttaaccataagtagtagtacatttcatgggtaaattaagcttgtgctgcttttgattcccttggattttgatgaggggggacaattaaaaagatgcaattgctctcaagcaatggaacattttcttggggatataagtgtgttaatttccacgtggatttattggtttatggatattaaaattgaaaattttacgtggc

SEQ ID NO: 598 - DNA, 546 bp, Gossypium hirsutum
  Clone ID: uC-gsronu33B019c04b1
gtttaaatccctaaatttttttcttttagttcaagacctttgcttcaatggctgatgcaggtggttcagccgtctctaagaggatgtggtgctcggttcccgaaagactccagctgcatatggccatgttggccttgcagttcggatatgcagggttccatgttgtttctcgagctgcccttaacatgggcgttagcaaactcgtcttcccagtctacagaaacatcattgctttccttctcctcctcccatttgcatatttcctcgaaaagaaggaccgaccagccattacactaaattttcttttacagttcttcctcttagctcttgtcgggataacagcaaatcaaggtttctatttgcttggtttggataacacatcaccaacctttgcatctgcaatacaaaactcagtccccgccattacttttctaatggctgctttgcttaggatagaaaaagtgaggcttgatcgaaaagatgggatatcaaaggtaataggaacagccttatgcgtgactggtgcatcagtgataacattatacc

SEQ ID NO: 599 - DNA, 560 bp, Gossypium hirsutum
  Clone ID: uC-gsronu33B019c05b1
cccactcgtccgagaaacccttctccttccttcttctacttctgttgagcatgaaacctttgtatcagccgtactagagacatattttctcccaatatcgtaccttcctaagatcacagtctctttctgaaatgcgagttcatcgggctcataaacatcacagacccagactctgtctttctctctaaccaccatgaatgttgtttctcctctcatgatttatcaaaatctccactgcatgcggcgcttcctctatccagaatcgaggatgctcgtagcacccccttctttcgccatcgtatgagcctttgttggcctcccttgagttcagtttacgtattattgttaacgcatccccttcaatgcagacttcctagaaccccatatcttcagccaaaataatggcttgcagacacgccctaaccttagccatcactggatctgaatattttccatgggtaggtacacgctgccattattaggccttctttgtttcgcgctatgatccctgagatagaaaatttgttaattgataaaggaagggtcagggtaatttttat

SEQ ID NO: 600 - DNA, 98 bp, Gossypium hirsutum
  Clone ID: uC-gsronu33B019c06b1
ctcactagcagtctaatatggtgtctcgtgcaatgtaagactataaattatcatatctcctattaaatataagggaaaatagatatatttttatggat

SEQ ID NO: 601 - DNA, 521 bp, Gossypium hirsutum
  unsure (1)..(521): unsure at all n locations
  Clone ID: uC-gsronu33B019c08b1
gtttaaacagaggaagagaaagcacaggcccaaggtaattactgagggcaaacctagaaggcccagaaagccagcgactccaaagcctgatggttctcaagaaaccccaactggtaagaggaaatatgtacgaaagagtacagtgaaaaacgacacatcaatcctcccaggagtagcgaatgcagagaaatcaacaggtaagaggaagtatgtgcgaagaaagggactcaacaaagactcaacaattcccacacaagaaggtggaaagggggccactcatccagaaacactcgagcataataagaaaccatgcaggagggcattagattttgacacagtaggacaagaaagagaagcttggtgcgcattgggaagttattgctcctatcaaatattgattcatagacaaggagtgttgaaacaatctggttaagttcaatgcattttgatgtgtctttnttgagtggctcataatcttattgtcctttgatcttttggagtagatgatngtatgcttatat

SEQ ID NO: 602 - DNA, 102 bp, Gossypium hirsutum
  Clone ID: uC-gsronu33B019c11b1
cattaatgcttgcttcactctcgactgttctttaactccctttcctgtatcctgtagaattgcatttagattcacatcaatctaagcccctttttgatctcc

SEQ ID NO: 603 - DNA, 459 bp, Gossypium hirsutum
  Clone ID: uC-gsronu33B019c12b1
gtttaactctaacaaatatcaggcggggatggatttgttcctcaacgccaaagcggtgcgcctacgcggtcaccatgacaagtatctcgtcgccgaggaagacgaagaatccgtttctcaagaccgaaacggatcctccaaaagcgctcgatggaccgtcgaattcgtacccgggtcagaaaacatcatccgcttaaaaagcttttacaacaagtatctcaccgcctccaaccagccctttttacttgggatgaccggtcgaaaggtgattcagtcgctgcctaggaggctcgactcgtcggtcgagtgggaacccattaaagtaggatctcaggcaaagctcaagactcgttacggtaactttttgagagccaatggagggttaccggcttggaggaactcagtcacccacgatattcctcataggacggctactcaagattgggtgttggggatgtg

SEQ ID NO: 604 - DNA, 523 bp, Gossypium hirsutum
  unsure (1)..(523): unsure at all n locations
  Clone ID: uC-gsronu33B019d03b1
ccctctcgtccgcccacgcgtccggttcaaccttgaaaccaatgtctcttcttcctcaaacactaacccttttagccttttcacatatagtaataatcctatcaaatgcggaaaccacttccgattatagtacctttatattcaaaaactgcaccaccaacacatttacagattcaaccaagttccattccgaaaccctttcgacctttttcgaagaacttgtatccaaatcttcccaagagaagttctacaaaactaccacgggagatgataacaatggcatttcaggcttctttcaatgcagggngtgatctaaacaacaatgactgctacaaatgcataacatctcttcctgaaatgttgaacattttgtgtaaaaagctgtttcggctcggattcagctccatggctgcaatgttcactatgaagctgatgagttcattgggaaaggtctaaatcgagttgcttacaaggtttgcgaagagaaaaggcggtggttgtggagttcgagaggtgagggatg

SEQ ID NO: 605 - DNA, 513 bp, Gossypium hirsutum
  Clone ID: uC-gsronu33B019d05b1
ccctctcgtccggcacaaaagagttttatctgagaaaagtaggttctttgctgagaagttgagtcaaaggaaagagaaaggagtttctcacactgtggaaatcagtgaatgtgatgacgtggaggtttatgtggaaactgtggttttgatgtactctgatgatttgaagaagaggttgattggtgaaaatgttaacaaggtcttggctttgcttcaggtttctgcggccattatgtttgatgctggaattagttcgtgcttaatttccagaagtgtggatcagtcgcttagaagaaactattgtttatttttaggcaaatgtattggttttttgttttttctaatcatcttttaagccatgatggtagtgggtaggtccaactttgtgcttattatgagtgatctttaaacctgggttagtgctgcactgacagatgaagatacttgcatggatggattcttaggcagggctttgaatgggtatgcgaagatgatggtgaggaaacgaatcgg

SEQ ID NO: 606 - DNA, 477 bp, Gossypium hirsutum
  Clone ID: uC-gsronu33B019d06b1
ccctctcgtccgtgtcttcgtgttgctacaccgattgatcagttgtctttgattgatgcacagttggcagagtcgcataacattttgagatcctatgcttcacaacaacaaggtcactctttatcaccacatgaaagacaagagcttgataacttcttggcacaatatttgatagtgttgtgtactttcaaagaacagcttcaacaacatgtcagagtccatgccgttgaagctgtcatggcttgccgtgaaattgaaaataacttacaagcgctcactggagtaaccttgggtgaaggcacaggtgcaacaatgtcagaagatgaggatgaactgcaaatggacttttttctggatcaatctgggtccgacggccatgattaatgggttttggtcccttacttcccacagaatctgaaaggatctttaatggatagggttcgtcaaatagctcaagattgacctttaccgggcttt

SEQ ID NO: 607 - DNA, 592 bp, Gossypium hirsutum
  Clone ID: uC-gsronu33B019d07b1
ttcacgcgtccgaatctacaaagcaagatgttcccggcttatttctcgatggtgggggtttgttgtgccatatcggtggcggcatttggttatttgcatccatggaagtcagcgacgatgccggagaagtaccagcttgggtttttagtctctgcatttgccttcaatctatccaatttgttcgtttttactcccatgaccatcgagatgatgaagcaaaggcacaaagtggagagagaagcaaacattggtgatgaaattggatggtcgaagaatcaggaagctgcaaagactaatccaaagcttgcagccatgaacaagaaatttggaatgattcatgggttatcttcacttgctaatattatgtcctttggcagcctggccatgcattcgtggtttttaaccggtaagctcaatctgtagtttgcagttaaattagacatagaaagtccaagttctaaaattgccttctggatatatagattgaagtgattacctgtatttatgtttccccttggatgactgtccaactattcttgcataatatgtaaactcaccatatgtaataacagaactagtcttatagtgcact

SEQ ID NO: 608 - DNA, 475 bp, Gossypium hirsutum
  Clone ID: uC-gsronu33B019d08b1
gtatacacattgagcttgcactatgtcatttagcgcaacatgaagtaaacgcaaaggacatgataagtggaggtgccctttgggagctggttcggatatcgcgggattgttctcgagaagacataagaagtcttgctcgacgaactctgaatttaagtcccatatttcgagctgaaatgagacgactaaggatagaagtatgatttgagatgaagtgttgggttttcgaaaccggattattcgagtgtgtggatgtagctataggaaaaacaacaaaatgttggcattgtatagagggtaaggtgggagattctttaagactgggttggcttatgatattattacgatcatgtttactaggctcttcattcagcttagtgttgtttggtgttagttaaaaaagtggggagggagttaacttttgaaggcaatagagttgtgtgagacaatatttatccctttttcttttttaaag

SEQ ID NO: 609 - DNA, 500 bp, Gossypium hirsutum
  Clone ID: uC-gsronu33B019d10b1
gtctaacgcaatggaaagaatagaattagatgaagcaatgctacaagggcaagcagagatatggcgttacttgtacagtttcgcagattccatggctcttaagtgtgccgtggagctccgcatagctgacataatacactctaatggtggccccctcactttgtcgcaaatagcttcatgcattaatggtggccttacttcacctgacatcaccacccttgctcgcataatgagattgctcattcgcagaaagattttcaccgtccaccatccttcagacggtggagatctcttgtacgacctaactcactcatcgagatggcttctacatgattcggagcaaaccctggtgcccatggtattaatggagaaccatccattgcagatggctccttggcactacttcagccaatgcgtgaaagaaggtggctttgccttaagaaagctatgggtgtgagatatgggttttagcataaggaaccctgatttaacaagctttt

SEQ ID NO: 610 - DNA, 482 bp, Gossypium hirsutum
  Clone ID: uC-gsronu33B019d11b1
gttgtaccagctataattggtcatgcggatgacgaggtgcttgaagctttggctgaaacaatgaagaaaggaaccagctttggcagtccttgtcttcttgagagtgttttggcagagatggtaatctcagctgttccaagcattgaaatggttcgatttgtaaactctggtacagaagcatgcatgggtgtgctccgccttgcccgcacctttactggccgagaaaagataatcaaatttgaaggttgttaccatggccatgctgatccatttcttgtcaaggcaggtagcggagttgctaccctagggctccctgactctcctggtgttccgaaagcaaccacttctggaactctaactgccccttacaatgacatagcagctgttgaaagtcttttaacagtaatgaaggtgaaatagcagcaattattcttgaacctgctgttggcaactctggcttcattacccctaaaccagacttt

SEQ ID NO: 611 - DNA, 675 bp, Gossypium hirsutum
  unsure (1)..(675): unsure at all n locations
  Clone ID: uC-gsronu33B019e01b1
cttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgtttccctgctaatcttgggattggcttncggtgtccgctcctataccaaaacaccagcttcatctaagcattgagactccccagagataatttgaacaatcttcacaatagattatgctagtttaatttgtttggaatttcacatactgcagggtgggaaatggttggatatttttattaaacatttgctccatgcagttgaccnactcagattcgcctcgatgtgatatttgataatgtcttccagttttcacatgtgttgtcatgctcctttttgtaaaaaactgtcattct

SEQ ID NO: 612 - DNA, 589 bp, Gossypium hirsutum
  Clone ID: uC-gsronu33B019e05b1
ggttataggcccactcattcttttcatccatggcttccccgagctatggtactcttggcgtcaccagattgcttctttgtcttccaaaggttaccgagctgtggcacccgacctgagaggctacggtgacacggatgcgccagatttggtcaccagttatacctgcttccatatagtgggggatttggttcagcttttaaatattatttcccctaacgaacacaaagtgttggtagtagggcatgactggggagctgccatagcttggtatttgtgtttgtttaggccagacaaagtgaaagctgtgttcaacctcagtgtgtcctttattccacataatccacatatgaaccctattgatgggtggagagctatctatgggaatgattattacatgtgtagattccagcaacctggaaaaatagaagctgagtttgcggagatgggtacagagacagtagtgaaggcatttctgacatacagagttcctggtccaataatgttacccaaagggaaaccatttggacattcagcggataccccaattgctttgccttcttggttatcagaagaagagggtcattactat

SEQ ID NO: 613 - DNA, 501 bp, Gossypium hirsutum
  Clone ID: uC-gsronu33B019e08b1
cccccgtaaaaaatgtctctggtggccaacgaagattttcagcacattttgcgtgtcctgaacaccaacgttgatggaaagcagaagattatgtttgctttgacctccatcaagggtatcggaaggcgttttgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgacatgaagttgagagatgacttggagcgcttgaagaagatcaggaaccaccgtggtctgaggcactactggggcctttgtgtcgtggtcagcacaccaagactactggtcgacgaggaaagactgttggtgtgtctaagaagcgttgaattctttatgacaatatctatagtttgacga

SEQ ID NO: 614 - DNA, 592 bp, Gossypium hirsutum
  unsure (1)..(592): unsure at all n locations
  Clone ID: uC-gsronu33B019e10b1
ttagtctccatctttctttcttcactaacaaatttaaccagttttttgggagttaaatagcttgaaatcgatggcaggaatgagattgtcgccggaagagtctacggaagctaaccaacatcttcagcttccgcagcaacagctgcagaccggtcgagaagcggcttccgatgacgacaggtcggtggctgcagattcatggtctataaagagcgattacggaagcacacttgatgatgagcagcgccacgctgatgccgccgaagccctgtcctccgctgccaacttccgtcccgcctctgattacagttccgacaaggacgaaccagatgcagagacatcaatgcttggtcttcagagttactgggatgctgcatatcttgatgagcttgccaattttcgtgaacatggtcacgttggtgaaatttggtttggaactgatgtcatggatactgttatttcttggaccaaagtttgtgtactgatgtttctcaaggtcacatnccggatcatgttggagagcccaagccgcagtctgttgaacacgatgaaaagatttgtcttgctgagtgtactgacattggcacgggaa

SEQ ID NO: 615 - DNA, 574 bp, Gossypium hirsutum
  Clone ID: uC-gsronu33B019e11b1
tttcactacaccatggatgaagtgaagctctttgggttttgggcaagtccttttagtagaagggtcatttgggcattaaagctaaaaggtgtggaatatgaatacattgaagaagatttgccttataataagagtgatctgttgttgcagtacaacccagttcataaaaagatcccagtgctcgttcatggaggaaagccaattgcagagtcattggttattttggaatatatagatgaagtgtggccacataatcctttgttgccaaaagatgcttacgagagatccgtagctagattttgggccaaattcattcaggaaaagactcaaccaatgtgggaattctttgctaaacatggcgaagaacagcagaaggcaatcgaggacaactacgaaattctgaggacgattgaagaacatggtcttggaaataaaaagttctttggcggcgaccaaattggcgtagctgaccttgtttttggaatggttattcatatgttggcacccatggaaaaagtggttgggggagtaaagttcattaagccgatagctttccacgcctgcatgcctgggt

SEQ ID NO: 616 - DNA, 311 bp, Gossypium hirsutum
  Clone ID: uC-gsronu33B019f02b1
caattattatattataaaagaatgaaaagaaaaaagagggaattcagaaaaaaaagtgcttcactacacacctaacgctgcgttctacccaaggagcattttagcatgtcgccggatttcattaactgtccgagagtggtcccatgtgctggactgcttaatgccttggcggggccctcctctggctacattgccttttcggcccccttttgcctgcgggtcgtatcgttcttgggccctcttttgccattccttcttccgggtcgcctttcctaaggggcgtttgggacgcgccctgggccggcccgttt

SEQ ID NO: 617 - DNA, 510 bp, Gossypium hirsutum
  Clone ID: uC-gsronu33B019f05b1
ccctctcgtccgagcgcctggaattaatgcctcaccatcagaggataatatgcgatattttaatgtgatgatccttggtccaacacaatctccatatgaaggaggggttttcaagttggaactatttttgcccgaagaatatcccatggcggctcccaaggtccggtttcttacaaagatatatcatcctaacatcgataagcttggaagaatatgcctcgatattcttaaagacaaatggagtccggctctccagattcgaactgtacttttgagcattcaagcactcttgagtgctcctaatcctgatgatccactctcggaaaacattgctaagcactggaaaacaaacgaggccgaagccgtcgagacagctaaggaatggacccgtttgtatgcgaacggtgcataatacgattggtggaaatgttagcttctttgaaataacatttttatgcaacataatgcggaaattcagaagaattaatgtttgaaggagtctgatagtag

SEQ ID NO: 618 - DNA, 404 bp, Gossypium hirsutum
  Clone ID: uC-gsronu33B019f07b1
ataatcatggacagccatatatgtggcacttgacaacgtggggatctggaacttgaggtctgagtactgggcaagacagtaccttgggcagcagctttacttgcgtgtatacacagattcaacatctctcagggatgaataccccatccccaagaatgctctcctctgcggtagggcagctggccgaagcacccgaccgctctaagccaccataggataaggaacgttgggtggtggatggatgaaagatgattgaagagagtaggagttttgcctcttaatctcaatgtatatatcattaatatttttattattgctcattttttctgttgctaggcatgtaatactttttgtaaaacccataagggacttttaattttaggggttcaatttttttttctttt

SEQ ID NO: 619 - DNA, 535 bp, Gossypium hirsutum
  Clone ID: uC-gsronu33B019f11b1
gtttacttcagcgtctatggatactggattgtattggagataagggactaggagtagtggctttgacatgtaaagaattgcaggaattgagggtttttccatctgatccctttggagctggaaatgctgccgtcactgaggaaggtttggtcctagtatctgcaggctgtccaaagctcaattcgctgctgtacttctgtcagcagatgacgaatgctgccctcataactgtagctaaaaactgcccgaattttatccgcttcagattgtgcatccttgaccccataaaacctgaccctgtaaccaatcagccattggatgaaggttttggggcgattgtccagtcgtgcaagggtctcaagagactatcactctctggccttctgactgatcaggtttttctttacataggaatgtatgccgagcagctcgagatgctgtccatcgcttttgctgcagacagtgacaaaggaatgctctacgtgttgaatggttgcaagaaacttcgcaagctagagatcagggactgcccctt

SEQ ID NO: 620 - DNA, 504 bp, Gossypium hirsutum
  Clone ID: uC-gsronu33B019g01b1
ccctctcgtccggtaacttttgcatcattgagggaccggagactgttcaagattttgtgaagatgcagcttcaggaaattgaagataatataaagagcaggcgcaataagatctttctcctcatggaagaggtaaggagattacggatacaacagcggataaagaatgtgaaagttatcaatgagaatggcgaagaagaaacagatgagatgcctgacattccatcttcaattccttttctctctcatgtgacaccaaagacaatgaagcagctctacttcacaagcctggcatttatatctggaataattgtattcggaggccttattgcaccaacactggagctggaattaggtctaggaggcacctcatatgaagatttcatatgcaacatgcatctacatttgcagttaagtaggttcgaccctatcgtggcatcctttaaaggggtgcctgggtgttatttcagcctgatgctattgaagccacaatgttgaacaacag

SEQ ID NO: 621 - DNA, 528 bp, Gossypium hirsutum
  Clone ID: uC-gsronu33B019g03b1
tggttagcattcccatcaaatgggcagcctgaagtgacatctgcttggcaaaccccagctgctgaaccagggaaggcagattgggaattggctttggttgagtcagctagtaacttgtcgaggcaaaaagcagctttgggtggtgggcttgatccattattgttgaatggcatgtatgatcagggaatggtaaggcagcatgttagctctggtcagttaagtggggggagtgccagtagtgtggcattgccagggccggggaagacaccggttttagctcttcctgcaccagatggaacagttcagaatgtcaatcaagacccatttgctgcgtcattgagcattccacctcctttatatgtgcaaatggctgacatggaaaagaagcaacatttacttgtccaggaacagcaggtatggcagcaatattaaaggatggatcaaggtcattctagtttggcaagattacaccctggatatatggacctgaccgatgccgtgacccttatggatgcccctgttatggat

SEQ ID NO: 622 - DNA, 346 bp, Gossypium hirsutum
  Clone ID: uC-gsronu33B019g05b1
ccctctcgtccgcccacgcgtccgcccacgcgtccgggtgatttagataaacgtcgttcaactacggggtatctgtttactcttgcgaaagccccagtgagttggaagtctaccttacagtctacagtagctgtgtctactacagaggcagaatatatgacagttacagaagctgttaaggaggctatttagcttaatggattattgaaagacttgggagttgttcaaagtcacattagtctatattgtgacagtcagagtgctattcatttagcgaaaaatcaagtctatcattcaagaaccaagcatatcgacgtaagatatcactttgtgcgggaagtctttg

SEQ ID NO: 623 - DNA, 574 bp, Gossypium hirsutum
  Clone ID: uC-gsronu33B019g06b1
ccctctcgtccggggtcggtgaaagataatggctccacacccaccttttaaaccatcttcaattgctcccctgcctcttccttctcctttcacccaattttcttaccaaccaaacatgtttgatcctaccaaagaactgcccaaatcttatgtcagtttatcggatcacttaactggaggattcagtgattgtaatgacagttatgatcgtgccatgaactacggtcccaaagtgcaaaaaactgctcaaaactacgcaaattacagcagttggaacaccttggaagggaggttcgaagttgaaacattgatggcggacgatgagtccggaatttccagtcctcctttatggaaatctagtcctcaacatgaaaacaacgttaattaccggtgtctatcgccatcgtcgagagctcaagccatagctagaggccaaaaggagcttatggaaatggttagtaaaatgcccgagtcttgttacgaactttcgtgaaagatctcgtggaacatcagcctgtcgttgttgtggaaccgaagcaggagagtttcgcccaaggagaggttcaaattcgat

SEQ ID NO: 624 - DNA, 404 bp, Gossypium hirsutum
  Clone ID: uC-gsronu33B019g08b1
gtgtatgatgtgccgacttgcctctctcgtaagagcaccgttttagggtcatcaaagcaaatggtgaagcaatttggcttctctggactcttgagcggccagcaaaaatccaatccagatttctacaattggaaccggattaaggttaggtactgcgatggatcatcgttcaccggggatgctgttgatcgagctaataatctctttttcaaaggaaacagcatatgggaatttatcattgctgatctactagcaaaaggaatgagaaatgctaaaaatgctattctttctggctgttccgctggaggattggcttcgatattgcactgtgacaggtttcgagctctccttcccgcttttactaaagtaaagtgcatttcagaagctggcttttttcttcatgc

SEQ ID NO: 625 - DNA, 485 bp, Gossypium hirsutum
  Clone ID: uC-gsronu33B019g11b1
cttttggccaacctcttgtcgatgactggaaatgcctcaagaaaatggtgaggactttcgaaacacattgtggatcactagcccagtacgggatgaaacacatgcgatcccttgcaaacatctgcaatgccgggattcagacagaacagatggctgaggcatcggcacaagcttgtgtcagcgttcctactggtcgttggagctctcttcagaaaggttttagtgcataaaaataccactggaattggcaaatattatcggccaaagcttggattatgtttgtacttgctgtgttttcttatatcccgaatggtccgaatgctgctgcattttgatgattattcatgcgatttcttatttctgaagttatgtaggagcaactctaataccagactgctaaatttatgtaaatatgctttaggatgtgttctatctcagacgacgatgtttgtatataatgatctatgaggaactatcataaatga

SEQ ID NO: 626 - DNA, 245 bp, Gossypium hirsutum
  Clone ID: uC-gsronu33B019g12b1
atcatgattttgacaaggtgcttgcaagacagaggccaacagtgagcaaagctgatcttgaggtccatgaaagatttacaaatgagttcggagaggaaggttgatagatttaatgtaacttttcacattgatctacactagttgtaagtgcaaacactgtattttatttataacttctggatcatcgaatgaatgtttgacacaatccgaatctcttgtttatacagtgtaaataagattataag

SEQ ID NO: 627 - DNA, 457 bp, Gossypium hirsutum
  Clone ID: uC-gsronu33B019h01b1
ctctctgggtctctctgtgtactgtcttccccttttccatttctcgtaaacaaagtccataacattcgtctctcagatcctttcctcttagatcatcaaatccattcctttttttcaccaaaacatgagggaaatcataagcattcatataggtcaagctggtattcaagtcggtaactcatgttgggagctttactgccttgaacatgaaatccaacccgatggaatgatgcccagtgacacctctgtaggtgtagcaaatgatgctttcaacactttctttagtgaaactggttcagggaaacatgttcctagagctgtgtttgtgggatctggaacctactggtgatcgatgaagttaggactgggacttaccgacaacttttccaccctgaacagcttatttctggcaaagaagatgctgccaataactttgccagaggccattatacaattg

SEQ ID NO: 628 - DNA, 513 bp, Gossypium hirsutum
  Clone ID: uC-gsronu33B019h02b1
caattgttggacctaacaggctaatcaaagagtctgagatcccaaatcttccatatcttagagctgtcataagagaaactctaaggcttcatccttcagctcccttgatcatcagggaatgtggtgaagattgtactgtgaatgggttcatggtgaaagctaagacccgagtactggtcaactgctatgctgtcatgagagaccctgattcatggaaaaaccctgatgaattcgatcctgaaaggttcttagacagctctgatgagaaaatcggagagcatcaaatggaattcaagggtcaaaactttaggttccttccattcgggagtggtcgaagaggatgcccaggagcttcacttgccatgttggtgatgcatgcagcagtagggtcgttggttcagtgctttgattgggaagtgacgggtgggaagaaaagttgaattaaacccaaggccaggattcgcttcagaaatggctcagccacttgtgtgctaccctatactacgttttaat

SEQ ID NO: 629 - DNA, 469 bp, Gossypium hirsutum
  Clone ID: uC-gsronu33B019h04b1
agtggaaaggagtccacaatgtttgtgcaatttattgggtaaaaacgcaaccgcagtggttgggatggacattgatatgaagagagctctgaatcttcccacggtttgtaatgtttccactcctcctgtgactctctgttcagtcatcaatcgtgccccagttgcaggtccaccacaaagcgaagaatctgtgtcaccaggtggcagcccttcaaatggaaacagaaatggagcagtcattggcttggcattcgctactgccattttgcacgcactttttgggatctattaatttcttttccccattactaatcatgtactacattattttaacattcaaatattctgtgtgtcctatgtatgcctttgtttctctggtaatggggggtaaaatacaatacaatacaacagatgaaacaaagaaaaacagcaaatccataagggacaaaaaatatggttctgattgcag

SEQ ID NO: 630 - DNA, 532 bp, Gossypium hirsutum
  unsure (1)..(532): unsure at all n locations
  Clone ID: uC-gsronu33B019h05b1
aatgttgggttgtggactgagatttgagggtatttttttcaactttttaccgcttatagtctttattggcctctatacctttctttctgtttgattttttgtttgtagttttgaatttttttcctcaaagtattatcttgatagtgattcaccaaataccagaaacatgagttttagtctaaagcaatccgctttagctgcatgcagtgatgtttcaaattcagttctccagcgaagatcactttcttgcagatcttcaattttacctcctttggttttccaaaacaattcgaaaagaacaaatctttcactgtcaaagcctttgcatgtttccgctgttgagattattgggaaggataaagaacccgtgatcaagtgcagggcttatgaagctgataagtcccagcctattcaggctgcagctagngaagtgaaatcagaagctgcaaaagggtgaaaattgggatttattttgcacttggtgggcttaaatgttgttttcatatttatacagaaggttttgatgcttacc

SEQ ID NO: 631 - DNA, 438 bp, Gossypium hirsutum
  Clone ID: uC-gsronu33B019h06b1
cccattcgtccgaaaagatcggtgatgactgtgaaagcatcttctgcaagtactgatggcgaggaacaggttccggcggaaagcaagaaggaagatttaccagtaggacaacttcctttagaatcaaagatgcagcagatggcggagcagaagatgaagatgaagatggcgaagaagataaggcttcgtagaaagcgacttgtccgcaagagaaagttgaggaagaagggacgatggccgccttctaagatgaaaaaattgaagaatgtatgaccttttgcttagtcgtttcaactttcttattcctactttgtagatcttatatactgttatgcagtgatgaccttaaagaactgaatctgctgttatccaatttcattatgaaaactgaaagattaatgcctaatgtgcttgcctgtttttggcatctcttatgcg

SEQ ID NO: 632 - DNA, 481 bp, Gossypium hirsutum
  Clone ID: uC-gsronu33B019h08b1
atttcaattgaaggtaccactgctatcaaagacgtacaagagcaaatggtgctacttactcggaacttcaataaagtcttcaagaagttgtcaagaaagaacaaaaagtttgatgtagccaaaaacaagataaaaggagtggtaattagtgaagaatctaacaaggagaaaaagaaaagaattcaatgccattaatggcatggatttagccgcataaaagttaaatgtgccaataccctaaaaaatctgtgtaacctggagtgatagagattcttcaagtagctcagatccagatgaggagctcgtgagcaattacgtgacgtttacttctaaagtcagtaatcttgatgctactgattctgagattgatattgatttagatggtgaatcaaatgccgattttctataaacctacagactatgttgcaaaatgagagtagggtatgagggtaacgccaacaaaatcactatgcaacatttg

SEQ ID NO: 633 - DNA, 470 bp, Gossypium hirsutum
  Clone ID: uC-gsronu33B019h09b1
gttattctcaattctcacacttgaacagcaaaagaaatcactttcacttttagttcagttctactgaggtttccatctctgaggacatggagagtcagagaggtcctcttcttagcttggcttacttctgtcaaggaaagacaatggaagagcttaggtattctcttttctatacgactatggagctggaacagacaaggatggcagttcaggaagagctaagaaagagagatgatcaattaattctactcaaggagttgctaagcaaggcaataagagagagggatgaagcacaggagaaatgccaaagactctttcttgagaaactcatgcttcatcaactgcagcagcaacaacaacaaaaacagcaaggtttctcctcttttggagtttctggcgttgaggatgaacgcataaaaggaatagactccaacaatggcttctcatcatctgactgtgagggaagcatc

SEQ ID NO: 634 - DNA, 506 bp, Gossypium hirsutum
  unsure (1)..(506): unsure at all n locations
  Clone ID: uC-gsronu33B019h12b1
ctttctctaactttcctggataaaccaaatccttttgaaacatcatctgaatttagcctctatatatttccagattcctcgctctgggtattattactctcttattcccttctcaaaaacctttcactctctcttcctcatcgtttcttcagagcttcagctccatcgcctgcctctttgcttcttcttttcttgttctatagtgtaatttcggtgatggaatcggcttgggtggatacgactctcgacctcaacatcaatccttcccataataccatcaaagttctgaagagagaatccagtggaaaactggctgattctgatgtgaaagtaccagttaaacaagagaccggagccttgttggaggaattgaaccggattagcgctgagaacaagaagctaactgagatgctaacagttttatgcgagcgctacagctctttgcagaaccaatacatggaattggtgagcaggaactcgngaagtgatgcaacagctgcaacatc

SEQ ID NO: 635 - DNA, 283 bp, Gossypium hirsutum
  Clone ID: uC-gsronu33B021a05b1
ttttatacgaaaggtttattatagagctgagggggacttttatgataagatgttgttatggggaaaagtagctatttttttaagtactgatatgggattgctttaactagacaacttaatactgtcaattaaatcatgtcagtatttcatgtaatagttttgatcattgggtttggtcgtacaatgagaatcaccttcaacatgtgattgttgccaatgttgaatttaaaatttgaatatttatattattaataaaaattttatttcaaaaggaagaactaag

SEQ ID NO: 636 - DNA, 323 bp, Gossypium hirsutum
  unsure (1)..(323): unsure at all n locations
  Clone ID: uC-gsronu33B021a06b1
tcttgtttgagcctagtgagttgacctcatggggtttttaccgagctggaattgctgagttcgntgctactttccttttcttgtatatctcggtgttgaccgtgatgggagttgttaaggacaaaaccaagtgtacaactgttgggattcaagggattgcttgggcttttggtggtatgatctttgctcttgtttactgcactgctggtatctcaggtggtcatatcaatccagcggtgacatttgggctgttcttgggtaggaaattggtcgttgacaagggcaatatactacatggtgattgcagtgcttgggagccatat

SEQ ID NO: 637 - DNA, 544 bp, Gossypium hirsutum
  Clone ID: uC-gsronu33B021a09b1
tcttggacgcgtgggctctcagctactttggctgtcataatttctccaattagctctggtttaggcgatggcttcaaagcggatcttgaaggagctcaaggatctacagaaagatcctcctacctcttgcagtgcaggccctgttgctgaagacatgtttcattggcaagcgactattatgggtccacctgacagtccatatgccggtggagtgtttctagtcaccattcatttccctccggactatccatttaagccacccaaggttgcattcaggacaaaggtctttcaccctaatattaacagcaatggcagcatttgcctcgatattttgaaggagcagtggagccctgccctcaccatatccaaggtattgctctcaatctgctcacttttgacggacccaaatcccgatgatcccttggtgccagagattgcccacatgtacaagaccgacagggctaagtacgagacaactgctcggagctggacccagaagtatgctatgggttagtgtgctaatatgcatataataggagggctt

SEQ ID NO: 638 - DNA, 551 bp, Gossypium hirsutum
  unsure (1)..(551): unsure at all n locations
  Clone ID: uC-gsronu33B021a10b1
tccacgcgtccgtccaactatcactctgtaggtttattgcattaaataaatcatgaaatctttccttcctttctttgcattcctctcacttctcctgtttgtagacaccattgcagcagctaggaaagatgctggagagtactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgttaatgaggagttcgaaccaaggccaaacatttcagcttacggtgatgacgctaatctaaaaggagataaatcatcatcttttgcagaagattttgaaccgagacctaacatttcggcttacggnggcgatgatgctggtcttaaaggacagaaagaatcattcactaaagattttcgatccacagccaaatatctccgcttacaataactaattaaaagcgaaacccaagtaccattggcttagacccacatcttccattaatttc

SEQ ID NO: 639 - DNA, 594 bp, Gossypium hirsutum
  unsure (1)..(594): unsure at all n locations
  Clone ID: uC-gsronu33B021b02b1
ttggtggtgctactcaaaattcaatcaaagttgcacagtggatgcttcaaattcctggggcaactggttacattggctgcattgggaaggacaagtttggggaggaaatgaagaagaactcaaaagctgctggtgttaatgttcaatatctcgaggatgaaactgcaccaacaggaacttgtgctgtttgtgttgttggtggtgaaaggtcactcattgcaaatctatcagctgctaactgctataagtctgagcatttgaagaagcctgagaattgggcgttggttgagaaggccaagtacttctatattgctggatttttccttactgtatctccggactccatacagcttgttgctgaacacgctgctgcaaagaacaaggtgttctcaatgaatctttctgctccatttatttgcgagttctttaaggatgcacaagagaaagcactaccgtatatggactttgtctttggcaacgaaactgaagcaagaaccttctcaaggttcatggcttggagactgatgatgttgcagagatagccctgaagatttcacagtgcccaaaagcttcttnaacatacaagaggactac

SEQ ID NO: 640 - DNA, 530 bp, Gossypium hirsutum
  Clone ID: uC-gsronu33B021b04b1
ttttaatgaaactttaagattatatggtctacaagaatggcttaataagagaagttgtaagagaagttcagattggaaatctagtgttacctgctaatatagatctttatattgcaaatgttgtacctcaacatgaccctcaactatggggagacgatgtccatctttttaaaccagagaggttcgcagaaggaattgccaaagctaccaattacaatgcagctgcattttgtccctttggaattggacctcggtcttgtgttggtatgagctttgcaaccatggaaacaaagattgcactctccatgattcttcaacgctataccatttctctctcccctgcttatgtccactcaccaatatctgttctcggcattcaaccagaacatggaattcaagtaatactcaaatcactggacagcaatgtttaatgtacatggttgctatgaattcaaggtttaaccttgctggtttatgaattcttgtttaagagattacatttaatatgttaattaaatgcttactttaaa

SEQ ID NO: 641 - DNA, 536 bp, Gossypium hirsutum
  unsure (1)..(536): unsure at all n locations
  Clone ID: uC-gsronu33B021b10b1
tccacgcgtccgattctccctcctcccaacccaatttgaagagagtaaaggaagatcccgaaactggggggttcatgaatttggatgaaaaccttttgtacgaggttctgaaacacgttgatgccaggaccttagcaatggcctcctgcgttagtaagctgtggctcaaaactgctagagacgagcgtctttgggagttgatctgtaccaggcactgggctaacatcggttgtggaacccaacagcttagatccgtggttttacctctcggtggtttccgccgtctccactcccgttacctttggccgctttccaaaccccaagctgcttcacctttgccttgggctccgcccaagattataaattccaagccgccggcacggtggggaaagaatgaggttacctttgtttgtctcttctcttatacagtatttgagaagatgcatttcacaagcaggcgcagataattgtagattggggtttttgnttttacgtttggattgggtcttattttcttatatttaccttgggatttt

SEQ ID NO: 642 - DNA, 386 bp, Gossypium hirsutum
  unsure (1)..(386): unsure at all n locations
  Clone ID: uC-gsronu33B021b12b1
tcgtaggctcttctacgctgcgcttcctctccgggtatgtgttcattggccctgtgctcgactttgttggctccatcaccatcgtcactttgctttacaaccttgacttcgtgtttgggtttaggagaaacaagcaaattgatgttggagactgtgaatcagggtgatcctactcgtacatgtaggctttaatgccctagcaaatgccatgcatgcggtactagattccttggtttgcttctctaattataagtatacgtgtgaagtgaagcaattcccgttgcttcactaataattaagtatgaaccccccccccccaatttgtaatgcaaatgatgaagtatatagctagtctctagctagcaactgagagcattcattcaana

SEQ ID NO: 643 - DNA, 267 bp, Gossypium hirsutum
  Clone ID: uC-gsronu33B021c02b1
tttgtttcgtgggcggacgcgtgggcggacgcgtgggtgtttgaagaatgctaccagtagttggcgaagaccattggaaagttcaaaatatagcaaatgtccatgtctacatcatcaacactgaacaacaatatttagccaacaagcttggtgattctaccttgttagacagcttaaattagaagtagaggtacaactttacagattacatttttaaatattattttaatagtgaattatattgctacgtgtatgtattttacatgc

SEQ ID NO: 644 - DNA, 267 bp, Gossypium hirsutum
  Clone ID: uC-gsronu33B021c04b1
tgttgtaattgagtattctctatttattttgggacgacatattaatcatgagattcgtttatggagaattaactatttttttaagtactgatattgtattgatttaacttgacaacttagtactgtcaattaaatcatgtcagtatttcatgtaatagttttgatcattgggtttgtttgtacaatgagaatcaccttcaacatgtgatttttgtaaattttgaatttaaaatttgaatatttatattattaataaaaattttattt

SEQ ID NO: 645 - DNA, 488 bp, Gossypium hirsutum
  Clone ID: uC-gsronu33B021c05b1
ttatatacgaaaatttcacatacataaataacaaggactcataaatataagatctttttctaaaacccagcataccccaattcctctttattcccccccccccccaccaaaaaaaaaaaaaactcccaaatctaaagagagactttcctcgcctacaaccctttcttcgtcttggattatgagctcgaaggcgaaacccactctcggtggaccgcggattaagacccgcaaacggaatattgctgcacctctggaccctgcagcatttgctgatgcagtagtccagatctatttggataatgctggtgatctggaacttgttgccaagaaccttgaatcttctgatcttaacttctcaagatacggtgacactttctttgaggttgttttcaccggaggcccgacacaaccaggcacaatcaaaccctgtgagggggagcgtcacccttactctgtaataaagtgtgaggctaaacgtgaaaccattt

SEQ ID NO: 646 - DNA, 352 bp, Gossypium hirsutum
  Clone ID: uC-gsronu33B021c08b1
ttatcggttcaagcttatgttagctaagatcaagatggctggggttgtcatgcaagaactcgcgaaattgaaaaaggagaaatcatcttgaaatgatacctgaatcacgaggatttgctagttttgtcattcaacattctgcaatgtgttctttcggaatgttttttttttttgtttgtttcaattaagatcagttgagtgcagtttcattggtctaagacagattttgtagtgaatttattgctagatttttgtttgtgaaaacttgtggtaatttatattggctgcatgagaggcataataatagtctctataagaacagcggtgtatttgtccttcctctgatggccac

SEQ ID NO: 647 - DNA, 569 bp, Gossypium hirsutum
  Clone ID: uC-gsronu33B021c09b1
tgttcttccacgcgtccgcccacgcgtccgccggcgcgttcggtaaaagaagaaattgaagcctgcggaggagaaaaggcggtggagtggaagcgaataatggagagaagctttgagaggatggatatggaagttcaacaatctacggtggactccgtagagaatccgaattgccgatgcgaactccaaactccacagtgcgatgccgtcggatctaccgctgtggttgccgttgtcactcaggataagatcatcgtagctaactgcggtgattcccgcgctgtcttgtgccaaaacggcgtcgctcttcccctctccgacgatcacaagccggatcgacccgatgaactgctccgaatcgaagaagccggtggtcgagtaatttactgggatggagctcgagttcttggtgttttagccatgtcaagagcaataggtgataattatttaaagcccttcgttataccagaaccagaggtaccaataacagagagaagcagcagagatgaatgtttaatattaggaagcgatggactatgggacgtggtgaccaacgagacagtttgtgg

SEQ ID NO: 648 - DNA, 232 bp, Gossypium hirsutum
  Clone ID: uC-gsronu33B021c11b1
tccacgcgtccgggttgcttgagttgcagccacgacattgtggactatatgtagcattgtctaccatgaatgccgacaaggagagatgggattgtgcagctgacttgaggaaagccatggtagaagcaggcttaaaaaaatttccagcttatagcttcattgattccatgtaaaaatcgtgtgaaaacagatgtctctattctttaactaatcacatgcattctgcagcagc

SEQ ID NO: 649 - DNA, 585 bp, Gossypium hirsutum
  Clone ID: uC-gsronu33B021d09b1
tttcttctctccctcaaactctgagaaacagaaaatcgtaatagaagatcatcgtaaataaagaaagcaagtaagcttccaacactcggcagcatttttgaattctgtaattggatgagggttactaacctgaaataactcaaccaatctccatcgttggacgcacataagaaacgaaactagagccagggatccgaatttcaaacaccaagatctaaatgacggatccgaatctggatctgcaagaatcgggttgggaggaactcaggagagaggctcgaaagatcgagggtgatctcgatgtcaaactctcttcttatgctaagctcggtgctaggttcacccaaggagatacctgggtcgccaaccgttgggtcaagtagatcatggaagtctatggaaatggaaattcagtcattgctcgagaaactgctggacataaatgatgccatgagcagatgtgctgcgtctgctgcttcaactacttcagtaacccaaaagcttgcaaggcatagagacatactacatgagtttactcaggagtttagaagaatcaaaggaaccataattaatgagggaacacgc

SEQ ID NO: 650 - DNA, 269 bp, Gossypium hirsutum
  Clone ID: uC-gsronu33B021d11b1
tcgttttatttcaacgaaaatatccacaggggggtcatcggatttctactttttccgaatccacagatccattttcacctatggctccagtagcagcaacatcttcagattctataaagcctagagatgtttgtgttgttggtgttgcacgtactccaatgggtggatttcttggctctctgtcatctttatctgccaccaagcttggttcgatagccatagaagctgctcttaaaagggcaaatgttgatccatcacttgtgcaagaa

SEQ ID NO: 651 - DNA, 549 bp, Gossypium hirsutum
  unsure (1)..(549): unsure at all n locations
  Clone ID: uC-gsronu33B021e02b1
ttaagtatatgatactatgtcgtgtaataaggggagattgggagcttcttcgttctggaagtggacagtgttatcctatcaatgaagattttgatagtggagtggatgatcttcagcatccaaagtactatattatctggaacatgaatatcagcactcacatttatccagagtttgttgttagtttcaagatctccaatgctgaagggcgtttgattggaagtgagactaatcatgctgtttcaggcgtcactgcatctactccaggacttcagggtcgtttaccagtattatcatctgccggtgaattggggagtattaatcaccaaacctcagaatcaggtggatcccacgaaaatgatcctagcctgggttcaaacacttcaaagacccctaaatctccttggatgcctttcccaatgttgtttgctgctatctcaaacaaaatccctcgntcagatatggatcaagttactaatcattatgaactattcagggcaaaaaaaataagtcgtgatgatttttgcaaaaaagctgaaattgatagtc

SEQ ID NO: 652 - DNA, 545 bp, Gossypium hirsutum
  Clone ID: uC-gsronu33B021e07b1
tttaactccccgcttctctgaatcccgggcggttttaatatgtctttcatttcttaaaagaccctgtcaagaacaaacctaaactatcatagcaggtgtttttggtttttctgaaagccaggtgatcccagaatagagatccagatttcccttttttgtttttgtttttcaatatttattatcatcagctaagagggtttatttttggtccctcaaggttgtttttttttttaatcaaactagtacctgttctttggttttggttaagatacaggtttttacctagttattgaatatggcagcagctatagatatgtataatagcagcagcaacagctcagttttctcagatccttttagtgcggagctgatgaaagcgcttgaaccttttatgaaaagtgcttcatctacctctcctttatcttcttcttcttcatattcacagtctaacctgtatcctgaatttttctcccatggaggacccatttgtgctcaaacaagggttctgtaactatcaaaacttgtgggttttgagcaaacaggtt

SEQ ID NO: 653 - DNA, 432 bp, Gossypium hirsutum
  Clone ID: uC-gsronu33B021e08b1
ttcatttagttggctttttttggtgtggggggtttagttaactcaaacgtttggtttatgtcggggaagttagggatcattgtacgatggtctacttgatattaatgtactattattttagcctttcaccgtatcgccaccattaagatgacgggccctatggggctggcggtgggcggacaattggtgcttaattccctacttgcttaccttccatcttttaagcattttgcttaagaggatgtttggagctggagactgtattgtggtgcttattattatttaatattcaagggttttgagaacattaatgttaatagctattattgtacgagatttttttttgaaaaattaatcagtttgcggtcaaacttgtatgggaattatatttaatgcctgggtttggaatcttgtgaatccttttttgctttg

SEQ ID NO: 654 - DNA, 177 bp, Gossypium hirsutum
  Clone ID: uC-gsronu33B021e09b1
ctagtattttgtaaaatctgttgagaggaaggatgggctttgctttgttaatgtggttggctaattatcgtggacttctggtatttcatgtaatacggacatatactgattccttgtgtgttttacttcgtccagatgtgacttcatgcactcaacctatataaagaggaggcttag

SEQ ID NO: 655 - DNA, 430 bp, Gossypium hirsutum
  Clone ID: uC-gsronu33B021f01b1
tttatccagaaggggagatcttttacatcgggggggttctttggattgctcctacggttccgcccgcggagaagaaggtagcggagaaccgtgagatagtgaaatggcgcatcaaagagggattggatttcaagctatacctccctcactaccgtgccaaagaggattggaaacgacattttgggaatcaatggacgagacttgagaagaggaaggccaattttgatcctatgtccatccttgcacctggacaaagaatttttaaaaggactaatcaataataataatttagtaggcaatcgtaatttggtgataacttcgcatatatatatatcaaatatatcatctattaattggtgagtcatctccattgaatttgcttgacaataaatgggggattatcaatgtaaaggaaaaaaaaattctaatt

SEQ ID NO: 656 - DNA, 469 bp, Gossypium hirsutum
  Clone ID: uC-gsronu33B021f03b1
tccatgcgtccgggaagagcttgtctgaaggggaaattgcaccttatgtagcctaggcagaaaagcgaaaggtcgagtatgaaaagaacatgaaggcctacaataagagacaggctgagggtcctaaagacgaagatgttgagtctgacaaatcagtgtctgaggtgaatgatgaggatgatgatgaagaaggcagcggagacgaagaagatgatgagtaggaaggtccgtggtggatagcataatcaatgtaggctgtgatagtgtttgatcaaaaccatatgttaatgctttcgatgtttccatgttattcttttagatgcgcatgccatctaagggagaaatgtacctctgaatcctgttgggtccttttgaccttctgaaattaatagttgtagatgggataatctgcttctatatgtactttttgaataaaagttgaatggcttagataaatcctttcgtagag

SEQ ID NO: 657 - DNA, 263 bp, Gossypium hirsutum
  Clone ID: uC-gsronu33B021f04b1
tccatgcgtccgcccacgcgtccggtaccggaggggcagcttacaaaaaaaaaaaattaaaaaaaaaattcgactttgttattagtttaccagcatgtgctccaataaactataagatttgggatactatatatttcaattctgatatttctttttctctattttcttttaatcctctctgctttcatctttgggtagagttttctgttattcgatgtccttttgttaaaaacgactgacaatgaaatttaattattgctgag

SEQ ID NO: 658 - DNA, 474 bp, Gossypium hirsutum
  Clone ID: uC-gsronu33B021f08b1
tttctgctccactaggatccaacactggagggggttaattaatagattcttctttaagaggggctgatatggccgacttgagaagcaccgctcttcgaagtagaaggtatggatccccttctcagtatcaaggcggagcaactggttctttcaggcctagttctacggatccaagctctagacctgcttccatcgatcctaattatagagcagatccaagctccagatctgcttccattgatcccagacctgcttccattgatcccaactatagagcggatccgggctctagagctgctcccattgatcccaattatagagtggatccgagctctagagtggcttccattgaccccaattatagagcggatccaagcgctagaactgctccgattgatcccaattatagagctgctccagagctgaagtataggggtccaaccctggaatctggtgggttttctaaacgaagag

SEQ ID NO: 659 - DNA, 247 bp, Gossypium hirsutum
  Clone ID: uC-gsronu33B021f09b1
ttataattattcaactgtggaattgttgataggatctgttggttgttgagtgactcggcatatatagtcgtgtgttgattaatagtggtatcattgtcacggtattggtttacagcattggccaatgatgcatggctgctgtactctttttttttttatagctcataattgttgtaattagaccatggttatattttctgacattcatctattgtttgtgttgctggtggtgaggctattctcttct

SEQ ID NO: 660 - DNA, 426 bp, Gossypium hirsutum
  Clone ID: uC-gsronu33B021f10b1
tgtaggatcatcctggtggtgatgagggccggttgtttgcaacagggaatgatttaagtgatgattttgaggatgttggtcatagtagcagtgctcgggcaatgatggatgaattttacgtgggcgatgtcgatacatcaactatcccaactaagaccaagtacacccctcccaagcagcctcactatgagcaggacaagacctcggacttcattataaagcttctccaattcctcgttcccctgctgatcttgggattggcctttggagtccgattctataccaaatcacctgcttaagtatcaagaccacaacccagaatggaaaaaacttctcaatattattattatgttaggttaaacgtttggttggaactgttacatattgagggatggttcgaaatactatatttactcgttctggtta

SEQ ID NO: 661 - DNA, 384 bp, Gossypium hirsutum
  Clone ID: uC-gsronu33B021f12b1
ttccacgcgtccgggcaaaagatcccgggcgtttctgttgatggtcttcctcattatgaaattgctgctcagatttgtcgtcaggctggtttggtgaaacgattggagaaggctggggatcttcttgaggatggtgaagaagataattttgccattgtgtttgcggctatgggtgtaaacatggaaactgcacagtttttcaaacgtgattttgaggaaaatggctcaatggagagagtgacccttttcctaaacctggctaatgaccccacaattgaacgtattattacttgctcgaattgctctcacttactgctgaatatctggcatatgaatgcgggaagcatgttcttgtgattcttacagacatgagttcttatgctg

SEQ ID NO: 662 - DNA, 532 bp, Gossypium hirsutum
  Clone ID: uC-gsronu33B021g02b1
ttgatcagtgcagagcagagagagaacgagcgagagattggggaagccacttgtatcaacaggggaattcttcaagaggagggacgagtggaggaagcatccgatgctcagcaatcagctccgccacgccacccctggcctaggcatcgccctcgttgccttcggcatttatctggtcggggagcaggtctacaacaggatttatgctccttcctcctctcatcatcaccaacaacaatcttcttctcactcccattgagatcaggtagatgctctatggaaagaacacagtttggacatggtcatgtttcagtttccctctgtaggttgctgtaataagcttcgtactgacataaaacggacttgcttcaagtttgattattgaaaccttggattggagctattctatggagctttatctggttccttctcaaggtgggatggttaatggactcattaatgtcatatctttcgaacttaaaaaattttatagtaagtgaattccaatcgtactgcgtagtttgcgatgctt

SEQ ID NO: 663 - DNA, 405 bp, Gossypium hirsutum
  Clone ID: uC-gsronu33B021g03b1
tccatgcgtccgcccacgcgtccggagaaagtgcttgaaaactgtgcatcaaagcttcaaccatacctaacccaagctgtagagaacttgggaatttcttttgatgattatagtagtatagttgcttctatatgtggggcgacagctggtgctgtagagcgggatgatgctgctgttggaaaacttgcggatgatgagaaaataccagcagaggcacctttggagaacgcagcccagggggataaaaagattcctaaagaagcagtttcaattgaacaagtggcccttgtaaatgaaaagactcccgtgccagttgcttgcaatggcattatgcgaactgctgattcaatctctgtaaagaagcaagaggatgatcacattgctgataagtccgagaatgaaaca

SEQ ID NO: 664 - DNA, 263 bp, Gossypium hirsutum
  Clone ID: uC-gsronu33B021g04b1
tcctttcgtccgcccacgcgtccggtaccggaggggctgcccacaaaaaaaaataataaaaaaaaaaattcgactttgttattagtttaccagcatgtgctccaataaactataagatttgtgatactatatatttcaattctgatatttctttttctctattttcttttaatcctctctgctttcatctttgggtagagttttctgttattcgatgtccttttgttaaaaacgactgacaatgaaatttaattattgctgag

SEQ ID NO: 665 - DNA, 559 bp, Gossypium hirsutum
  Clone ID: uC-gsronu33B021g05b1
tgttgtctttgtacagcctgcattgtatgaaggctgtggtttgacagttgtggatgcattgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaatttaagctgttaaataacatttgggccggttttttttggagaataaaatttggtttgtaatttcattgcagaagctcttttgaattcatcttggcttttccttttccttttttcgccggcattgtttg

SEQ ID NO: 666 - DNA, 358 bp, Gossypium hirsutum
  Clone ID: uC-gsronu33B021g08b1
tccacgcgtccgatcaactttaattttttatggcgtgggattatgttttgggtgtttgacaaagaaatttgtactcgatagttcacttaactagtgagctcattataagcaaatgctcatccagaccatgctcattcgttgtgcttttcataaatataattcatggtgattgttttgcttgtctaaaaaaaaaaaaaaaaaaaataaaaacatcacaaacaaaaaaaacaaaaataatgaaaaaaaaaacaaaaaaacaaacaaacttaaaataaacaaaaggaccccttaaaaaagggggggccccttttaaaggttccaggttttcttccgcgtgtttggaagcataaattttttt

SEQ ID NO: 667 - DNA, 155 bp, Gossypium hirsutum
  unsure (1)..(155): unsure at all n locations
  Clone ID: uC-gsronu33B021g11b1
tacccacccgtccttaacaccccaacctcctgacaaaaagggacggtttaataaacccaaccgcctattaacaccccnaaaaaagaaaatggccgaccaacttacccaacagcacaaccctcaaaccaaggaggcctttagcctctttgacaaag

SEQ ID NO: 668 - DNA, 384 bp, Gossypium hirsutum
  unsure (1)..(384): unsure at all n locations
  Clone ID: uC-gsronu33B021g12b1
tccacgcgtccgcccgcttgttcttctcttgattgcgttctatattgaggatggcttgtactaagagaactctggctttccttttgatgctggcttttgtaggagtctctcttggtgcagttcacaaagtgggcgattccaccggctggactagtcttgggaatattgactacctcaagtgggcttccaccaagaatttccatgttggcgactctcttctttttcagtacaaccctcaattccacaacgtgatgcaagtgacccacgacgatttccagtcatgcaacggaacatctgccatcgcctcctacacctntggatccgactccgtaaccctcaaaaggcctggccacttttatttcctttgcggtgttccaggccact

SEQ ID NO: 669 - DNA, 316 bp, Gossypium hirsutum
  Clone ID: uC-gsronu33B021h03b1
tttattcgtcccatgtagcctaccgatacggggagttatatttagctagcgctggtttatcatggccgtacagacggtataaagatctttgaagaaactgacactgactatgagctccactaatggtgggaaagaggcgaggccgccaaagggtgggactcgcttgtggaaatgcattggattgcgctacatgacttgcaatgacgctattgactgaacctacatgtagtataaatggccatttactggctctgctacaatccgggggaatatggtagccgggtcttgtcacacagccaagatggtcacgacaatc

SEQ ID NO: 670 - DNA, 519 bp, Gossypium hirsutum
  Clone ID: uC-gsronu33B021h04b1
tttttcccacgactcaaacctctcaaatctgtggggtttttaattccccatgcgatctacaccctaaaccaaaagtcatggccaccccttccgcacgtgaggaaaacgtttacctggcgaaactcgccgagcaagccgagcgctacgaggaaatggtcaagttcatggagaacgtcgtctccgccgtccctgcccccgacgaactcaccgtcgaggaacggaacctcctctctgtcgcctacaaaaacgtgatcggcgctcgccgtgcctcttggcggatcgtttcctccatcgagcagaaagaggaaggacgtggcaacgccgaccacgtctctgtcatccgggagtacagggccaagatcgaggccgaattgtccgagatttgcgccggaattttgaagcttctcgacgagaagcttgttccggccgccgggaccggggattccaggtcttttacctgaagatgaaaggagattaccataggtacttggctgagttcaagacttgcgatgacaggaa

SEQ ID NO: 671 - DNA, 406 bp, Gossypium hirsutum
  unsure (1)..(406): unsure at all n locations
  Clone ID: uC-gsronu33B021h06b1
ttcttatcaacgtaaatttgtagctntagggtgggttttataattgagggggtggcttaccaccataggagctgagaatttaaaacgatgtcggagaagttctcgccgactctcagaatcggagatctcagtgatttcatagcaccgtctcaagcctgcgtcgattctctcaaaggactcaaagcaacccctaagaaacctgaacctcaggctttagctggtaagagtcagcaaactgaaccagtaaaaatttcactcaaggattgcttggcatgtagtgggtgcataacctcagcggagactgtgatgcttgagaagcaaagcttagatgaatccctttcaaatattaataaagggaaagcgganattgattccctggctcccgcagcaaggggcctcccttggt

SEQ ID NO: 672 - DNA, 365 bp, Gossypium hirsutum
  Clone ID: uC-gsronu33B021h09b1
tccacgcgtccgatttctcgagaaaaggaagatgtctttaggttgcaattgcggttctagctgcagctgcggcgacagctgctcatgcagcaggaacctcaaccttggatactcggagaagacaaccagcactcagaccatcatctccggagtagcgccagtgaagatgacctttgagggaccagagatgagcactactgaatcaggacatggatgcaagggtggatcaaactgctcttgtgatccatgcaactgttgaaaagcttgatgaaagccctagattctgaaaaaagaaagcagcaaactaacaggcctctgtaatgatttattttcaaggatgaatgcctgcaaggcctatgactata

SEQ ID NO: 673 - DNA, 567 bp, Gossypium hirsutum
  Clone ID: uC-gsronu33B021h11b1
tcgtgccatgattactcgactgcaggaagagagggcatcgtttcaaatggaagccttgcagcacctgagaatgatggaagaacaagctgagtacgatatggaagcactgcaaaacacaaacgaccttcttgctgagaaagagaaagagattcaagatctagaagccgagctagagttttacaggatgaagttccccaatgaattcatgccggagggcatagtgaagtcagcatacaatttgcaaataacacgggacacaatggatcatttagaagctaatagtattgaagaaaaggcaatcttacatacagatacagttaccggaaaaccgaacatcggctccacagttgaagaaacatatcaatcatttgaggacacaaacaaagtcaccatgaagaatccattgtctgaacatgaacatgggtaccaagaagaactcattccttgaggctttatctacaaacactacgaagatgccctgaagagatgctactggccatgaattgtataggtatttcagagattggtttcttcttagaaaataatataggacatgattttaaaaca

SEQ ID NO: 674 - DNA, 514 bp, Gossypium hirsutum
  unsure (1)..(514): unsure at all n locations
  Clone ID: uC-gsronu33B021h12b1
tccacgcgtccgctctcggccagcctgcgagcgacggtggaggcaagtgtgcctcgtctccgtcacggctccaaacagaaccctacgaatccgcacgcctctgaaccggagaagtggccaccgactaggtcgacgccggtcaacggtgttcgtaaccaaaaaacaacgaagtttccaggcctttatagccgaaaggaaagaaaatcaaaataaaaaaatacaatttccatcctttcccttttgctgtgctgtggttttttgttttcttttgcacgtacggagtgcgtggcggcgtacggaggctgtgctggcgacgggggttgctggtcgtacggggcgagggctggggcgtgcgtggggagctgagcggcgctaaggtttttcttccctcctttggctgaaaatgtttaggataatcgggctagttgggctttagggcatttgggtctaggtttgggctttaatgatggactatagngttggggtttattctttggacttttggtttaataat

SEQ ID NO: 675 - DNA, 291 bp, Gossypium hirsutum
  Clone ID: uC-gsronu33B027a04b1
ctctatttacctggcatatcaatcccatcagaccttttcattaccccagtgcacattgaaaaatcaaaacccattgaaactctcagcataatcaaaattctagaacactttcttcagccccttcatttcttctccacctctcctcacccactacctccgtccacctcctgtcttcagccaccgtctctaccgcactaggagataccagctttcggatgatcgttcgagaatcaccttcaaccttaatctccctcaaccctagttgttaccccaactttagcgcctgaagac

SEQ ID NO: 676 - DNA, 406 bp, Gossypium hirsutum
  unsure (1)..(406): unsure at all n locations
  Clone ID: uC-gsronu33B027a07b1
ttggtgatgtcggcaagggttgtgctgctgccttgaagcaagccggtgctcgcgtcattgtcaccgagatcgatcccatctgtgcccttcaggctctcatggaaggacttcaagttttgacccttgaggatgttgtctccgaggctgatatctttgtcaccaccactggtaacaaggacatcatcatggttaaccacatgaggaagatgaagaacaatgccattgtttgcaacatcggtcacttcgacaatgaaattgacatgctcggtctcgagaattatcctggtgtcaagcgcattaccatcaagcctcaaaccgatgnngtgggtcttccctgaaaccaacaccggcatcattgtgttggctgaagggacgtctcatgaactgggggttgtgctactggcca

SEQ ID NO: 677 - DNA, 97 bp, Gossypium hirsutum
  Clone ID: uC-gsronu33B027a08b1
tccacgcgtccgttttctctgtttcgagtgttttaatattttgcaaacgatcgcatacacttagtaccatgtgtgggtactcttgcatgccatggtc

SEQ ID NO: 678 - DNA, 246 bp, Gossypium hirsutum
  Clone ID: uC-gsronu33B027a11b1
gttgtagaagcagctgcgtgagcttcctaagctacctagggtttccttcattcgaaaatgatttacgacgtcaattctcctctcttccgctctttcctcagccagaagggaggctcctccgacaagagaaaaatggaggagcagaagcctaaggaacagagacccaaagcaaatgagaataagcctgtcatgacagagtaacagctgcttttgtttagtatgaatggcaagtttggggatgggttg

SEQ ID NO: 679 - DNA, 355 bp, Gossypium hirsutum
  Clone ID: uC-gsronu33B027b01b1
ttctttacaacacactctatggaagaagctgatgttttaagtgaccgtataggaatcatggtaaaaggtagactcagctgccttggaacctcgatcaggttgaagtcacgattcggtactggtttcattgctaatgttagcttcactggaaacaacaatggacttagccctcccaacggagatgcagctgacacaacacaccaacgggagtctgtaaaacatttctttaaaaaacatctagacgtggagccaaaggaggagacccaaaatttcttgactttcgtcattcctcatgatcgagaaaagcttctgactggattttttaaggagcttgaagagagagcaggagcatttg

SEQ ID NO: 680 - DNA, 396 bp, Gossypium hirsutum
  Clone ID: uC-gsronu33B027b05b1
ttcacgcgtccgcccacgcgtccgcataatgcttgaaggagatctgatggaggaatacaaaagcttcgtgattacaatccaaacttcccccaagagcgacggtaaaggcagtatagtgcactggactctggattatgaaaagctgcacgagggtattggacatcccgagtctctgctccagttctttatcgaactcacagcggacatggctgctcatctccgcaaggaaacttaattaatggatagaccatggcaagaaaatcccatgtcgaatcgtctgctattactattactatcagtactgatctaagaataaaactggcagctttgtactgtgttttcatttgaatatttgtatgctaggttctgattatgctgttatgagtggtcggagcg

SEQ ID NO: 681 - DNA, 308 bp, Gossypium hirsutum
  Clone ID: uC-gsronu33B027b07b1
acccacgcgatccttctgtacagcacactgtctggcagatgctgttgttttaagtgtaccgttaggaatcatcgcaaaaggtagactcagctgccttggaacctcgatcaggttgaagtcacgattcgctactggtctcattgcttatgttagcttcactggaaacaacaatggacttagcccttccaacggagatgcatttgacacaacacaccaacgggagtctgtacaacatttttttaaaaaacatctagatctggtgccatatgtggtgtcccaatattttttgacttttgccatttcccaat

SEQ ID NO: 682 - DNA, 287 bp, Gossypium hirsutum
  Clone ID: uC-gsronu33B027b08b1
atccgttcactctctcaacctaactacaatgactaagagaacgaagaaggccggaattgtcgggaaatacggtacccgatatggtgccagtttgaggaagcaaattaagaagatggaggtcagtcaacacagcaagtacttctgcgagttctgtggaaagtatgcagtgaagagaaaggctgttggaattctggggctgcaaggattgcgggaaagttaaagccgggggtgcttatacttagaacactgctagtgctgtgaccgtcaggagtttcattagaaggttg

SEQ ID NO: 683 - DNA, 58 bp, Gossypium hirsutum
  Clone ID: uC-gsronu33B027c02b1
tgatgtaaccctttaaaagcctttgtttggaacatacaatatcctccattggtagaca

SEQ ID NO: 684 - DNA, 55 bp, Gossypium hirsutum
  Clone ID: uC-gsronu33B027c03b1
tccactcgtccgagttctagatcgcgacctagatgaatgacaagacacatagaaa

SEQ ID NO: 685 - DNA, 125 bp, Gossypium hirsutum
  Clone ID: uC-gsronu33B027c05b1
atacttagtaagcgcgagtcatcagctcgcgttgactacgttcctgtcctaaggacacaccgcccgtcgttactacctattgaagaagcggaggaagcttttttataatttaaattgccgggaca

SEQ ID NO: 686 - DNA, 89 bp, Gossypium hirsutum
  Clone ID: uC-gsronu33B027c06b1
gtcacttatgatggagctaccatcttaaagtgcctgcacattgacaacccagcggcaaaagttttgattgacatttttaaagattaaga

SEQ ID NO: 687 - DNA, 62 bp, Gossypium hirsutum
  Clone ID: uC-gsronu33B027c08b1
ttcttattcgctgagggcaccccgctctggattgttgtacttaaaaaagcgcctgataccat

SEQ ID NO: 688 - DNA, 312 bp, Gossypium hirsutum
  Clone ID: uC-gsronu33B027c11b1
tcgtggtcatagggggacacgctggtatcaccattttaccgctgctgtcaaagacgaaacccactgttagatttactgatgaagaagtggagcaactactgtcagaattcaaaatgccgggacagaggttgtggaggcaaaagcaggtgcagggtctgccaccctgtccatggcctatgcagccgcgagatttgtcgaatcatcccttcgcgctttggatggagatggagacgtctacgagtgctctttcgtacaattcgatctgaccaatctttcattctttgcatctaggatcaagcttggaaggaatgt

SEQ ID NO: 689 - DNA, 91 bp, Gossypium hirsutum
  Clone ID: uC-gsronu33B027d02b1
ttaatcctatgattctgtgaccactatcattacagtagaatggcaaaggaactgtgaccactattgggatctctgtgatgttatctttttt

SEQ ID NO: 690 - DNA, 178 bp, Gossypium hirsutum
  Clone ID: uC-gsronu33B027d05b1
ctcttgcaaatggttgaccctcccaactcacctctctataaccccttccctcggccgtaaaataaccggaactctctttggccatcgccgcggtcacgtcagcttcgccgtccaggacgatcctcgctccgaaccggttatgctcctcgaactagccctgtcaacggttagcatggtg

SEQ ID NO: 691 - DNA, 96 bp, Gossypium hirsutum
  Clone ID: uC-gsronu33B027d07b1
tctcgactcaacccacgcttacatcatactacagcaatccttcaagcacattactacggaataaatggcgttttcacccattatctcccagcaaag

SEQ ID NO: 692 - DNA, 344 bp, Gossypium hirsutum
  Clone ID: uC-gsronu33B027d09b1
aaaggttatcatgaatgtttaagagtggttcagggtttattttgaagctttagatgaaagtttcaatagaacaagcaacgaaaagttgatgcttgaacgagccgccggccgggccatcgttgacttagtggcttgttcgccgtcagagtcgatagagcggcgtgaaccagccgcgcgttggtcaaggcggttccatgcaagtgggttcagtcctgtgggtttgagtgatgaagtgtgtgatgatgtgcgcgccttggtgagaaggtataaagatggttggtcgatgacacaatgccctgacgccggaatatttttgtcgtggaaagatcaggtgggtggttttg

SEQ ID NO: 693 - DNA, 381 bp, Gossypium hirsutum
  Clone ID: uC-gsronu33B027e02b1
gccctttcaacttatcaaacaatgcttaataccttggatggaactcgtgatgagacaggtgctagccttaccccttgggccatttggaccagggcttggactgctgaagaaaacaggcatggtgatctgcttaataagtatctctacttgtctgggagagtggacatgaggcaaattgagaggacaatccagtacttgattggatcgggaatggatcctcatacagagaatagtccttaccgaggattcatatacacttcgttccaagaaagggcaacttttatttcccatgggaatacaagcaggctgccataggagttgggggatattaacttggctaaatttgtggtagcattgccttagatgagaagcgccacgaga

SEQ ID NO: 694 - DNA, 330 bp, Gossypium hirsutum
  Clone ID: uC-gsronu33B027e03b1
ttttgtgataaacatgctatatctcagaaactggtgcgattcatgcctgtagtggagttcaggaaatctaaagttggatgatcacaaacattttgtttgtttccatgatttagtaggtcttaaaatgttgggaaattaggcactgcaggctgaactttgtaataatataaaaaaagaaagaaatgttcaagtattgtgtgtaaatagtattgatagggccttttaagttatgatacccatttatgaaagttttttattgtaatttattccccctttttaaggtttttttttaaattatgtagctattataatattatatgagtctgttct

SEQ ID NO: 695 - DNA, 357 bp, Gossypium hirsutum
  Clone ID: uC-gsronu33B027e04b1
gcgctgtgtcaaaatttcaaagagccaggcgtgtcggagttcctatcagccatggctgccggctggaactcgaagctgatagtggaatcgtggtcgtacgggagtcccatagcaaccagcgtaggcctcgccgtagcggcgcgtcacacgtgcggaagacacatgtgcgtagtcccggatgaacggtcaagattgggctacatcaaggccatggaggaatccgggaccttgtcatcgacggcggtgatcgtcggagaagcggaggaagtgatggtaggggctccacgagtgggatttctgggtcgtggacttaaagcgataaggatctcgctacggttttaaaggtgtgctaaattg

SEQ ID NO: 696 - DNA, 341 bp, Gossypium hirsutum
  Clone ID: uC-gsronu33B027e05b1
gcgttgacttagaagtggatctatttatgctgcgacggtgactggtgttatcggtagaaaccgttcgaggtaacagagatttagtgttctgaaattgaaagcgaaatgtgtccaaaggacagatatggttattggtcggttggttcccggatgttggaaacaacacgttaccggtatattcttgaagaagcaactgattatattgccgcgcttgagatgcttgctacggccatgagcgctcttgctgatttgatttctgggtcctgttgcatcaactgtagctaaccggcgaccagccagtgacaccttttttttgcttaattcacaagcatcatcctctt

SEQ ID NO: 697 - DNA, 350 bp, Gossypium hirsutum
  Clone ID: uC-gsronu33B027e08b1
ttaagaaccaaaagaggctaaccagctcttgcaagttacaaatatgacttagcacttgtatttgtacggaatacttattattttccctaaaaattacgggcagaattgttcgatttaaattgtgggttaacccgcccaaggttttacactcctatgattaaattgatgtggtgtgaggctcacagcaatacctggatattcatcgctagagatgcctaggacctttaatggtccttaccgaggattcatatacacttcgttccaagaaagggcaacttgtattttccatgggaatacaggcaggctggccaatgagaatgggcatattaacttggctcaaatttgtggta

SEQ ID NO: 698 - DNA, 503 bp, Gossypium hirsutum
  Clone ID: uC-gsronu33B027e10b1
tttttatttctccctgactgttgcataacaaataaccagcaccatcttgtggatctcctgatttttttccatttgcatgtcaagtagcttgtgaggctaaaatttccacgtatttattggtttctctattcttcttgttcgcttcgttttctttgtaggtgccatggcatttgatgtagaatatgcacgatggctggaagagcaaaaccgacaaattaatgagctgagaacggcagtaaattctcatgcaagcgatgcagaacttcgtattattgttgatggtgtaatggctcactatgatgaaattttcaggttgaagagcaatgcagctaacggctgatgttatccatttgttgtcaggcatgtggaaaacacctgccgagaggtgtttcttatgcttgggggtttcacgtcatctgagcttctaaagctttttgtagatcaattggagcctttgaccgacaacagttggtggggataggcaacttgcagcaatcctccca

SEQ ID NO: 699 - DNA, 259 bp, Gossypium hirsutum
  Clone ID: uC-gsronu33B027e12b1
acactatgttacctaccactatgagaaatgctcttcgtgttaaactgaagccgtttgcaaagtctttaactgcatcaatatacgatgcttcccttgcagcggagtggagcttggcactagtgcggattttggaatggttggctcctcttgctcacaatacgattaggtggcaatccgagcataaccttgaagagcagcatataatttctgggtcaaatatacttttggtacagacactacactttgcggatcaagcaaa

SEQ ID NO: 700 - DNA, 448 bp, Gossypium hirsutum
  unsure (1)..(448): unsure at all n locations
  Clone ID: uC-gsronu33B027f03b1
ggaaatagcagccgcaaagactgcctcaacctctcctctgttctttatgccgaaactctcctttttcaactttgatttagacgaagtgaaccaagaggtcgacgtcgtgcctacgttggtaaggatttcctttctcccttttatttttttttgtttggtgtacataagaaacaaagaatcaaagaaatcaaaaagaaaagagaaaaaatgacggaaaaaatcaccttaaaaaaaactctttgcttcgattttccgttcgtattcaatatcccaaaaaaagccccctcttagattttacaaatcggctttctattggncgaatctaggattaaaaaataatatttctctattttccctattctcgtgtattctggtactgctgattttgctgtgcttgcagttacacctagctggagcnatgaacgctggcgcacacgcgcagaggcac

SEQ ID NO: 701 - DNA, 456 bp, Gossypium hirsutum
  Clone ID: uC-gsronu33B027f04b1
ttgagtttgaagcttcaagtgccaaaatctagggatttgcgggtggagaagacgagagcccatctctctgcttcaaagctcctgtccaggtagaattctcttcttcccttgcgttgtgttctttcctgttcaatcgccatggcttcaaagcggattttgaaagaactcaaggatttgcagaaagatccacccacttcttgcagtgctggtccagtagctgaagacatgtttcattggcaagcaacaatcatgggaccctcagatagcccttatgtgcaggtgtgttttttagttactatccatttccctccgatttatcctttcaagcctcctaaggttgcatttaggaccaaggtcttccatcccaacatcaacagcaatggaagcatttgtcttgatatcctcaaagaacaatggagccctgcactaaccatttccaggttctgctctcaatct

SEQ ID NO: 702 - DNA, 539 bp, Gossypium hirsutum
  Clone ID: uC-gsronu33B027f06b1
gtttgactcacgagcaagagaaagatgttgataaactcataactcgtttggttaccaaggaagaagcacatgttgcactgatggagctcatgaaatggagatcagaagggttagaaccactctatgctcaagccgttcaagttaaacaacgggactctgtgaccggaaaactgaagatcgctaacccccaaagcagtaggctggtatgggaaacttgtcttagcgagtacaaatcattgggaaaggttgcagtgaggcttatcttcttacatgcaacatgcatgcgggtttaaacgtaactggtctttgatgaagtggtatttgtgtacacagacactcacggataggccttgaaagggctcaaaaaatgatattcattgcagctcattcaaagctcggcagagggggattttgccaacgaggaagaaaagtacgcggatcttttatgacggcggtgagggatggcatcctaatggagtcttacagatgcacataagtgaaagctttttttctttaactctttgagattgaaactttag

SEQ ID NO: 703 - DNA, 429 bp, Gossypium hirsutum
  Clone ID: uC-gsronu33B027f07b1
gtgaacggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcgccgccgccacttcttcaccccgcgaggaaaatgtctacatggcgaaactcgccgagcaagccgaacgctacgaggaaatggcttgagttcatggcagaaaggtctctgcctccgccgacaacgaggagctcaccgtcgaggaaaggaaccttctctcgtcgcttaaagaatgttatcggcgctcgcgtgctttctggcgcatcatttccttcattgagcagatagaggagagctcgtggtaacgatgaccacgtcgctacgatccgtgattacc

SEQ ID NO: 704 - DNA, 479 bp, Gossypium hirsutum
  Clone ID: uC-gsronu33B027f08b1
tttgatcaattttttggtctcggttccgagacacgaagaactaagactcatatccctgatccttatgggatagaaatcggtagccctactaagattccatcagggtttgtagaaacatgggggttgaacgtccatgctatcgatacaaggggagtggaagataggatgggatgtaccgaatgtcggtgcaatttgtataatgttaccaaggaggaaaatggaacacctttgagcccaaattatgatgggggactattatgttgctatgatggcacaaaatgtaggttgaaagatgggtttattggcatcgaaagaaccctttaccttcaatacaccgtgaagtgggtcgatatgaatagcttaattgtaccggtgaatgtttataatttcgcagtttctgatacttggaagagatctcgtaattcaactgggatagattcagagcacacttgccaggtggagtatcatgttgaatcttg

SEQ ID NO: 705 - DNA, 223 bp, Gossypium hirsutum
  Clone ID: uC-gsronu33B027g01b1
ttgctatgagggacgcgatcgaaggaatgaacggtcaaaatcttgatggaaggaacataactgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaggtggatacggaaacggtggggggat

SEQ ID NO: 706 - DNA, 122 bp, Gossypium hirsutum
  Clone ID: uC-gsronu33B027g04b1
gcgttcattcgtccggcaaatcctaaggaatagaagaaaaatggcatgatacgacagagcgattaccgtgttctcgccggacgggcatttattccaggtggaatacgcccttgaagccgttc

SEQ ID NO: 707 - DNA, 287 bp, Gossypium hirsutum
  Clone ID: uC-gsronu33B027g07b1
tcgttcacgcgttcgcccacgcgtccgcccacgcgttcggaggaattcgaatattgtgagggttcctagtgtttggtgtatgagtttttttttcttagaggacagcaattggctttttagacgttgaagaataaatggcccattgttctcttgctatcatgccacctcatctaaacatcttctttccttcccttttacctattaattttgattccacattgcattcgggggcacaattacttttcaataccataagtaatgtaatgctaaatacttcacttttgatt

SEQ ID NO: 708 - DNA, 303 bp, Gossypium hirsutum
  Clone ID: uC-gsronu33B027g09b1
ataggatgacacgcgacgcaataacacgtttatagggggagcggattataattgactgtcaatccgtgtatggccgtgacactgagagaaaggtaaaggttacttggaagatcggcgtgcggcatataacatggtacccatattgtgtgacagcattgctggcaaaaactacactattgtatgagccaaacacttgaagctgaagcatttgctggtcaaaagattgctttgaatgtctaaaataaagtcagtttagcctttattcatagagatggttttttattttaattttcaattaggcct

SEQ ID NO: 709 - DNA, 118 bp, Gossypium hirsutum
  Clone ID: uC-gsronu33B027g12b1
tcaagaagtcacaagtttttaccacttatcaggaccagcagactaccgtctcgattcaggtctttgaaggtgaaaggagtctcacaaaagattgtaggctgttgggacaatacgatct

SEQ ID NO: 710 - DNA, 263 bp, Gossypium hirsutum
  Clone ID: uC-gsronu33B027h02b1
cccacgcatgcgtttcatttgacaactattgcaatcaccggcgccggtatcaaccctgctcgtagttttggggccgctgttatctacaaccaggacaagccatgggatgatcattggatgttctgggctggaccattcattggtgcagccattgctgcaatctatcaccagtttatcctgagggcagctgctgttaaagctcttggatccttcaggagcagctctgccatgtaattaagcaatcattctccagccacaagttt

SEQ ID NO: 711 - DNA, 64 bp, Gossypium hirsutum
  Clone ID: uC-gsronu33B027h08b1
gtgcattttgaaactattcaaaacaccgggggcggtataaaggtgttatagtggttgggacccc

SEQ ID NO: 712 - DNA, 89 bp, Gossypium hirsutum
  Clone ID: uC-gsronu33B027h09b1
gcgctgatgtaagctgatatgactgaggctacgtgatagacatttatataataaaatatctttcggcaaaaaaaaaaaaaaaaaacaaa

SEQ ID NO: 713 - DNA, 313 bp, Gossypium hirsutum
  Clone ID: uC-gsronu33B028a02b1
ccctctcgtccggtgaactaaaaaaggagttaaaaatggcttgtcctccaactcacaaagtggtaaaaggtgagcttaagaatggttctgatgactgccttgcgagcttgatgtattcgaattaccaaggtgctccggtaacgattaaaaaagattcattacccactccatttgcgcagaatatgatggtcgacggtctgtacggaggcctggtgtatgatgttgttagggttaagtggattattctttggaccactgattgtaaggtggctactaagatcattccgaccgaaaaccatattgtttgggagga

SEQ ID NO: 714 - DNA, 358 bp, Gossypium hirsutum
  Clone ID: uC-gsronu33B028a06b1
ccctctcgtccgcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttgggtacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccactttaggatgtctacaagattggtggta

SEQ ID NO: 715 - DNA, 161 bp, Gossypium hirsutum
  Clone ID: uC-gsronu33B028a07b1
atggtgatgtggaaaaggtgcgagtacgacgtttgttatttaattatatgagcaataccaagccacctatctatatactaatttgtgcaaagcctttgtttaaagttccgaatatctaatttttaaatataatttaatataaactatttataaaaaataat

SEQ ID NO: 716 - DNA, 106 bp, Gossypium hirsutum
  Clone ID: uC-gsronu33B028a08b1
cgtactgcctactactactgcttctactacctaagataattaattatctgcgcaaaaccaagctacctttcttcgtcctcatctgtgcaaagcctctgtttctagt

SEQ ID NO: 717 - DNA, 83 bp, Gossypium hirsutum
  Clone ID: uC-gsronu33B028a12b1
cctaaatcgagaaaaaattgcaacttaagtccgttcatttcaccttcttcttccttttcttcttattgtttgcatttaatatt

SEQ ID NO: 718 - DNA, 483 bp, Gossypium hirsutum
  Clone ID: uC-gsronu33B028b01b1
cggtcgcgtgggtttcagtataaggactcagtttcatcagccatatgtggtcctatctgtctccggctgaacaacttatcgctatcacggatgggagcttttgagaaattattgtgggttcaaatgttagatctcagccacaatgaactacaatcaattgaaggattggaagctatgcagctcctctcttgtttgagtttgagaaacaataaactgagaagtttaactgctctggagcctttgagaaagctcaagttattaagagtactggatatttcatacaaccagattggcgatcattctattgacacaacaaggtacttgtgctcttctcctttgtctcattcagttggaggtgaatcgaacaaggatgaaaccgtgaccagggatggtgctcttattgacaattgggagggcttttatttttttaaagaccttaacttggatcaattagaagtaggtggggaacacaattgctgatta

SEQ ID NO: 719 - DNA, 99 bp, Gossypium hirsutum
  Clone ID: uC-gsronu33B028b03b1
cctttgctcggaacagaatcctcaggctcactccgtattcgtgcaccagtcagagccacctcaccagaaaaagagatcttcggagtcagactttttctt

SEQ ID NO: 720 - DNA, 289 bp, Gossypium hirsutum
  Clone ID: uC-gsronu33B028b04b1
cggtcgtgtggggtgaacggcacttgcacaaatattcgtttcccccctttcaatgcccacttttctctttcggattttcttgctatacaatctccttctcgactatttggtccccagaaagctcaaatctttcctctctccttcttgtactaccaccaccccctttgtttctgtcggaggtgaaaccgaaaagaacccatctccggcagttgcattggcatcggtctcccctcgctgtcctctaaaaagaatggacgctgctgagttgaagagggttgtcccatctgtt

SEQ ID NO: 721 - DNA, 287 bp, Gossypium hirsutum
  Clone ID: uC-gsronu33B028b10b1
cgcgcatgcgtggggtgaacggcacttgcacaaatatttgtttcccccctttcaatgcccacttttctctttcggattttcttgctatacaatctccttctcgactatttggtccccagaaagctcaaatccttcctctctcctttttgaactaccaccaccccctttgtttctgtcggaggtgaaaccgaaaagaacccatctccggcagatgcattgtcattggtctccccctcgctgttctcttaaatgactggacgctgcttgaattgaagagggtgttccaa

SEQ ID NO: 722 - DNA, 417 bp, Gossypium hirsutum
  Clone ID: uC-gsronu33B028b12b1
gaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagcttcgattgttgagaatataa

SEQ ID NO: 723 - DNA, 470 bp, Gossypium hirsutum
  Clone ID: uC-gsronu33B028c01b1
cccatctcgtccgcccacgcgtccggtcctgttcaaactcagatggctgtggcagtgtttaatagtcctcttggaggggaatatcctaggaacaatgcggtggaagagaaacaacctacccgaagaagacgggtttttgttcagactgagaccggctgtgtcttgggcatggagttagatcgcagtgacaatgctcatacggttaagagaaggttgcaggttgcccttaatttccctacagagcaaagctcgctgacttttggcgatgtggagttgaagaatgatcttagtgccgttcggaatgattctccacttttcctgacacggaactatctccatagaagcttctttactccttgtctttcgcctactgaaagggacccttcgcagagagataggagtggtcctaatgagatactggggcattctgatagctttaacgtattaaaaattctggttaaggatgttgt

SEQ ID NO: 724 - DNA, 469 bp, Gossypium hirsutum
  Clone ID: uC-gsronu33B028c02b1
cccactcgtccgagtggcttgacgttcccctttgctcccttcttccagaagccaaaagtttgagttaagaacaatggcttttgctgcaatgaagccgacaaaacctggtttggaggagtcccaggagcagattcacaagatcaggatcactctctcctccaagaatgtgaaaaaccttgagaaagtttgtgctgatttggttcgtggtgccaaggataagagactgagggttaaggggccagtgagaatgcccaccaaggttcttcacatcacaacaaggaagtctccctgtggtgaaggaacaaacacatgggatagatttgagctccgtgttcacaagcgagttattgatcttttcagctcccctgatgtggtcaagcagatcacatctatcaccattgaacctggtgttgaggtggaggttactattgcagattcttaaatatgcctcacttatatgctttttggc

SEQ ID NO: 725 - DNA, 183 bp, Gossypium hirsutum
  Clone ID: uC-gsronu33B028c04b1
gtgcaaattattttttatatgccacgaattaaatttatcagcagagaaataaacggggggactccctcaagaaaaccacatcagatttcagatcctgcttccaagctctgcagaatgtactgtgagcagaaagcggtaagcaactttggtgctgtcattatcatagctctttagcctgttttt

SEQ ID NO: 726 - DNA, 183 bp, Gossypium hirsutum
  Clone ID: uC-gsronu33B028c09b1
tgtgttgatcagtctgcaaggcacgtggactcgtagacgatcaagggactaaactgtacattgccactgatggaagggcatggcatgacctgccacttccacctggatactgtggcaatgtgttatgcactgactccccagaagctgcgcttagtgatctactgttaaagctaacatggtacc

SEQ ID NO: 727 - DNA, 68 bp, Gossypium hirsutum
  Clone ID: uC-gsronu33B028c10b1
cctgcgcgaacgaatataaataagccacaattgaggggttttcttcaacgaaacttacgggcccaccc

SEQ ID NO: 728 - DNA, 477 bp, Gossypium hirsutum
  Clone ID: uC-gsronu33B028c12b1
gtgatgaagaacaacataggcttttggtctatgagtttatgggaaatggttcattgtcgaacttccttttcggagtgttacggcctagttggcaaaaaaggttacaaattgcatcaggaattgcaaaaggcctcgcatacttgcatgaagaatgcagcacacagatcatccattgtgacattaaaccacaaaacatactcttggatgattgtttaacggccaagatatctgatttcggattagcaaagctgttgatcaacagcaaaactcaaacgctgactggcgtacgagggacgaaagggtacgtggcaccggaatggttcagaaactccccggtcacagtcaaggtagacgtttacagtttcggagtgatgctgttggagatcatatgttgcagaaaatgtgttgaagtggagatggatgaagaagcaatattaacagaatgggcattcgattgctacaatgaagggatgatgg

SEQ ID NO: 729 - DNA, 293 bp, Gossypium hirsutum
  Clone ID: uC-gsronu33B028d01b1
ggtgttctcaaaaggattttaaccgagagaggtatcatgaaggaagagacactagaagaccatctaaaaagtttgatttcatcttcaccggtgatgctcttcatgaagggtacccccgataatccaagatgtggcttcagctctaaagttgtcaacgccctaaaagaggaaggcattgattttgggtcattcgatattttaaccaatgatgaggttcgacagggattgaaagtcttttcaaactggccgaccttttctcagctttattacaaaggtgagcttatcgtaggttg

SEQ ID NO: 730 - DNA, 348 bp, Gossypium hirsutum
  Clone ID: uC-gsronu33B028d02b1
gaatcgctgagtttgttgctaccttcttgttcctttacatcactgtcttgactgtcatgggtgtctctcaatctaagaccaaatgtactactgttggtattcaaggcattgcttgggcctttggtggcatgatctttgctcttgtttattgtaccgctggcatttcaggtggccatattaacccagctgtgacctttgggttgttactggcaaggaagctgtcccttacaagggcagtgttctacatgatcatgcaatgccttggtgctatctgtggagctggtgtagtgaaaggattcgaaggagacagtagatatgagatgttgggtggtggagccaatgttgtga

SEQ ID NO: 731 - DNA, 285 bp, Gossypium hirsutum
  Clone ID: uC-gsronu33B028d03b1
cccattcttccgataaacggtgcgagcagacacaggaatgcacatgaggatagacaccgtggacacctctggatatgaacaagagagctcgctctttgcaacaggatcagacgtcaagtgatgtaaagcttgtccgcgaagcggacaatgccaaagaggagagcactcactacaggtttgaccacggacacagctaatgttggagcagtggttcaagaattcactggaaatcctgcaccaccatttttgggttcatcatcatatttctcgaaggcttgacctttt

SEQ ID NO: 732 - DNA, 174 bp, Gossypium hirsutum
  Clone ID: uC-gsronu33B028d04b1
ccctctcttccgaccactcgtccgggcagtggagggcctgctatcgacttcatacaccgcaaccaccccagagcctgcgttggagatctcgctgtgtacataagcttactgctggacttcgttatgtccctgtcctacgacgttaaccgcctattatgtgggactggacctaac

SEQ ID NO: 733 - DNA, 321 bp, Gossypium hirsutum
  unsure (1)..(321): unsure at all n locations
  Clone ID: uC-gsronu33B028d07b1
ttcctttccagcaaaaaaaaaagcanaaaacaggacatcactgtcttgactgtcatgggtgtctctcaatctaagaccaaatgtactactgttgttattcaaggcattgcttgggcctttggtggcatgatctttgctcttgtttattgtaccgctggcatttcaggtggccatattaacccatctgttacctttgggttgttactggcaaggaagctgtcccttacaagggcagtgttctacatgatcatgcaatgccttggtgctatctgtggagctggtgtagtgaaaggattcgaaggagacagcagatatgagatg

SEQ ID NO: 734 - DNA, 73 bp, Gossypium hirsutum
  Clone ID: uC-gsronu33B028d11b1
actaattctgattgcataggcgaagtcctacatttccttttttttacactttactaccaatcatccccattct

SEQ ID NO: 735 - DNA, 320 bp, Gossypium hirsutum
  Clone ID: uC-gsronu33B028e01b1
caatattggcccttttaaagtctttgctccattctcattacaagacaatgagcaaagaagggcagctataatagcccaattttacctgggcccagttccataaccaaaacaaaaccaaaaataaaaattgagtctaaaatataaagagtccatttacaataaataagcccaaattacttaaaaaccactacccaaactttacaagcccaaacagcccataaccgaaactagaaacagaaaccctagcccccacactagcctccaaagaagccaccagtgtatgagcctaagccaccaaagccaccggtttacacgccacc

SEQ ID NO: 736 - DNA, 151 bp, Gossypium hirsutum
  Clone ID: uC-gsronu33B028e03b1
ccctctcttccgcccactcgttctcagacactagggcgtgcaatctacttcaaggaccgtaggcaccctagagcctgcttaacagacctagctcgttccttcacctgattgattgacttcgttaataccgtgtccgctgacagtgctggcc

SEQ ID NO: 737 - DNA, 135 bp, Gossypium hirsutum
  Clone ID: uC-gsronu33B028e04b1
gcctctcgtccgaccacgcgtgcgcgcagacttgggcatgctctctagttcagggaccgtaacggccccacagccttcataacggacttagctcgttccgtaagctttataatttacatcgtgatgagcctgtct

SEQ ID NO: 738 - DNA, 414 bp, Gossypium hirsutum
  Clone ID: uC-gsronu33B028e08b1
cgtacaaaaaaatgagcaagaattgggggtgttttttactacttagaccgcagtccccccccattttgaaattcatttctatggtattttttttgtaaattaattaaataatttctttaatttattcttttattcttactatctaagtttttattattttctatttattattattaaaacaatatattttttacatttttatatctattattttcttaaataaacccatatttatattttattaataaaatttattttttaatttaattttattttaaatatctatttaatatcatctctatatattatacatatttaatattttaactaaataattattatctatattatattttacacgaattattttttaagaatgtattaatatatattataaataaataaagtatctat

SEQ ID NO: 739 - DNA, 174 bp, Gossypium hirsutum
  Clone ID: uC-gsronu33B028e09b1
ttctctcgtccgaccacacgtccaatgacacttgggcatgcaaactactttaaagaccgtaacgaccttagagcctgctaaacagacctagctatttccatacactttatgattgacttcatgaagtccctgtccaatgatagaactgaccaaagccgtgcgatagggcctaac

SEQ ID NO: 740 - DNA, 442 bp, Gossypium hirsutum
  Clone ID: uC-gsronu33B028e12b1
tttttgcgttcgctaccactataaaaaatgctcttagtgttaaactgaagccgtctgcaaagtctgtaacttcattagtatgctatgcttaccttgcccaagatcggagcttggcactagagcggatttcggaatggatgggtcctcctgataacaatactattaggtgacactcacagcataaccttgaaaagcagcatataattcccgagacaaatatactttcgggacagacactacactctggggatcaagcaaaaactgaggcaggtatcaaggatcttcttgatgaacttaataacctgtatagcactggcggcgcccacaatgacaaagctttaacagaatctgatgtcaatggtagctcccaatataagatcaaaagggatgacaagagatgacactcatcttagggaaagattcatgaatgccaccccgagac

SEQ ID NO: 741 - DNA, 256 bp, Gossypium hirsutum
  Clone ID: uC-gsronu33B028f02b1
caaattggcagtcacgaacatggcattggttcagccactgtaactaattatatttatagaaggtgtttcttaacgtaaaaccactgcccagctctatactacataccatacatacactcgaccgcgggctaaacctatagagaaggccgaagttgccgatggtatatagaacgaggctcgcatggaagcttcactgctttaattacagagccacaactggttcgataacgagtgtgatggagcaggactttgggac

SEQ ID NO: 742 - DNA, 207 bp, Gossypium hirsutum
  Clone ID: uC-gsronu33B028f03b1
gcctttcttccgaccacgggttcgcggagaccagggcgtgatcactagtacaaagaccgcagcggcccccgagcatgcaaaagagacgtagctagatgcctaagccgtgcgaaggacttcaagaataacgctgtccgccgatggtaacgacctgagcggggcgcaagagacacaagatgtgcaagtatacaacaagagcctgagtca

SEQ ID NO: 743 - DNA, 58 bp, Gossypium hirsutum
  Clone ID: uC-gsronu33B028f07b1
ttctctcgtccgggcacaggtgagaggagaggggggcttgcaagaaactttagagacg

SEQ ID NO: 744 - DNA, 118 bp, Gossypium hirsutum
  Clone ID: uC-gsronu33B028f08b1
ttctctcgtccgatcactggtgcgtgcagacgggggcgtgctcacaagtacaagcacggtatcgatcttatagccttcgttaccgatgtagtgagttccataacctttgtaatgtact

SEQ ID NO: 745 - DNA, 169 bp, Gossypium hirsutum
  Clone ID: uC-gsronu33B028f09b1
ttctctcgtccgatcactagtgctcacagacgtggtcttgatcacgactttaaagtccgtaacctgcttttgccctgacaaacggacgtgggtggatacaggaaccttcttattgacttcgagaggtgcgtgcctcatgatctctgtaacctcagagcggctgtaggac

SEQ ID NO: 746 - DNA, 216 bp, Gossypium hirsutum
  Clone ID: uC-gsronu33B028g01b1
ctttgctgataattggatctattgggttggtccattggttggtggtgggttagctgggttgatttatggtgatgttttcattgggtcatattctgccgccccagcttcagaagattatgctcaaaagtttgaaactctgaaactgcttgtttatggcttttgtgtcaaatgctttgaatgcttttgatcatggggatttgatgttcgtgggcgttt

SEQ ID NO: 747 - DNA, 172 bp, Gossypium hirsutum
  Clone ID: uC-gsronu33B028g02b1
ccctctcgtccgctccacgcgtccgcccacgcgtccgcctggagttgtttcttgtgctgatatccttgttctgtctgctagggaaggcatcgattcgttgggaggcccttatattcctctcaaaactggaagaagagaccgtagaaggagccaagcatatgttgaggaggag

SEQ ID NO: 748 - DNA, 61 bp, Gossypium hirsutum
  Clone ID: uC-gsronu33B028g04b1
gcctgcttccgacaaaaagtgagagaaaaaaaggttctgcttttatctaaaagaacgccca

SEQ ID NO: 749 - DNA, 128 bp, Gossypium hirsutum
  Clone ID: uC-gsronu33B028g05b1
gccatgcttccgagcacgcgtgaggggagagatgggcgtgcatgatactacagacaccgccgaggccccaatcccagccattagagtttgtgtgatgaaaataaagccttgtttgtacatgtttattt

SEQ ID NO: 750 - DNA, 191 bp, Gossypium hirsutum
  Clone ID: uC-gsronu33B028g07b1
tctctctcgtccgaccacacgtccgcgcacacgtgggcgtgaaaactactatagagaccgtagccaccctagagcctgcgagacagtcctagctagatgcataaactttatgatttacttcgtgatgaacctatccgacgatgtgactgacctatgaggggcgatagggctcaacgatacgcaggtttaca

SEQ ID NO: 751 - DNA, 63 bp, Gossypium hirsutum
  Clone ID: uC-gsronu33B028g09b1
tttattcgtccgaaaacccgtgagtgcaaagggggtctttttaaatactaacaaacccaaacc

SEQ ID NO: 752 - DNA, 488 bp, Gossypium hirsutum
  Clone ID: uC-gsronu33B028g11b1
ttttctcgtccgataaaacgtgaatggagagtgggtctttcttacaactatagaccccgttaccccctttaataattttattattttctcctatactttatttaattatttgtattttataattttaattatttttttattatctatttactattttattcatatttaattttatatttattattttttattaattttctatttttttcatatttttttttttatatacttctttttttatattatactatttttttttaaatttctttatacttttttttttttttactctttaatatttctttttaattataattttttttattttttctttttatattctttttttttaaatcttatttatatttatttttctttttaaatatatttatattttttcttaattattttatttataaatttaacttttcaatattttttacacatttatattctttatctttactttttttattttatatattatt

SEQ ID NO: 753 - DNA, 419 bp, Gossypium hirsutum
  unsure (1)..(419): unsure at all n locations
  Clone ID: uC-gsronu33B028h02b1
aaatttgctgctcactttctccttcatcaaaccccaaaaacctagctttgcctcctttttaatttcttggattttggtgaactttatgaatccaagatcagagtaaaggattcgagttttaaccccagaattaagtacatctgctctttttgatctttgggttgaaattgtctacacaaagagggtgatttagaaatggatgctgatccatggactctttgtctttcttcaactgctaggagatatcaatcagctcttcagtcacgatctgatatgtttatggngtttgaagaaatggatggagaagacgatgtaagagaggagtttccatgccctttttgttcagagtatttcgatatcgtgggcttgtgctgtcacattgatgatgaacatcctgtggaggctaacaatggggtatg

SEQ ID NO: 754 - DNA, 55 bp, Gossypium hirsutum
  Clone ID: uC-gsronu33B028h10b1
tctattcgtccgaaaattatggaccttaatattatttatacaaaaaaaaataaaa

SEQ ID NO: 755 - DNA, 59 bp, Gossypium hirsutum
  Clone ID: uC-gsronu33B029a03b1
ggtacgttaatatgataatgactgccaagaggagcatgataaaatcggtagaggtcata

SEQ ID NO: 756 - DNA, 173 bp, Gossypium hirsutum
  Clone ID: uC-gsronu33B029a04b1
cgtgtgtatttgcttcatgtatcaggtacggtagcgatcgccataactgatgctccaagcattggcagcatgccagcttcaggattgatggcatgcaaaccagcagtgacccctcccaaccctccgccggccacgtcaacttgctgctccgccctctcccacgctgacatgcg

SEQ ID NO: 757 - DNA, 299 bp, Gossypium hirsutum
  Clone ID: uC-gsronu33B029a05b1
cccacgcgtccgaaataatatctgctcgttcttatcctgctcgctactctccactcaaatggcgctatccttaaccatcagcaatggcatcagtagcagtagcaatgcaaatgggggcccaatccttcccaacaaccagctacctttcggcctccctcatcgccgcaacgtcctcttcccaatctcccccagaaccttccacttgacctccgctgcaaaaagttctcttcccgaaccggacgcttcgatagcaagaaccggaggagcaatctcaccacaaaagaacaaggatggggaca

SEQ ID NO: 758 - DNA, 237 bp, Gossypium hirsutum
  Clone ID: uC-gsronu33B029a07b1
ttgcctacgcgtccgaaaaaaaaaaaaaaaaattttattatatattaaaaaatataattataaaaaaatacaaatttaaaatatattttatattattttttctttttttcttacttggtcttctcctttttgtggttccatgttctacttcttgtgtctgcatttttattttttttttttagttttaccaattttttattcttctgttcttcttttttattctctttctttttcttt

SEQ ID NO: 759 - DNA, 94 bp, Gossypium hirsutum
  Clone ID: uC-gsronu33B029a09b1
tgcctacgcgtccgctctgcttctccggggaacatgcacaatgtattggtaggacatcgaacttttgagaacatgatgaccataatgtctatta

SEQ ID NO: 760 - DNA, 228 bp, Gossypium hirsutum
  Clone ID: uC-gsronu33B029a11b1
tgtcttcgcaaataatatcgggttgatgttatcctggttgctacttttcaatcaaatggcgctatccttaaccatcagcaatggcatcagtagcaagtagcaatgccaaaggggggcccaatctttccaaaaaccagttacctttttgggcttccttaatagtcggaacggtcctttttccaaatcttccccaaaaccttccacttgacctccgctgccaaaaagttc

SEQ ID NO: 761 - DNA, 572 bp, Gossypium hirsutum
  Clone ID: uC-gsronu33B029b02b1
gattttacttgtacccctagcagagagagaaaatatacagaggaaaagaaaagaaaacttagaacgagcttcgtgggtggagcttgttttcgttgcgtttattattattatttctgatattcccaacacagagaaaggaagggatggagagcgattcagcgatggtggcatttccattgctgacaacgcccatcgaatccaattacagggcatgcaccattccttacagattcccttccgataatcctcgaaaggctacccctactgaaattgcctggatcgaccttttccgcaattccattccctccttcaagaagagagctgagagcgatactaccgtggttgatgcttcaactaaagctgagaaatttgctcaaaggtatgctgatatacttgatgacataaagaaagatccagaaagccatggcgggccacctgattgtattcttctctgccgacttcgtgaacaggttcttagagaaactgggtttagagatatattcaagaaagtcaaagatgaagagaataccaaggctatcttcctattttcagatgtagtcggcttaatgatg

SEQ ID NO: 762 - DNA, 401 bp, Gossypium hirsutum
  Clone ID: uC-gsronu33B029b04b1
ccgtactgttagtttgcatacacatcagctaatgctgtcatcaaggaagtcatggaatacgagcagagaattcatatcattgatttccaaatagcacagggtacccaatggatgtaccttattgcagctctttcaaaacgccctggtggccctccatttatccgatttattgttattgatgcttatcttttaaattattctttcattttttttctattatttttctcatttcatttatttttttattttcttttactttttcttttattttcttccttttttcttatttatttttctttttttttctatcttattttcttatatttcattcattttcattatctcttttatttctctaaatattttttttttaaatatcttatttttttattcttcatttt

SEQ ID NO: 763 - DNA, 210 bp, Gossypium hirsutum
  Clone ID: uC-gsronu33B029b05b1
cctacgctgccggagaaagaagcgaaaagagtcctttttttgtgggttttgttcgcctttaacaatgaacgaaggcatggtttttgttggtcgtttcgcattgattactacaccattatttatttatatttcatacttataacaaacatattttttttaatgctttcgtccgagccaactactcctaaaacattctttctaacacttttt

SEQ ID NO: 764 - DNA, 291 bp, Gossypium hirsutum
  Clone ID: uC-gsronu33B029b07b1
agcgcatcacgcgcgagaaagtgaacggttccaccgtcaacgttgggatcaacccatccaaggttgtcatcaccaagctgaggctggacaaggataggaagtctttgctggatcgtaaggctaagggacgcgccgctgctgataaagataaggggactaagttttcagctgaggatataatgcagagcgtcgataaggttgtctttttttttcccttctcaatcatgtgttttgcaactgttgaagttttagttttatggagttttatttttgttttgtttttatgctatt

SEQ ID NO: 765 - DNA, 110 bp, Gossypium hirsutum
  Clone ID: uC-gsronu33B029b09b1
tcgcctacgcgtccgcccacgcgtccgcatatctcgacggaggattatacttttattatcagcattctggttggaaactattgttttattactgccttcactcttttttt

SEQ ID NO: 766 - DNA, 449 bp, Gossypium hirsutum
  Clone ID: uC-gsronu33B029b10b1
tgcttacgcgtccgccgccatatacacccaaaccgccggttgtgaagcctccaccggttgtgaagcctccgccatatacacccaaaccgccggttgtcggcgttcgcgtttaggaacatcagtttgacgaagatcgagtcacggccacaccgtaaccggccgatccggttagtcgacgacgccaatgtaggaacggcgaagcatttcgaatacatgttttacgtggatttcgaagcgtcaatggtggaggtcagagttcaaatcgcgttggtggtggttcatgaattcacctcttttttgaggtgttttaggtcgtttctaatggatttgacatcttcttattatttattgtgttgtttccttatctttttttttttctttatcatcttctattatttttttttattacattttttatttttctatattatattttttttttttttttc

SEQ ID NO: 767 - DNA, 434 bp, Gossypium hirsutum
  unsure (1)..(434): unsure at all n locations
  Clone ID: uC-gsronu33B029b11b1
cttcattccacatctcttttatgtttccttttactcgaggaggtaaaataaatatagtagaaatttggaactcaattaagtttatgtttgttaaaactatgcaggttttcggattgatgactaaaccattagttaggatcttgcttccttctccaaaacatctctcgagaatgctttcgtccgagccaactactcctaaatcattcttcctaccacttctcaacaatgggcaagaatctgaggctgaacaaggcaaccgaagcngtgatccgngccgtccagcttaagaatgctcttgaccactccttccccaccgtgcactattattggagaaaattcgatgatgccttcatgcgacctgtattcgtgaagggggtttcgtaccatttgtccccggatcacccactgaacaaaacggccttcagtggcaatga

SEQ ID NO: 768 - DNA, 166 bp, Gossypium hirsutum
  Clone ID: uC-gsronu33B029b12b1
ccgaccggaatcgaattccggcccagaccacgcgtctgtttttctaacctactttctcgaaaaagtatatgttttaggtgaacgcggatccactgacctgctggacaactgttcagcagcagaaccttaaccaggaattcggagaagacaaccagactcagaccat

SEQ ID NO: 769 - DNA, 436 bp, Gossypium hirsutum
  Clone ID: uC-gsronu33B029c01b1
ccattctctagctcccaaggtaaatatgccgatcagaaacatagcagttggccggcccgaagaggcgactcaccccgatgctcttaaggcagctttggctgagtttcatctcaaccttgatctttgtttacgtcttttcttctcttatcattgattcttaatccctctcttcttttttttttccttcttttttctattctttttatattctttttctttataatattactttttttctctttaatttttctctttttttttttcttttttatatttttcatcttttttttcttatctttttcatctttattcttttctctttcttttcttctatatttcttttccttttatatctatcttttttacttcttttcttttttatttttttctttcttactttttcttcttctttcacttctttaaccttcttttcttt

SEQ ID NO: 770 - DNA, 400 bp, Gossypium hirsutum
  Clone ID: uC-gsronu33B029c06b1
cttactttttcgcccacgcgttcgtccacgcgttcgcccacgcgtccgaaaaaaaaaaaaaaaaataaaaaaaaaaataaatatttattatatatttttttttttttatcttttatttttatttatattatttaattttttttatttttttttttttttagtttgtttattttaatttatttattctttattttttttttatttttttttattatttttttatatattttttattatttatttattattttattttttttgtatttatatatttattatttttttttttttatttattatttatttaattttcatttatatttttttttttttataatttttatttatatcttattatacattatttttattattctttattttattatattttatatta

SEQ ID NO: 771 - DNA, 159 bp, Gossypium hirsutum
  Clone ID: uC-gsronu33B029c08b1
tcgtgtcttttcattaagaaagatcaatttaatgttcttccaaattcagaggtgttaaaaccactgccatagaattggcagaaggatttatttttttcttacttttgattttcatttattttgtttacttatattttcatctaattttttttttttcat

SEQ ID NO: 772 - DNA, 180 bp, Gossypium hirsutum
  Clone ID: uC-gsronu33B029d08b1
tcggataattgggtgctgtgccgtatattcttgaagaaaagaagtgctaaaaacgatgaagaaggcctgcaatcttgcaaccaaagaattggtaaattaaggacaagcaagcctgtctttatgatttcccgactaaagacaggactgacttaaacctagccctttcttccttgtcatttg

SEQ ID NO: 773 - DNA, 556 bp, Gossypium hirsutum
  Clone ID: uC-gsronu33B029d09b1
cccacgcgtccgctttcctatgacagatgccaggcatattaaggcaggactgtctgtattggccaaatacaagagacctttactcgtacattccgagattcaatcacttgttgaaagccacttagaaactaaagatggtggtggtgatcctcgatcatattcaacttatcttaaaacaaggccaccttcttgggaggaggcagctgttagagaacttttgactgttacaaaggacacaaggagcggaggtccggcagaaggtgctcatcttcatgtggttcatttgtctgatgccagttcttccttagatcttataaaggaagcgaaaaggagaggtgacagcataactgttgagacttgccctcattatctagctttttcagccgaagaaattcctgatggagatactcgtttcaagtgtgccccacctatccgtgatgcagccaataaagaaaaactatggaatgctttatggaaggagatattgacatgctgagttctgatcattcaccaacagtcccggaacttaaaactctgaatgatggtaacttttgag

SEQ ID NO: 774 - DNA, 988 bp, Gossypium hirsutum
  unsure (1)..(988): unsure at all n locations
  Clone ID: uC-gsronu33B029d11b1
ttggatccacgcgtccgcccacgcgtnntaaaattttttaatttaattttatattttaaataattctatattatatattaaatattattttatatttttattattatttttaattttttttaatttttatattatttttttttaatctttaaattatttataaaatatatttatattattttatatttattatttttaattctatattttaattatataaatatattctatatttatttttatattttataatatattttttattttataattttttcttttttttttttacttttaaatataattatattattctattattaatctttttatttatttattaaattttatcttaattaaattaattattttatctattatattatttttatatatataaattttataattaattctatatttttattatttttattttttatttatattttattaatttttttatatttattattaattaatttctcaatacttttatatatttaattttttatattatattttatttatatattattcatattttttaacatttatctatttttacttatattttaatattaaatttattattttattttattattataatttttttattataatttatattaatatataatttattaaattattaatttataataatttttaaattttatattataattatttattatatttatatataatttaatattatataattttatttatatatattattttctttatttaatatatatatttataaaatattacttatttaaatataactttctatcaaataaatctatttatttaatcttttaatattattattttatttttcaatacttatatttcttatatatattatatataatttatttataattttatatctatttatttttattataaataatataataattcaattaatttaataaaatatataattatttattatcttatattatattct

SEQ ID NO: 775 - DNA, 104 bp, Gossypium hirsutum
  Clone ID: uC-gsronu33B029e01b1
cgtacgcttggggctttctctggaaaggacccaaccaaggtggacaggagtggagcttacattccttagaaaaatttcaataagaattgcttctaatttcatat

SEQ ID NO: 776 - DNA, 56 bp, Gossypium hirsutum
  Clone ID: uC-gsronu33B029e02b1
cccacgcttccgaggattgacagactgagagctctttcttgattctatgggtggtg

SEQ ID NO: 777 - DNA, 172 bp, Gossypium hirsutum
  Clone ID: uC-gsronu33B029e03b1
tttctctattactgtttggtttgggttttctattttttgatcgatgttgttactgttctcttaaaatcataaaaatggaatgaagtatctttttttcataattctatataatttttcatatatatttttattattaattatatctatacttataatttattaactctacttt

SEQ ID NO: 778 - DNA, 98 bp, Gossypium hirsutum
  unsure (1)..(98): unsure at all n locations
  Clone ID: uC-gsronu33B029e04b1
cttttncttccagcaaatccaaatatggctgcatctgctccttctgatcatcttgtttacaagggtgaactcaaaggtcacaatggttgggttacatc

SEQ ID NO: 779 - DNA, 64 bp, Gossypium hirsutum
  Clone ID: uC-gsronu33B029e07b1
tcgcctacgcgtccgcccacgcgtccgcgctccttctcgctgcgatttcgtctttaagatctca

SEQ ID NO: 780 - DNA, 355 bp, Gossypium hirsutum
  Clone ID: uC-gsronu33B029e09b1
tcgaactgtgaataagtgaattgacatccaagcgttccattccatttccgtatagttcaaaaacacttgagtaccttcgatcatattttagtgtcaaaaatggccgaggagcataccagtaaggcccctgagttggagagcaacgttagcggtgaaggagcagtggagagcatggaccgagggttgttcgttttttttgagtagtatgtatttaatacctatactattatattttaattcttttttcaattataatttaacattcttattttatctttctttttacttttttctttttctaattttttctcaatattcttatttttatctgtacatttttttctctatctatatt

SEQ ID NO: 781 - DNA, 124 bp, Gossypium hirsutum
  Clone ID: uC-gsronu33B029e10b1
agtgcttccttttttttttttctctccttttccaccgccgtcgatctcgatccttatcctcgttttcaaacaagctcgaaaaagatggccaacgctgcatcggtaatggctgttcatgaatatt

SEQ ID NO: 782 - DNA, 606 bp, Gossypium hirsutum
  unsure (1)..(606): unsure at all n locations
  Clone ID: uC-gsronu33B029e11b1
ctttatttgaaagaccgccctcgtaatctcgatttctccgtagacccgacagaaaaaggtcaaaggcgagactatctctagcgatcaaatatgttcaggctttacaaaggtttcaaggagctgttagcttcctctgcaacggcgtcggtaccgtcgacagcagccaagttttatgctgctgctgctgcgaaatcagcttctccaaaagtggctcagaaaactccgaaaaagccgaccgcttcaaaacccaagactaaaaaaccagctgctcttcgatccgagactcgacccagngggatttctaaagttacccccggtttctcctgctttgggacagttccttggagcgcaacaggtntcccgtacttaagctgtaagcagattctggtcctatatcaaatcccaaaacctccagaatcccaatacagnaagggagatcttttgcgatgagaagcttaagaccatttttaatggaaaagaaaggtaggtttcctggagattggaaaatgttacccctactttgtgagactacctgctaattctctattggccctggtgcacatagcacatcagctagcttttcaggtatgtatgttggctttgtcg

SEQ ID NO: 783 - DNA, 70 bp, Gossypium hirsutum
  Clone ID: uC-gsronu33B029e12b1
tcgctacgcgtccggttctgatgtagcaatcaagagaattaaagccagctgctttgtagtcaagcccttt

SEQ ID NO: 784 - DNA, 211 bp, Gossypium hirsutum
  Clone ID: uC-gsronu33B029f01b1
ctttggctttcgcatcagctccatggatcgggcgcagctcctcctcgtaggattacctctcttcctcttcgccactgatcttctcagactatttactattccgtcctcaaaggcgccgtcccattaacatcatcatcaccaccataattctcacctacccaaacccttcactcaattctgaaacccttagatatttattttacagaaaccc

SEQ ID NO: 785 - DNA, 252 bp, Gossypium hirsutum
  Clone ID: uC-gsronu33B029f02b1
catcgactccgtcttatggacaacacaacagtgctacagtgaatccttcatacaggatgaatatgtccgcaatgcagcgatatgctcctcgtcttgatgagtcgttctacatatgtatgggtgtctcttatttttctttaactctccttttttatcttttattcttttatctttttatatactctctttatccctttttttcttatcttttttttttctttctttttttattataatttttttttcttttct

SEQ ID NO: 786 - DNA, 799 bp, Gossypium hirsutum
  Clone ID: uC-gsronu33B029f04b1
atgtcgtcattatactaaaggaacaagagcagaaaaccaggctgagagggatcaaagctcaaaaagccaacatttccgccgaaaaagttatcgtccggtttctccgcacctttctcggacctaatggcatggttttgatgcttcaaagtctcgtcttcattgttactatcacaaattatgctccatcaatttttaattattttttttttcttcttttctttatcttctttccttttcttatcttttctctttactttatcatctttatttttttatcttttttttctttctctttccatctctttttctttttttttttcctctttttttattctatttttttcttattcctttataatatctatctctctctctctttatatactctctcttcttcttttcttttcttcttcttccttcttttatattcttcctctcttttcttttttcctcttatttttttctttcttttttatttttatatcttttttatcaatcttttttacttttttcttttcttcttttttcttttcttttttttattctcttattttctaccctatctcttctttttcttttccttttcactttcttttcttcttttcttctctttattttcatttttctatttctcctcttttttctttcctttatttttctccttttacttttttcttttattcatttcttcttttttatcttttttttttaattgtattccttttttatatttcattttattttttacctcttctttttatctttctttcttatcttctatcttttttttttatttttt

SEQ ID NO: 787 - DNA, 97 bp, Gossypium hirsutum
  Clone ID: uC-gsronu33B029f06b1
catcgtttttatgaaccaccaaagaaggagaagtctggtcctaattcaccagtttatacacctacatcccaaagagaaacttgaacctaaatcactt

SEQ ID NO: 788 - DNA, 445 bp, Gossypium hirsutum
  Clone ID: uC-gsronu33B029f12b1
cccacgcgtccgcttgaaagtgcgcttaatggaaagaaattctttggtggagaaaccattggaatggtagatattgttgctagctctgttgggtatttcattagggtcactcaagaaattatggggcaaaatctgctgtcagctgacaaatttccccaattattccaatggtctgaagatttcgcaaattgcagcattgttaaggaaagtttgcctccaagagacaaactacttccctttgtcaaaggtctcattgccaaatatcagcaagataatgctaaggcctaagccctcccaatgaacgtctttcacaatgattgtcgcatgcattttgccatttttgtatttgctgcttttgtgtgtaatgacctacttgcttttatgtttcgagtgaaaaaataaattaactcattgtactcttaaataaattggttattaacttatc

SEQ ID NO: 789 - DNA, 212 bp, Gossypium hirsutum
  Clone ID: uC-gsronu33B029g02b1
ccattgcttaatacgggcgagagaccgatagcgacaagttccgtgaggcaaagaagttaagagaaagcactctttttattctttcctctcttctctctcttttctttcattctcatccttctctttctcttctttaaactctctcttactctttttttttttatttctctttactccttctttcttctttcctttttcctttattctttttt

SEQ ID NO: 790 - DNA, 319 bp, Gossypium hirsutum
  Clone ID: uC-gsronu33B029g03b1
ggtgggatatagaactcaagacgacagtgatgatgatgatgatcataagtttctgccatgcgttattcccaactgcactcttgactactcttgtcaaccagctcctcctccagtacctcagcgagaagttcctcgcaattcatctttatttgatccttgctattgggcatactgtggagaaggaacctgcaacaaaactgcaacatacaagtacgtatgcgaatgcagatctgggttttccaatcttctcaataggacatactttccttgctacagacaatgtaccctcggatccgattgctcccgccttgggattacg

SEQ ID NO: 791 - DNA, 424 bp, Gossypium hirsutum
  Clone ID: uC-gsronu33B029g04b1
gatggatgctgggttactccattttttggagcgtcttgaacctttggctaccatcacttctccaccaacgggacgagcagggttttagcttcgtttatctataaaaccggaattaattgccttattctcttcatactcattttttaattaatttttttatttaattatattattttatatatatttatcttttaattcaaatatacttttttcaatcattttatttttttcatattcttctttattattaaattctttattcttaactctcttatattatttttaatttttatattatattcttatttttacatttttatataaacttatcatctcattatatttttttttttatttatatatcttttatactttattattatctttaatatctattctattttatttcaatcctgtactattt

SEQ ID NO: 792 - DNA, 104 bp, Gossypium hirsutum
  Clone ID: uC-gsronu33B029g08b1
tcgcctacgcgtccggactttttgagctttcgtgtttgtctattgaattatttacttcactttctcgagaaaaaaaaatgtcttcaggttgcaattgctgattc

SEQ ID NO: 793 - DNA, 86 bp, Gossypium hirsutum
  Clone ID: uC-gsronu33B029g10b1
tgtctacgcgtccgggtcctgtcaaagcacatacttcccattgtaagaactgatccagaacctatctatattattttttttttaaa

SEQ ID NO: 794 - DNA, 74 bp, Gossypium hirsutum
  Clone ID: uC-gsronu33B029g11b1
tgcctacgcgtccgcccacgcgtccgcccacgcgttcgcgccctcgacctattctcaaactctaaataggtagg

SEQ ID NO: 795 - DNA, 440 bp, Gossypium hirsutum
  Clone ID: uC-gsronu33B029g12b1
gttaaagcaaagctaattcaatctcgaaccatcccggagttaaagatccttttatccgaaccgaacatgaccccctcgataatcgagaaatcattaaaactgctggaaactttatcatcttgcaaagaagggagggtggagatatggcatgatacgatactgttacaagcgattgtgcagaaagtgttgaaagcatcgagcaaagcgacagagcatgcagtgacgatactctggattgtttgctatttatttagagacgagaaagcgctagaagcggtgggttagtggcaatggaatgaccaagattttgttgctcatccaaagcaattgttctcctgcggttagacaaatgtctgccgatttgctcaagattctttggggttaattccaagccttggttatcaagttatgatactaagactacccatattatgcccttt

SEQ ID NO: 796 - DNA, 223 bp, Gossypium hirsutum
  Clone ID: uC-gsronu33B029h02b1
accgcgaggggacaggaagtacacgtggactgcggagatcaaggggccggttgaaaggaagtacaaatgggtagcggagatcaaggatgggaagaagacagaagaggtgaaagagaaaaagtataaatggacggctgagattgaaggaaagggaattgatgggcctatctcgagaaagtacgtgttctcagcatccactggtggcgatgcaagtgaatgtagc

SEQ ID NO: 797 - DNA, 195 bp, Gossypium hirsutum
  Clone ID: uC-gsronu33B029h09b1
tcgctctatttcaagtctgcaaaacccctagccagccacttccccgccgcctctccgaaccatgggccgagtccgtaccaagacggtaaagaaatcctctcgccatgtgatcgagaggtactactctcgcatgacgcttgatttccacaccaacatgaagatcattgaagaagtgtctatcattcctttcaagct

SEQ ID NO: 798 - DNA, 518 bp, Gossypium hirsutum
  Clone ID: uC-gsronu33B029h10b1
tgcccacgcgtccgcccacgcgtccgcccacgcgtccggcgacaacaacaatggctgacttcaagaaagccactgctttgattctcacagtggctttgcttgtgaatctcgctttaatggttgatgctgatggtgatgttgattagatgtattttgtcctgtatcttttttttttgactcttttctccttctacttgttattgtttttgccctactttcaaattctttttacttttattttttctttcttttattgtctttattaattttcactatcttttttttatcatttttttatttttttttttttctcttttcttttctttttttatttttttttattttattttttcttttttcttttatttatcttattttccatttttttaatctatatctctttatatctttttttctatttttttttcattttttatttacttatcgttattttttttttccttttattttcttttttttcatctcttattattttttttcttctattcttttttttt

SEQ ID NO: 799 - DNA, 240 bp, Gossypium hirsutum
  Clone ID: uC-gsronu33B029h12b1
gcttttctaaaatgggaaatgaagctgattatataagaatggacaagcctatgcattaccggcatccatggtgtttcagggcatcaaatgatcatgttccaagagttggcccagcactccctcatgtcttgaggaatcgtgtactaaagttgtctcggcctaaactagaaagtcactttatcttggatgtcaatgtattggatgggactgtaatggctccatcttcaccatttacaaaga

SEQ ID NO: 800 - DNA, 536 bp, Gossypium hirsutum
  Clone ID: uC-gsronu33B031a01b1
aattgaagttttaaacttttatttatcattcaaatagctagatttcacggttaattcatcagctagatgaactagctaacggaaagcacagaatccagcaaacgacgaaactgggaaccatgacttcagccttcgtgctcaaggcaaagtgtattctccacactggtaaccaacaggacgatcagcaatgttgcagcgttttggaatagtgataaatcataaattattggcagtggccttggctccaccagaaatggtagatttgccatttaaccccttaaatttttatgaaattgcatgctagtataacggtaaaattgcactttggccctcccaataatttatgatttatctctagtccccctaaagcaattttctggcttggttccctgctattcatgttcaattgggaaaagcagagtagctgcttagtgttcagcttgatactgactccgaagcagtgcctatacgagacggtgaaaagcttgcaagaagaaggtcacctgcctataccagcgcaacaccaggaagattct

SEQ ID NO: 801 - DNA, 289 bp, Gossypium hirsutum
  Clone ID: uC-gsronu33B031a02b1
tccattcgttcggttgagatggtgctgcaagcaacccagatggggactgatggaagaactcaatccatttgcactaagctagacggtattgactgaggacaggatgcggcaaacatagacaacaagacagacccaaagacttataacctggctgctgcaccactcattaacattgtccatatacctagaggaagacagatggccaccaggatgttagctacccaagccggagttacgattttccataagttatttttcaggggagaagttaaaaaagggagaaggattc

SEQ ID NO: 802 - DNA, 611 bp, Gossypium hirsutum
  unsure (1)..(611): unsure at all n locations
  Clone ID: uC-gsronu33B031a03b1
gtgtttgtctattgaattctttccctcactttctcgaaaagaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcaccactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgggtcttgtgtaatagaagctttgtttgtggtgaaaataatgtataagccatttggttgggagcaaattgtccttttctccaaggatttttgctgctcattcatggtgacttggtttatggttttatctgttgttgttaaaatcttataaaaatatatatcggntgctgctctggttttgtatcacatcatngtctgaaaatatatggcatcttttatt

SEQ ID NO: 803 - DNA, 558 bp, Gossypium hirsutum
  Clone ID: uC-gsronu33B031a04b1
cccactcgttcgcggacgcgtgggacaagccacacagtggatgaagtaagttcaagtgactacagtacatgcacggtgggaaacgcaatcacaacagataacagtggagcgaccaccgttgctctcaagaccgccgggacacattacttcatttgtggtgtggtgggtcactgtgcgaatggaatgaaactttcagtcaaagtggagtcaggttcatcggcagcaccatctaagtcgccgtctaagtcaccatcgtcttcttcgtcatcctcgccggcttccaccgataaaccatcgaccggcacaccatctactacaactacaacaactaaagccccggactcctcatcctcatggagtctctccccatttatggctgttgtcacaacttgtcttgcgttgctggttttggtcatttcgtaataagctttcggcatagagtgttggccagccatggtcaggatagaggcagtgctgctgatcttatcttttcccttttcttattcctttttattatattgttggggtgggatcattgtatcttcatgatgagatgtt

SEQ ID NO: 804 - DNA, 555 bp, Gossypium hirsutum
  unsure (1)..(555): unsure at all n locations
  Clone ID: uC-gsronu33B031a05b1
cccactcgtccggcctagtcacccaccaacccaccagcatgaccaccaccctcaccctcaccctcaccctcatccacccactaagcccccaacccccactcctcctccagttcatccaccacccaaggcgccagtgcaaccaccaaccaagcccccaacttctgctccacccaagccaccagttcaacctccaactaagccaccaaccaaacctccaactcaacccccgcctaaaccaccaactcagcccccaactaagccaccaaccaagcctccaactcagtccccgaccaagccaccaacacacccaccatctcatcctccggccaagccacctacatcgagtcatgtggcagtgcagggcgttgtttattgcaagtcatgcaagtacgccggagtcgacacccttttgggagctaaaccaattcctcgtgccaccgtaaggctaacatgcaaagacgctaaaaacgaattaacggtccagttcaagactgacaagaatggttatttctttctggcagcaccattaccatctacaatnttgatctcacaatt

SEQ ID NO: 805 - DNA, 489 bp, Gossypium hirsutum
  Clone ID: uC-gsronu33B031a08b1
ttcactcgtgcggaagactactaggagaagctcaaggaggtagtggcagtatgcagcccaatcatcacagatgggtgccaaagatctggcggagcatgaggtggtggatcaactgatgaagatgatgattctcatgatgaactttaaaaaactggtaatgacattttgattgctgaaacaagcaaagcaaagcaaagggtgagaaggatgagagcataggtaggtgagatgaagatatacaggaatttttctccatggtagaagttaaaaaagggagaattatatccccctttgttcggatgttatttttgggtgaatgaatacgttttaacggatattattttttttttgttttcatgactctctcccctggaacttgtgatctcttttatctatgattgaatctggttctcttgatccaagaaagaaaaattcagtaaatgtccatggtagaaaatgttagtatttcaatttattacgactgctata

SEQ ID NO: 806 - DNA, 356 bp, Gossypium hirsutum
  Clone ID: uC-gsronu33B031a11b1
cccattcttttttgaacaaacacccaccaacccacggggagggtttaaaatcacaaaccgcgtcctaaccacaacccacacactacagaccccaacccccacacactcccccagctaagtgcacccccccaaggctgacacacgcaaccaaccaacacaagcccaccaacactctgcctccaccccacgaccacccagaaccaaaccctccaacctaagccaaccaacccaaaacccatctaacctcaacccccccggctaaaaccaccccaacaccaagccccccaacttaagacccacccaacccaaagaccctcccaaccccacaacacccccgacacaaggcccactcaacc

SEQ ID NO: 807 - DNA, 434 bp, Gossypium hirsutum
  Clone ID: uC-gsronu33B031a12b1
catatggggaatttcatggctggttctcctttttcagctggtgtaattgcagctgatggtttggcagttcattctcgtagccatggtggaggatttgctgttcagactgagccttgcatgggccgttctgttagcgtacatggatgctctgaggcagcgaatccaccatcgtctcaagaagaaaaccttgatgtcgtcaaggatgcagccactgatatttcccaaacggtttcaagaagagacatggcgacccaaatgagcccacagagtagcacccactcatctcccaaaggaaggccttctttctctccctcttccccttcagctctacctatcatggaactgcagagcatccatggctctaaatcagtactgagagatgtgccagtagatgaaagggtgaccctgactaggtggtcgaagaagcatagagc

SEQ ID NO: 808 - DNA, 489 bp, Gossypium hirsutum
  Clone ID: uC-gsronu33B031b02b1
cccacgcgtccggagcacaatctgaaaatcctcttgcccagtcagttcccaacttttctgatctcagaaaagaaaatacaaagccctcttctggagctggcaaggtgacgagccatttccaagcgagaaactatgctcgtagcaagagtaataatgaagagattgctcttggcaaggatgaacagtctcgacggtctcagtcccataggaaaagcttcgctggtcctgtagatgtttcagatgtgccagccttgaactctgatgacataggtttggcacctttgaaatttgataaagagcagatgggccagagcttcaatgacaaatctctgaagaatgaggaagcaaagcctttcctctggaaaggtaatggtgttggtcctggtgctggagtaaaaactgcaaagttcaaagcatcagagacatttgcgactccaaatggcgaagatccgatgagccagaattgaagcagatgattctatggatatg

SEQ ID NO: 809 - DNA, 632 bp, Gossypium hirsutum
  unsure (1)..(632): unsure at all n locations
  Clone ID: uC-gsronu33B031b03b1
aaaaataatttctcccaatattatctttgagatcttaacgtaaggtctctcatttgaaatgcaatttatctttccagtacactcaatatttgtaaatgatgcatgccctacctattagatgtgtgtattaccttatagtaggtccaagtctcttgacccgatggagcaacgaaggataagggacgatcactgcaaaaggcaaccctagcagtggataaataaagagtccctgcaacagggcctgttgttgtggagaggtaacaagcaaatgcattcttcaacttttcatttggatcagttgcaaatatcttcttgaaaagtgagtcgaacccaccctttgttatggctttcgccgttaggtttactttaccccacgcagcatccgataccgacgatccacttctcactgtagttttcatcattgtatatgtaaatatttttttgcaacatcttgttaaaagaattttcgataaaaaaatggggttaattccattaaagttctcaaaaatggttcatattttaaattagtcaccgaacttcaaacatcttaatggctcttcaaatatctatatttatcaataggntcttcgtcagcagtcataccttggtgtaatatcactcaatatacggag

SEQ ID NO: 810 - DNA, 377 bp, Gossypium hirsutum
  Clone ID: uC-gsronu33B031b07b1
cccattcgttcggagcacaatgtgcaaatcctatggggcagttagttcccaacttttctgatctcaaacaagaaaataccaagccctcttctggagctggcaaggtgacgagccatttccaagcgagaaactatgctcgctgcaagagtaataatgaagagattgctcttggcaaggatgaacagtctcgacggtctcagtcccataggaaaagcttcgctgggcctggagatgtttcaaatgtgccagccttgaacttttgatgacataggtttggcacctttggaaattgaataagagcaaatgggtccaagcttcaatgacaaaactttgaagaaagagggaacaaagccctttctttggaaaggtaaggggtt

SEQ ID NO: 811 - DNA, 234 bp, Gossypium hirsutum
  Clone ID: uC-gsronu33B031b08b1
tttgtagcttcatcatttgatagtaatgattgtctttgcggcaatccactcaagacttgctaataatatttgctcaatgaaattaataattgtgcatgggggattaaattgtaatagaatgttttattttgggttattattagaaataatagaagtattgaaggttgtctttggttattaaaaaaaaaaaaaaaaagaaaccataaaaaaagataaaaaaaaaaaacatagaac

SEQ ID NO: 812 - DNA, 594 bp, Gossypium hirsutum
  Clone ID: uC-gsronu33B031b10b1
ttcatgcgtccgggagaggttactcaggtgcagcggggatgattgagactactagctgtggtaggactggagcgatggggaaagtgcaacataaagatgcaataaaagagtctatccggagttgggttactgctggaaagaatgcaaaactaagtacaaaggctgctgctttaaacctcagttttgaccagcaatgcacgcactgtgagaaggaattaatcaacacttcactgttgaacctgcttacttatccatggatagaagaaaaggtgaacaaagggatgctttctctgcacggtggctactatgactttgtcaactgtacttttgagaaatggacattggattacaagggaagcatcatgaatggaaaaaccagagttgtagtgaaggaccgattattttggtgctaaccttctcggtccatcttatcttttttatctgttgctttcccattcgcttgttcgttaacagtttaattgattcgtaagtgttaagtgtcaatgcagactaataatgttaaattccttgtgatattaaggaattactacttaagtggaataatatgtttggttttggatatggggttgaaag

SEQ ID NO: 813 - DNA, 337 bp, Gossypium hirsutum
  Clone ID: uC-gsronu33B031b11b1
tttatttaccaaaaagaaactagaaaaacacatacgagagggacttattgaaaattggtgttgttaaagaaaaacaatcgcataaaggcaatgattatagagctcggtagacgcaacgccctccgccgttgggctactgtctaatagattggacgtctaagctcacacgttgttcccccaaaccttattcttgaccagcaatgctcgctactgtcagaaggtttctatcatcactttactgttgaacctgcttacttttacatgggtagaacgaaaaggtgaacaaagggatgctttttctgcacagaggtttctatgactttgtcaactgttcttt

SEQ ID NO: 814 - DNA, 175 bp, Gossypium hirsutum
  Clone ID: uC-gsronu33B031c01b1
gcagtattataaaagctttattgctcgggttttgagggtcggttggggaacttgttttcattctttcccttgcccgctttgtcagaaacagtcagttttatgcatatcgatatttaagtttgtattctgtaaaattgaatcggattgatcatgtttttggtttatatctcctatc

SEQ ID NO: 815 - DNA, 403 bp, Gossypium hirsutum
  Clone ID: uC-gsronu33B031c03b1
cccactcgttcggcattttgcagcaaagaatgtaggtaccaagagatgatgctagaagaaagcaccaacaaactagaatctgatgacatctttgggacttattcctaacatttgtttcaagttctcatcatcagtcttgcataaaagccagtcaaggattaagtaaaaccagcacaaataacttctgtttgtcaatcatcgtgagagtttttaattgcttttagctgtttaaacgatgaaactttggcgttgactctcaaggaatcttcttcaacaggctctatggtatttgtagaattgatctttcttgctttctttgctagtgatccttagaggttttgcttttgccataatgactttggagggggtggtaatttgaaaatgccaatgatcatcattctga

SEQ ID NO: 816 - DNA, 513 bp, Gossypium hirsutum
  Clone ID: uC-gsronu33B031c05b1
cccactcgttcggctatatctttctctctgtcttgggtcagctcacccagaaaaaattactaaaaaaaagggcaaaggcaaaggcaaaggcaaagcacaaagaatcgtcatatttaccatttgtgagaatttcgcttattttctttacagttttcccctatcctcggatggacctttattgtttctttccttttattggtgcaattcttcttcatttcttcttctccttcaatgattatcgtgatgctgttgttggtttcatctatttttggtaaattaatcgagttctgatctggggttctttttggagagattccgtcaattgcttcaagtgattataaaaaacccataatttagatgggctgttggatagcttgattcggaggtaattgaagacttagtcattgttaaagttttgagtttttctttatctgattaccgctggttaggttcgtttgatcgggaagttgaccctcgttctacatatttaaaaatttacattttacccacgaa

SEQ ID NO: 817 - DNA, 226 bp, Gossypium hirsutum
  Clone ID: uC-gsronu33B031c06b1
cccattcgttcgcccacgcgtccgcaccacagtcaggacagaggggtgttaccgagttagtcgaagctgccctgctacccacaaatttatgtacaatggatccaacatggtattcctggtttggattagtgttatcaattactctaaaagtccaaccctgttgttgataatgtataaattgtagactcttctcagatgggatttcatttaccaaaaattggtaatg

SEQ ID NO: 818 - DNA, 220 bp, Gossypium hirsutum
  Clone ID: uC-gsronu33B031c07b1
cttattcgtgcggagcagttttgggtcatcggtggggattcatctcatctataagtcgttttcaaagggatactaagggtacgggagggcatagacaccaagtttactgttactgccaaagtaggtgatgatgcaatattgagaggagagttacattgtgaaatggactacacttctgatgcctccaacatcactccttatcgacaacatggttggtgtt

SEQ ID NO: 819 - DNA, 365 bp, Gossypium hirsutum
  Clone ID: uC-gsronu33B031c09b1
cttcgtaacactaactatattgcatcctatcctttttttccacagtaaacttgacatgaacaccatatatgacggacagaactcaacccgacagcacgactgctatcgaaattgtgaaactataaggtgattgaaacatcaccttttattgaaatcaaagaagcatatcaactagtgaacacaatattatggtggatgcatgtacatcaaatacaagttcatatctcaaactcaaatctctttacttggttctcaagcaacccctagttgcttctcttggagtacttgtctgtttgtttgtttttgcagtttgtactgcacttacttataggttttgtatatgctataatgatttttgagtggat

SEQ ID NO: 820 - DNA, 480 bp, Gossypium hirsutum
  unsure (1)..(480): unsure at all n locations
  Clone ID: uC-gsronu33B031c11b1
tctcacgcgtccgctcgatttttttctccatacatatacatatgtatatgtgtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaggaaccaaagttaatcacccggggaaggcaaaaaaaaatttttttaaagggggaacaaaaaaaaaaaaaaggggccgggattaaaaaaggggggaaggggaaaaaccgggggaaacccaaataaaaaacgcttggaaaaaaaaaccctttttcaaaggggggaaaaaaaaaaaagggcccgaaacaaaggcctttcaaaaaagtggcaaacccaaaagggaaaagggaaccctcccttaaggggcaaataaaggggggggggggggggggtaaacccaaaa

SEQ ID NO: 821 - DNA, 329 bp, Gossypium hirsutum
  Clone ID: uC-gsronu33B031c12b1
ggatactaaagtgacagcaaaaatgggtggattgatgagcaagaaagttgggattagaattacgtgcgatgggattaaaggggttgtcccgaaaggtaagttgccggcggcggccaatgtctccggcgccaaatgtaaggttgatctccgtatcaagatctggaaatggacgttttgagacgagggataaaggttttccattttgatgaattttttattatggttttggtgttgaaatttgagtgtgaaattggattttttttttcatttaaaaaatgtaacgtcatataccaattctatcaatcagatttccagcattatttggttgg

SEQ ID NO: 822 - DNA, 138 bp, Gossypium hirsutum
  Clone ID: uC-gsronu33B031d03b1
gtccttgtcacagtagtgatgggtgatggcagaggtccacttgatgttcaaattcgaacaaaggagatgcatttgcaagctgagtatggctttttcaatcattgtagatttcttgagttcttttgctagtttttttta

SEQ ID NO: 823 - DNA, 518 bp, Gossypium hirsutum
  Clone ID: uC-gsronu33B031d06b1
cccattcgttcgtccacgcgtccggacccatgtttttaatgctgctggtttgaccggtagacccaatgttgattggtgtgaatcccacaaaacagaaacaattcgcaccaatgtggccggaaccttgaccttggctgatgtttgccgagagcatgggcttttgatgttgaactttgctactgggtgtatattcgagtatgatgcaggacatcctcagggctctggcattggatttaaagaggaagacatacccaatttcactggttccttctattcaaaaaccaaggctatggttgaagagttgctgaaagaatacaacaatgtctgcaccctcagagttcgaatgccaatctcatccgacctaaacaaccctcgcaactttatcaccaagatttcaagatacagcaaggtggtcaacattcccaacagcatgacaatcttggacgaacttctaccgatttctatcgagatggcaaagaggaacttgacaggcatatggaacttcacgaaccctggcg

SEQ ID NO: 824 - DNA, 460 bp, Gossypium hirsutum
  Clone ID: uC-gsronu33B031d11b1
ttcattcgtccgcccacgcgtccgaaaagattgaagagaagttagaaggagaaaagaaagaagaggacacctcagttccagtagagaagtgcgatgagccagtagtccagccagagacgccagagaagaaaggtttcctcgagaagatcaaggagaaactccctggacaacacaagaaagctgaagaggccagtagcccagctccagccccagcagctgagccccatcacgaaggggagtcaaaggaaaagaagggaattctggagaagatcaaggagaagcttcctggtaaacactccaaatcagatgaagaaaaagaaaaggcttgagattcaagttcacataaaaatactgatgggattgtgtgtttctttaattgttaaaaaaatatctgttttttggtttgaggttgaatttgttgtatatttcatattaaggtcctttctttttccagcatttt

SEQ ID NO: 825 - DNA, 419 bp, Gossypium hirsutum
  Clone ID: uC-gsronu33B031e03b1
ctggttcttctgagtcatctctgagtgaatacacaaatgtcgattctattgaagaacgtgaccgatggatacagtaatgccaatagcttggccgatgctgagactaccaaggttactgctgaagcgagctgtgctccactgagaggaagcctatcgatgaggtgagatgggacttttgatgttaagaccaagacaggaggtccattcggaaccatgaagcatcctgctgagctcgcacatgctgctaacaacggccttgatatcgccgtcagacttctcgagccgatcaaggagcagttccctaacctcacctacgctgacttctatcagcttgcttgtgtcgtccccgttgagattactggtggacctgaaattcccttccatcccggagagaggacaagccttacccaccacctgag

SEQ ID NO: 826 - DNA, 166 bp, Gossypium hirsutum
  unsure (1)..(166): unsure at all n locations
  Clone ID: uC-gsronu33B031e05b1
gaagttggtgatgggacaacgtctgttgttgttttggctggtgtacttttaagggaggctgaccagcaagagccgngtgaagacatattccgtgacatatatgcaagggtttcctctatgagatacgaaagaatttccaccatgttctgttttgaaaaattacaag

SEQ ID NO: 827 - DNA, 104 bp, Gossypium hirsutum
  Clone ID: uC-gsronu33B031e08b1
ttaatagaaggattagagttgccattaatggttgctgcattttagctattataacttttggattcttccggcatgtcttttcaacaactaaagagatgttttca

SEQ ID NO: 828 - DNA, 111 bp, Gossypium hirsutum
  Clone ID: uC-gsronu33B031e11b1
tggacgcgtgggtcgcccacgcgtccgggatgctaaatagggactcgttcggaattaaacgtcaacattttacttctatgtttatcaaaaaataaaagaaaattacctccc

SEQ ID NO: 829 - DNA, 125 bp, Gossypium hirsutum
  Clone ID: uC-gsronu33B031e12b1
atcaatctccatccatagaatctggagtcgggactgtaaattatgagaacagttgacattcaattgtattggtgaagaccggaaggaacgtgtaattcattagtgtgtaaataagacagagatgt

SEQ ID NO: 830 - DNA, 221 bp, Gossypium hirsutum
  Clone ID: uC-gsronu33B031f01b1
ttcattaccaaaaggtgctgaagagtcgcttggtgagatggatttgtcccctgagtggatttacaagataaagtcttctgttaaaaaggaactcactcatggttcaaaaccatctcttgtcgaaacacttttacattctcaagaaaggaatatatctgaagaggcctcaggtcaggtacatgatgggcttgcagctttgcagccaatgtctaactgagaaa

SEQ ID NO: 831 - DNA, 490 bp, Gossypium hirsutum
  Clone ID: uC-gsronu33B031g01b1
tttcattcgtccgcttttgaaatacaatccggttcatgggaaagttccggttcttcttcacaacgggaaaccaagtgtagagtcttttgttatacttgaattcatagaggaaacggggatgcataatgcgccaatgatacacgatccttatgacaaagctaccgatcgattctggatcaagttcagtgactaaaagtgctaaacgaccctttgaatgggtaaatggatcgccttgattgagccagaggcagggacgaatgacccttggggtgaactaaagcctggaattgaccttctaggtcccgttgatgagatattctttgatatctatgaccgatatgaaccagtcaacgaacctttttttgacaattgtttcatattaacaggttttggaggttcaacacattttgataaaatgtcagtgatgtacttaacatgtataccatgataactggaaaggtttttgaccttaatgtggatttgggtgctg

SEQ ID NO: 832 - DNA, 198 bp, Gossypium hirsutum
  Clone ID: uC-gsronu33B031g03b1
ttcactcgtccgcttaaattaggtgtatgtgctaatgtgcttggcttagtcaagcccgtcattggtatcacccccagtgatgccatgctgttcccttcttgatggcctcgtcgatcttgaagctgctgtttgcctttgcaccgctatcaaagcttacatcttaggcattaaccttaacattgcagtttcccttagctt

SEQ ID NO: 833 - DNA, 521 bp, Gossypium hirsutum
  Clone ID: uC-gsronu33B031g05b1
cttgttctgttttttctcatcatctttctttctccccctaaattctcacttcatatatactttatatcaacgatgtcggtaaaagagtgcggcaatcacgggaaataccgccggaaaatcttccggcgaatcatcgccggcatcctaatcttcattataattgttctgaggacaattcttctcatatgggccatcctgcgacccagcaaacccagggcacagtcctccaagacaccaccgtctacgctgtcaacgcctccacccgtaacctcctcacctccaatttccaagtcactctatcttctcgaaaccccaacgacagaatcggcatttactacgaccggatcgacgtttacgccacctaccagaaccaacaaatcacccttcgaacatccattcctccacgtaccagggtcacaaagagatcaacgattggtgacccttggtcaatgggaattcagtgcctatcgcaccggaatatttcgccagtttaggatccgatcagagtgccgggtcgggct

SEQ ID NO: 834 - DNA, 617 bp, Gossypium hirsutum
  Clone ID: uC-gsronu33B031g07b1
cccactcgttcgaagaaagttgtttgcgacccttcctacttgccaaacaaggttaggaagatcggcaaggttgctagggcaattgctattatgagtcacccaattccaaacaccaatgattctcattctgtgcagattatcctgccacaaaagcagttgggtcgtaaatcggatatgtatgtcttctgttgttcatattctcacaatgttgctccaaagggcaaattcattgcatttgtttcaacagaggccgagacagatcaccctgagagtgaactaaagcctggaattgaccttctaggtcccgttgatgagatattctttgatatctatgaccgatatgaaccagtcaacgaaccttctcttgacaattgtttcatatcaacaagttatgatgctacaacacattttgaatcaactgtcagtgatgtacttaacatgtataccatgataactggaaaggttcttgacctcagtgtggatttgagtgctgctagtgctgcggaagaataattaccctgaagcatggtatttgccaatgtttgtgcttgtttaagcttcttacagtgttgactgtgctggtgggattatgtctattacaccatgttttttttact

SEQ ID NO: 835 - DNA, 395 bp, Gossypium hirsutum
  Clone ID: uC-gsronu33B031g08b1
cccattcgttcgcccacgcgtccgaagaaggtttgtgccctttgacacccgaagaaactgctctagtattaagagcgctcggtattgaccgcaatgttcaaatttacattgccgctggagaaatatatggtggagagagacggatggctccgttggcagaagcatttcctaatttggtcagtaagatgtatgttcggcatctacaatgcatgttatatgtgatctaacagtcggcttttcttgcacaacaggttagaagggagactctgctagttcgatcggacttgaagttctttccaaaaccactcatcccaaatggcagtgtcggattatttagttttcttagaaagtgatttattcgttccttcatatgacggaaacatggccaaggttgt

SEQ ID NO: 836 - DNA, 488 bp, Gossypium hirsutum
  Clone ID: uC-gsronu33B031g09b1
cccactcgttcgcggatgagtggtggtgtgaaccaggacatggggattggtgtacttgccttgagaaatatacactttgtagggacggaatataccataagcaagaccaattcgaacgtcttttgccgacctttgttcaagtgattgatttgactgctcaagaagaatctgaatattggactgttatgtctgctgtatttgagggcaaaccagttgaatctattgaattaaggcccaacctagattatgttgcttccaattcaattgaagctagcatcaaccgcaaggtacgattgttaaggaccatgcttcaatgggaagagaaactacggtcggaatcaagttttggaagacaagatggtggcgcaaaatcaagaaaccacgcagattcgggttgttcttgtggaagtagttattatatgttggccttatggtgcataatgagactgagaactggcaggactgttgccaatgctgcaagaagagca

SEQ ID NO: 837 - DNA, 162 bp, Gossypium hirsutum
  Clone ID: uC-gsronu33B031h01b1
gccaattctgttagggtttctgccttggctcttgttgtagacattgggcctattgggcctgtatttgggtcctgggttttaaaaataggtctaggttatgtaattgggtttgggctatgtaattggactttaaacatttaatggactgttataattttattt

SEQ ID NO: 838 - DNA, 104 bp, Gossypium hirsutum
  Clone ID: uC-gsronu33B031h02b1
cccattcgataggcgacgactactcgagctctataacaccggaagctttaaactatggcggatgtagagaccgcggtcgcgacggacggtgtgcccaagatgag

SEQ ID NO: 839 - DNA, 373 bp, Gossypium hirsutum
  unsure (1)..(373): unsure at all n locations
  Clone ID: uC-gsronu33B031h03b1
atccatcgcactccgtctcacttttcttttatccgtggtgcttatagcagcaacaggtaactaccacctcatcaacatgtngtctcaccacctctctgagttggactccaccaccgattccgtcgcgtgctctccacgctccgagcaccatgctcctcatgatgccccgtgtacggttcatgtgcagtttcggcggaaagatccttccacgttcacatggatatcaggctccgtatgcccgggggggatacccggattggtggccgccattggtccaccctcctcggaggccatcctaacaaggctctctaaactctcaggaattgccaacgtgagtgttaagtatcagcttccgaacgaggatcttgacgcg

SEQ ID NO: 840 - DNA, 340 bp, Gossypium hirsutum
  Clone ID: uC-gsronu33B031h04b1
gaagatccttacggttacaaacccgaaaagatgacaggcggggtagaactaagtgacatagacttcgcgtaccccgcccgaccagatattattatctttaaaggcttctcactcaaaattgaagcaggtaaatcaacagcattggttggacaaagcggctcgggtaagtcaaccatcatcggattaattgagagattttatgatcctcttgagggagcagttaagattgatggtagactatataaggtcatcccaccttaggtcgctaaggaaacacattgcactcggaaggcaagaacccacattattttgctggtacaattcgagaaaacattgtata

SEQ ID NO: 841 - DNA, 571 bp, Gossypium hirsutum
  unsure (1)..(571): unsure at all n locations
  Clone ID: uC-gsronu33B031h06b1
cgatgtcagtcaaggcttcccttttagcaaaggtggtccaacgtgtaaaagaactaaaagaacaagccctcgagacgactgagctcgacaacttgccatcggaaactgacgagatcaccgttctctcgtgcgattactcaggcgacgggaggttgatattcaaggcctcgttgtgttgcgaggaccgatccgatcttttacccgaattaatcgacatcctaaagtccttacacttgaagaccctgaaagccgagatggcgacgctcggtgggcgaattcgcaacgtattcatcgtcgctgccgacaaggatcatagcatcgagtcagtccatttcttgcaaaatgcattgaaatctttgcttgaacgttcgaatccgagtgataggtctaaaaggagaagagtattggatcataaaataataatgtagtagtgaccatatatataattatccatagccattgtttaaaagtttcattttaagggttcttttttttttaattttagaggggtttttttctagnggacatgattttatttcatgagggcttgcttattatgttttctttgatg

SEQ ID NO: 842 - DNA, 463 bp, Gossypium hirsutum
  Clone ID: uC-gsronu33B032a01b1
cccacgcgttcggaagcagcttaggcaaccagttcgcagccatggtgaagtattcgaaggagtcagataatcccaccaagtcctgcaaggcaaggggctctgatctcagggttcatttcaagaacacaagggagactgcgtttgctatcaggaagttgcctttgggtaaggctaagaggtatttggaggatgttatggctcacaaacaggccgtacccttcagacgcttctgtggtggtgttggacgtacagctcaggcaaagaacaggcattctaacggacaaggtcgctggcctgtaaaatctgccaaattcattctagatttgctgaagaatgctgagagcaatgccgaggtcaagggcttggatgtggatgcactctatatttctcacatccaagttaaccaggctcagaaacaaaggcgtcgtactaccgtgccatggaagaatcaatctacatgtct

SEQ ID NO: 843 - DNA, 548 bp, Gossypium hirsutum
  Clone ID: uC-gsronu33B032a04b1
gcgcaatttgttcttgaatacctgaaaaatgggagtagagaagcacgtcatcaggcctggaaccggtcccaaacccacccccggtcagaccgtcaccgttcactgcactggctacgggaaaaatggagatttgtctgagaaattctggagcacaaaggatccagggcagcaacctttctgtttccaaattggcaagggctctggtataaaaggatgggatgaaggtgcgatgggaatgcaagtggccgaagttgctcgtcttcggtgctgcccagactatgcttatggtgctggtgggtttcctgcatggggaatacagccaaactcggctctcgaattcgagattgaagtcctaagtttgaagtgagtagcatgcagttggtgactgtcgagaaataatatgtagcccgaataactcacctgtgatgaacatatatagatattatggggtagcatgtatgaatattaaatgagtatcaatatgagtcatcttattcatgtatgacagctcttcagtgttggacttttcttctaataatatgagatgc

SEQ ID NO: 844 - DNA, 509 bp, Gossypium hirsutum
  Clone ID: uC-gsronu33B032a05b1
cgcgtccggaacttgcccgcgatcccaccgcactccgtgcacattgctatgaggaggactcattgccatgtgattcctgtctctatctcgtacaattacagtgggcggaaccttttccctctttgcactgttgtcagctatttctgttctctttgcttacaaatgtgttccggagactttgaagcctcatgtgggttcttggtctacatcgattgagcaacaacaaccggctgttgttgccgttaatcaacaaccggaaccaaaggcggcgaacaggtgtttctatttgtaggaaaaaggttggggtaactgggtttaagtgcaggtgcgagaatacatctctgtggggagcatcggtacccagaaaaacacgagtgctcatttgatttcagggtattggacgtgatgccattgctaaggcaaatcccgttgttaaagctgattaggtggagaggttctgaaaggtgggggaggttgctgttgatgaatggggttcttccttttttact

SEQ ID NO: 845 - DNA, 425 bp, Gossypium hirsutum
  Clone ID: uC-gsronu33B032a06b1
cggtccggatattgccctggatcccacgcagtccgtgactccatcaattcttgatacaggtaatatcgttaggtagttttcagcatactcgttttgagtttagtggttgtggataaagaaaaaatggctgaggagcataccaaggttggtggtagaggaagcattgcagagcatggtgcgagggatgcttgagttctaggggaagaaagattatgtgaagcctcaagctctagtggagttggtctccatccatgttgcgaaagtcatgatcgaagaggaacatcgggcagatgtggagaaacacagtctcctgtacaagcttcacctatccaatagcaactccagctcttctagtgacatggaagaaggtgataggcggagtgactatgaagaagatgaaattggagaagggtaagaaagtacag

SEQ ID NO: 846 - DNA, 587 bp, Gossypium hirsutum
  unsure (1)..(587): unsure at all n locations
  Clone ID: uC-gsronu33B032a07b1
gaattatactactataactccaccactttccaccagatttacattgcagatggcttcatcaatgctgtgggcttcaagggcggcttcttacctcaggatctctgtcttccacagaggcttttccactgttctaaaggatctgaaatatgcggattctcatgagtgggtgaaggttgagggtgactctgccactacttggtattactgatcatgctcaagatcatttaggtgatgttgtgtatgttgaattacccgaagtgggagctgctgtaaagcaaggtgaaagttttgcagcagttgaaagtgtcaaggctacaagtgatgttaattctcctgtttaggaaaagtggttgaagttaatgatgagctcagtggctctcctgctaaggttaantcaagtccatatgaggatggatggatattaaggttgagatgaaagatgcggggagtttgaaagacttgatggactcagaagaatactctaagttctgtgaggaaagaagattcaaagcactgagagcagatgccctggcgatgttggatgtcgggttctatgcaaagagagataaccggaagccgactggtga

SEQ ID NO: 847 - DNA, 638 bp, Gossypium hirsutum
  unsure (1)..(638): unsure at all n locations
  Clone ID: uC-gsronu33B032a09b1
cccacgcgtccgatgagaacaatatctttgaatggagtgtaacaattattggacctcctgatactctttatgaagggggatttttcaatgctatcatgagttttccaccaaattatccaaacagccctccaacagtcaaatttacatcagagatttggcatcctaatgtttatcctgatgggcgtgtttgcatatcaattcttcatcctccgggtgatgatccaaatggctatgagcttgcaagtgagcgctggatgccagtccatacagttgaaagtattgttttgagtatcatatcaatgctttccagccctaacgatgaatcccctgcgaatgttgaagctgcaaaagaatggagagagacaagagatgaattcaagaggaaggttagccgctgcgtgagacggtcccaagaaatgttatgatccattgccgctgcttcttcttgacaatatttgagtacccagggaatgccttcaatgattgtgtggggagctttggtcgataacactgcgagtgtccttgtagaatgccatatgaaaaaatctcaacactntacntaaaaactctcccttttttggtttgttttgactggagatgtaatactctgaaacagtttccgtattcaaacgtttttg

SEQ ID NO: 848 - DNA, 520 bp, Gossypium hirsutum
  Clone ID: uC-gsronu33B032a10b1
ggagtctttagaggaagagccagttggccaagaagttaggactgcaaccaaggcaggtggcggtatggttccagaaccgccgtgcaaggtggaagacaaagcagcttgaaagggactatgacctgctcaaatcttactttgattcccttcagtccaattatgacactattctcaaagaaaatgagaagctcaaatctgaggtagcttccttgactgaaaaactacaagccaaagatgtggcaacagaagcaatagcaggtgaaaaggatgaagggttagcagctgagatggcctccgccctccaattcagtatgaaggtggaggaccgtcttagtagcggcagtgtctgagcgcggtggtggatgatggatgccccacagctggtggacagcggcaattcctactttgcaagcgatgaatactccagaggcattggccctttgatggggttcagtcggaagatgaggatggcagcgatattgcgggagttactttccgatgtgttcgcaacacagagcat

SEQ ID NO: 849 - DNA, 496 bp, Gossypium hirsutum
  unsure (1)..(496): unsure at all n locations
  Clone ID: uC-gsronu33B032a12b1
tttgaaatacaatccggttcataagaaagtcccagttcttcttcacaacggaaaatcaattgtagagtctgttgttattcttgaatacattgaggaaacttggaagcataatctttatttgccacaagatccttatgacaaagctaccgctcgattctggatcaagttcatcgacgaaaagtgctttcctaccctttggctagctgcatggagccccgagaatgagcgagaaaaagtgacgaacgaagcttgcgagtatatgaaaacgcttgaaagtgcgcttaatggaaagaaattctttggtggagaaaccattggaatggtagatattgttgctagctctgttgggtatttcattagggtcactcaagaaattatggngctaaatctgctgtcagctgacaaatttccccaattanttcaatggtctgaagatttcgcanattgcagcattgttaaggaaagtttacctncaagagacatactactttccttt

SEQ ID NO: 850 - DNA, 310 bp, Gossypium hirsutum
  Clone ID: uC-gsronu33B032b02b1
tcctgtattctctcaattttgagctaaacaaacgttcttaattgtacccaactttggcggtgaggtacttgaattactaataatgcaattattttcggtttttgttaaaaaaaataatttttttgtttattaaaatttaatcagatataattttataattaataaaatattttaattattaattattataaataaagggggtggtcattttaaagtttccaaggttattttctttttacatgaaacttaatacttttctttttgtgcctcctaaattaaattcatttggtgtgattttataaatttattt

SEQ ID NO: 851 - DNA, 414 bp, Gossypium hirsutum
  Clone ID: uC-gsronu33B032b04b1
caaaaagtcttaagtgaggcatatttaagaatctgcgatggtaacctctagttttagtcaattagaagacttccatctgatatagccctcgatgtcctaaataatcttaagcttgagtggctggttacagggcttttgtcggttgtgattttcccatgctagtattaaagctaaggttctattttgtcctgtggctctggattgtctctcctttttgctacctaaaaagatcatgtctggatgattctgctggtccagctttgctatgcacccatcagccaaagtcgaccgtgcatggcggaaaaccgaggaccatcttaacaaagacaagacatgccagttcaagattcgtcaaaggggccctacaccttacgtgaaccaaaacccttgaatgggcccattgaacgagacatg

SEQ ID NO: 852 - DNA, 603 bp, Gossypium hirsutum
  Clone ID: uC-gsronu33B032b06b1
ccctcgtgtccggtcatgtttaataatgaaaaaacagacgacacattttatattatgaacatgatcaacttcttggcgagacgtttttaattatctatgagctcctactgcttgctgttacagactccttgcatacataacgagttgtatccaaaacagatagagactggcgggacatttaagcacagatctgtgccttggaaattaatcctgtaccaactgaatcctttacctagtttagactcactttaactgtcatcgttggcgtttgagtgtgtccgaaagcctgggtcattcagcctttcatcacatctttacatttatgtccacacattatagctcaatggaatcaaacacttgatgaagtgttacttaataattattacagtttaaatcagaagagtttacattatgttattttctacttcaataatttcacacatattattcgatgtaaaaatatgatggtagctaataatacatctatataatttcatgttttcacgtgctcgattccacaatacttttacatgtttttgacatactatttgttattcaatggaattttgatgaggtttatcagattaatgtcttgattttgta

SEQ ID NO: 853 - DNA, 879 bp, Gossypium hirsutum
  Clone ID: uC-gsronu33B032b07b1
gtcgtctacggccgccggttatatccggtgggtgattttgaagacccggaagtgaacccgcatagaccgacgaggagttgcatgagtagcacggtggaatcttttattgggtcttgaccggtttaactaccggtacattagtttactgttttcgtggcggtttttttcttcattattttttttttttcatcttttttttttttttgtttttttattatatttttttttatcagtatctttatttttatctctttttgtcctttttcatattatttcttttctttttttttatatttattttttttactttttttccttttttattctttttttataatttgaattttgttttctatttttacccttttatatttttcttttttagattatatttttttgttggttttttccttatttttttgttctcctttatttaactttttttattttttgtcttttataatttttttttttttcttctaattccatctaatttatttttatattattttttttctttactattctcttagtttttttttttttcttcttactcttatttttctttatgttgtttttctttgttctctttttatatttcccgttttatctttatttttttcctttttcttaatttatattatcatctttctttctgtattatagtaataattatttttttttctttatttttcttctctttattaatttttttaaatatgtttttctttcctattttcttttttgatttaaatatttttttattttttaatgtttttttttacatatttttttttatttctattattttctataataattaaatctctttatttgtttctcttcttctttcctctctttcttttatttttttttcta

SEQ ID NO: 854 - DNA, 432 bp, Gossypium hirsutum
  Clone ID: uC-gsronu33B032b09b1
caggtgattcaggtctcactggtcgtaagatcattattgacacctatggtggctggggagcccatggtggcggtgctttctttggaaaggaccctaccaaggtggacaggagtggtgctgacaatattagacagtctgccaagagcattgaagctaacgtgcttgcccgataatacatatttcaaggatgttatgcttcagaaacaggccgtaccctttatacgcttgtggggtggtgttggacttacaggttatgcaaagaacaggcattctaactgacaaagttgatggcctgtaaaaactgccaaattcattctagaattgctgaaaaatgctgagagcaatgcccaggtcaagggtttggatgtggatgcactttaatattcttacattcaagataaccagtcttaaaaacaaaagcgttatacatac

SEQ ID NO: 855 - DNA, 493 bp, Gossypium hirsutum
  Clone ID: uC-gsronu33B032c02b1
cacattgcttcggttttcctcgaggaactcaggccttttcttccggttaaaaaagaggttcttgagattttattggaaccatttgttggaataatgggtagagtgagtgataaaattttggttgggaagattagaattaatgtgtttgatgagtttgttaaaatgggaaggagattgttagaacttaagacctccattgaggaggttgatcaaggtgatgatgtagttgtgttggggactatcagtttggtgatgggattctctaaaaaattttatgaattgggttcttcagtggattgctgtcagggtaatagaaagattctgttaggagtacatgaagaattcttgaagttagagaaggatttaacatcattgggtattgatatttcgatccccgagtgtaatgaagggggtgaagaagatgaggtttctgaattggtacccattgctagcgagatgggattgaatatctttgatggtgcttcagaactgt

SEQ ID NO: 856 - DNA, 368 bp, Gossypium hirsutum
  Clone ID: uC-gsronu33B032c03b1
cccactctttcgcaacagaaaggattgaggcaacaggtcgtcgcctggcaaattattgcgagcgctttaatgttccgtttgagtacaaggctatagcagctcaaaactgggaaaatattcgaattgaggatatcaagattaataacaatgaggtgctagctgtaaattctctttttcggtttgagaatctgcttgatgagactgccgaagtggacagatcgaggaatgctgtgcttaaactgatcaggagaatgaaccctgatattttttgttcactccataattaatggatcatacaactctcccttctttgtttcaaggttcaggtaggctttattttatctttcatctagtatttgaaatgtctt

SEQ ID NO: 857 - DNA, 348 bp, Gossypium hirsutum
  Clone ID: uC-gsronu33B032c04b1
gcgcccactctttcgatttccccatctctctcgtctctgggtctcgtaagttggtgaatcgtgctgtaattagtgccaatggctcggattgacacctctgcatgttacattgtgtaggttacctttcgctgccataatttctcttccaatatccaatcaataccgttgtcattaagacccctggtgggaaattggtctatcatacaactaagaaatgagcatgtggtcctaattgttctgtcactggctagagaactcatggtatcccttacttgagacctgctgaattcaaaatgttctagattgccaatgaaccgtcggactgtgaattgtgcttatggtggtgtt

SEQ ID NO: 858 - DNA, 530 bp, Gossypium hirsutum
  Clone ID: uC-gsronu33B032c05b1
cccacgcgtccgcagaattagctattcagcacattcttccttgtgtcaaggaactatcaacagattcatcccagcatgttcgatctgctttggcctcagttataatgggaatggcacctgttttagggaaggatgcgaccatagagcaattgcttccaatatttctttctcttctgaaagatgaatttccagatgtccgactgaacatcattagcaagcttgatcaagtcaaccaggtgattggaattgatctgctgtcccagtccctattaccagcaattgtggagcttgcagaggatagacactggagggttcggcttgcgataatagaatacatccctttattggcaagtcagttgggtgttggctttttcgatgacaaacttggtgcactctgcatgccatggttgaaagataaggtttacttcattcgtgatgctgctgctataacgtgaagcgcctggctgaagaatttggaccagattgtgcaatgcaacatatagttccacaggttttagacatgattaaca

SEQ ID NO: 859 - DNA, 563 bp, Gossypium hirsutum
  unsure (1)..(563): unsure at all n locations
  Clone ID: uC-gsronu33B032c09b1
cagcctcacaccagcctagtgtttccatcaggaagaaatggcggtccctttgctgtcgaagaagattgtgaagaagcgtgttatgaagttcaagaggcctcaaagtgaccgcaagatctccgtcaagacaaactggcgaaggcccaagggtattgactctcgtgttaggaggaagttcaagggatgcactttgatgcccaacatcggttatggctcagacaagaagactcggcactatcttcccaacgggtttaagaaattcgtcgtgcacaatgtccaagagctagaacttctcatgatgcacaacaggacatactgtgctgagatagcacatgatgtttcaacgaagaagaggaaggaaattgttgagcgagcggctcagttggatgttgtcgttaccaacaaattgctagggttgtgcagccaggaggacgagtgagggtcggttcttgaagttgatttttgttctttttagtatgaaattctcttggttaggaagtaagaactttttggtccatggttaaattatatatttntatctgagtagcattgtctcttttttt

SEQ ID NO: 860 - DNA, 107 bp, Gossypium hirsutum
  Clone ID: uC-gsronu33B032d03b1
attacgtattacccaatttgaaaccaatcgacagagcatttttcttttgtgtgtgtgagagacaagaagaagaacagctatagctcaacatctttattcagcaatga

SEQ ID NO: 861 - DNA, 571 bp, Gossypium hirsutum
  unsure (1)..(571): unsure at all n locations
  Clone ID: uC-gsronu33B032d05b1
ctaaacccagttctctgctacttggatttggaacccggattattttgactcgtttgtccatttccttttgaatattcatcgagatcccaaaaatcccatcaacaactttgtttttccttttcggttttattccgttttctccacgttcaaacgtctcaaaacgaattacacatatctcgaagaaatgcaggaattcaagaccatcaagaaaaaaatgtggatgttttcttgttaaccttcacatttgcttcaactatctcccctactcctctcgcgtaatggaagctatcatcataacagccatagcaccgatcatcagaaacaacaagaagaaagtcgttaaccaacacaacttctctctgcaaaagctctccttctggtttgctcccaccacacgtccacctggtctactctctttcactcccggctcctaaaatataaaaaacgaaaaggaaaaaaaaaacaaagaanttctgtttttggttttgtgtttctgtatggctgcttactctttcaacaacaacttttcatccgngaattggtattctggtatccttgatccattttcacg

SEQ ID NO: 862 - DNA, 62 bp, Gossypium hirsutum
  Clone ID: uC-gsronu33B032d06b1
cgcgcatcgtcctacagtggggcacagagaacccaccgggggtaagtttactcggtgaagcc

SEQ ID NO: 863 - DNA, 201 bp, Gossypium hirsutum
  Clone ID: uC-gsronu33B032d08b1
ctcataactcctcaaaattcttcttcaatggcgtctcgagttcttgttttggcttcaattcttattttctcttgttttgcagagacatgctatggggcgatctcattctcatcccttcaaagaacacttgctgttactgcttctcatagacaaggacttttgaaagccggcgaagacatgattacagtgcgatggggatcg

SEQ ID NO: 864 - DNA, 536 bp, Gossypium hirsutum
  Clone ID: uC-gsronu33B032d10b1
atgtttcaacagctaagacatccctttgcagctctgggtcaaaatctccacaatgctaaaaatgtcatggttcaatctcaagtcaacaatgttaaggaggcttcgagcgacggtcatataccttgagctgattattctcgccttcgaaacctatgtaactgatgacacacctgtagagagaatgctgggatccaagaccatccagaaaaaaatgtggatgttttcttggtaacccttacatttgatttaactattttccctacctcttttgagtaatggaagctattattataaccggcattgcaccgatcattagaaaccaccagaagaaagttgttaacccaacacaactttttttggaaaagcctcttcttctggtttgcttccacccacacgttcacccgggtctactctttttcaacctccggttccctaaatttataaaaccgaaagggaaaaataaaacaaagaatttctgtttttgttcttgtgcttttgtatggctgctacttttttaacaacaactttcattccgg

SEQ ID NO: 865 - DNA, 60 bp, Gossypium hirsutum
  Clone ID: uC-gsronu33B032d12b1
cttggtcttccagttagggatagagctaatggaggctggatttttaggagacctatctcc

SEQ ID NO: 866 - DNA, 111 bp, Gossypium hirsutum
  Clone ID: uC-gsronu33B032e01b1
ttcccttctattttttgtctctgtggaaagtgaaaaggagaatgttttctttaggcacttcaaagggtgttcttgaaatcgccaaattcggtctctatgttacgaccccta

SEQ ID NO: 867 - DNA, 55 bp, Gossypium hirsutum
  Clone ID: uC-gsronu33B032e02b1
gtgtgattactttttatgggtgttgattaaaactgctttattaccatgagtgata

SEQ ID NO: 868 - DNA, 284 bp, Gossypium hirsutum
  Clone ID: uC-gsronu33B032e03b1
aaaaaatgtatataaagaaagaaaaccccaaaaatgctagagcttaggctagttcaaggttcgcttctgaagaaagtattggaagcgattaaggacttggtcaacgatgctaactccgacggctcggcgaccggtttcatactgcttgccatgtttacaagccacgtggctctggtcactgttctttctgtaaaagcttgttttttttttctattgcccacaaagtatgtcccccttttttattgaacacacggcccccccccttttgttcccataatcttttt

SEQ ID NO: 869 - DNA, 613 bp, Gossypium hirsutum
  Clone ID: uC-gsronu33B032e06b1
cccactgtgtctcggcttcccaaaaattcaattagattttgaaattccagcgaagggggaggtgactctcacacacacacacagatctttaaatttcattaatggatcatttaaatggttcaagagattgttttgaatcaggtattgaccgtggcttttgccttcgaggtccagatcgtcgaagtagattgcggttttagatcgacttgtccatgactttttgtgttgctattagtgagcgttggttgcttgttatttttttgttattttttttttcttttctttttttttttttttcttttatttaattttcttttttatattttttctttttatttttttttttttttttttattttttttttatttttctcttttttttctttatttttatcttattattttttttattcctttttttttttttttatttatttcttctttttttttatttttttttaattttttttctttttctttattctttattttcttttcttatttcttatatatttactattatttttatttttttttttttcttatttctttcttttttttttttaatttatttttcttttttcttttttattactttttctttatatttttt

SEQ ID NO: 870 - DNA, 471 bp, Gossypium hirsutum
  Clone ID: uC-gsronu33B032e07b1
aaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccctttttggggcccgggcttctttcgggggcccggccccctttcgggttttttttggggccccctttttttttttgggggcccggtttttatcccccggggggggggggaaaccccggggggggccaaatttttgggtttggcccacttcccctttttgcggggggggttctttttggagggggcccgcccggtgggccttcccccacctttgcccccccttattggttttgggccccccccctgtagggggccctcccccccggggggtgttttgttcccccccggtttggtgtttcccttgggggggcccctaaccccggcccttttctttttctccctttttttt

SEQ ID NO: 871 - DNA, 99 bp, Gossypium hirsutum
  Clone ID: uC-gsronu33B032e08b1
ctggtcatgagtgagagatgaggaaaacacgggggcgaatgttaaaaaaaaaccatcattttatataaaaaaatattaaaatgaaaaaaaatttgtaat

SEQ ID NO: 872 - DNA, 314 bp, Gossypium hirsutum
  Clone ID: uC-gsronu33B032f03b1
cttgtctctgttgtttccagctcacattccggcgatggatctccgtgaatcgatcactagccaaaccgacgtcgctttgaccctgaccaaaaacgttctccaaactgaagccaaggactcgaacctactgttctcgcccctgtcgatccatgttgtgctcagcttgatcgccgctggtgctaagggtccaaccctcgaccagctcctctctttcctcaagttcaaatccaacgaccacctcagctccttctcctccgagcttgtttccgttgtcttcgcggatggaagtccagccggtggtccccggttgtcat

SEQ ID NO: 873 - DNA, 914 bp, Gossypium hirsutum
  Clone ID: uC-gsronu33B032f04b1
cccacgctctcgccagccgagattattgtccatgggaaatctggtttcaacattgatccttaccatggtgatcaagctgctgacatactcgtcgatttctttgaaaagtgtcagaaagatccattttactgggataagatcttccaaggtggcttgattcgtattgaggtgttgtatacattgttgactgtcttatcccggccttttttcatttcatatgtttttttattatttttttttttttttttttttattatttatttatattgtctttattctattgtctttatcattctatttttttcctttatcgtttttatgttttactcctttgtttctttttcttatattcctcttttctttgtttgtttttttttctttttcttatttttctttctcttttttcattttccctttcattaccttttttttattcttcctctcatccctttattcttttttatcttttattctttatatttcttttttcctctattttttccaatattattcttttacactctattttttattattgattatgctcttgttattgtttctctttatttcctctttttattctttccttttttttccttctctatttgtttattttcatcttttcttttctatttcatttaaaattttcgtttaatatcttttttattatttttatattatatcttctttttttttttattttcattcttttctttttaatttatttttattatttttttttttttttctttattcttaataatttttttattatttttttttattattatattcttctttatttaattctttttttttcttgttttttctttcctttactcatcttttttttttatttttctttttttactttttctctcattttttttttttttttacttttttactttttt

SEQ ID NO: 874 - DNA, 461 bp, Gossypium hirsutum
  Clone ID: uC-gsronu33B032f06b1
cttaaatctgcgctcgagggatcttctcatatgatacgtgacgagcgatgcaagtcagcgaattggatagttgtgcatagagcgctaatggctataaaagatgtcgaaggaatgttctcttctttggatcctgagtactatgatatccttatgaagtatttgtatagaggattgtcaaccggagatcgccccacatgtgatcagtgccttaggatccatgagaagctgacggagagagctggtttgggctgcatacttcgttcccttgcagatactgtgaatgcaatttgactccaataggcccttcactttggaaaatgttttcaagtgcttgttgttcttaaatcattgaagtgctttagaagcttttatgttacagcttttcttccatgattcgtatttccagatcagagttgcggtccatgggttatatggtctcctattggcttttctcttggggt

SEQ ID NO: 875 - DNA, 470 bp, Gossypium hirsutum
  Clone ID: uC-gsronu33B032f12b1
cattcattgggcaactgtagtaaagcgggtggttggtgacgagacgatgcaagatagcgaattgactagttgtgcatagagcgctaatggctataaaagatgtcgaacgaatgttctcttctttggatcctgagtactatgatatccttatgaagtatttgtatagaggattgtcaaccggagatcgccccacatgtgatcagtgccttaggatccatgagaagctgacggagagagctggtttgggctgcatacttcgttcccttgcagatactgtgaatgcaatttgactccaataggcccttcactttggaaaatgttttcaagtgttgttgttcttaaatcattgaagtgctttagaagcttttatgttacagcttttctttcatgattcgtatttccagatcagagttgcggtcacatgggttatatggtctcctatctggcttttctacttggggtaattggag

SEQ ID NO: 876 - DNA, 70 bp, Gossypium hirsutum
  Clone ID: uC-gsronu33B032g01b1
gccgatattatgtttaatcaattgctgctgggagtgaggaacgagcggatgcatttcgtgggcacaacct

SEQ ID NO: 877 - DNA, 453 bp, Gossypium hirsutum
  Clone ID: uC-gsronu33B032g02b1
cggacgcgtggggaaaatggcagcaaagtatataattgcttctgttgcgggatcatttgccattgcttatgtatctgatctgcttgtttctgatagtaagatttttggagggaccacgccttccactgtttcaaacaagggatggtgggaagaaactgacaaaaaatttcaggcttggccccgcacagctggtcctccagtcgtgatgaatcccatcagccgccagaatttcatcgtgaagtctggttctgaatcttgaagacctaagtcttgcatttggttttgtcaatgatttcagttttaattgctactccctgtgaataaattctggtgccagactttgtttagtctggctttgcatttggaggcattctttgttctttttacaatttttgactcaatctgtctagaggacgatattgttcatgcttgatctaataaatttctctgaag

SEQ ID NO: 878 - DNA, 432 bp, Gossypium hirsutum
  Clone ID: uC-gsronu33B032g04b1
ccctttctttgcatctgatgaggtatattagcatttgcgtgcctagtaatgtcagttagcataaaccatgaaaacagtagcttatttggatgagcctaagatatgacaataccagttgatctttactatatgtaccagttttgttcaagaatattagggtttattaactcagatttgtgctaatataaattgtgcggtttctactattgatgcatggttcatactgaagggtacggtgttgtttatgagggacttgggcccacgaatataagcatggcaccctctggtgcaggctgctatggcgtatatggtatagttcacacggtctctgttcatgctcctcaaacacgatacaaaattagatactttgcctttgtacttttacaccttatgggggcaaaaccctttgatatggttaccttccttaacatt

SEQ ID NO: 879 - DNA, 90 bp, Gossypium hirsutum
  Clone ID: uC-gsronu33B032g05b1
gagagcaatgatggatttgtagtgcatttcgcgagttaaatttgtttttttgtattgtttctttaaagataagatgcatgggatttttag

SEQ ID NO: 880 - DNA, 352 bp, Gossypium hirsutum
  Clone ID: uC-gsronu33B032g08b1
aaatggcagcaaaggatataatggcgggggtttttgaaccatttgccattgtttatctatctgatccgcttggtctgatcgcagatttttgtagtgggatgcttccttgcaggagccatatagggaaggcggagtgcattccaaaccaatatgcttgtaacccggaaccaagcccttcattcgggaggaatccccacagccgtcagattttcatcgtgaagtctgggtctgaatcttgaagacctaagacttgcatttggttttgtcaatgatttcagttttaatagctactccctgagaatcaatccagacacccggctcccatgggtctgactttgcattcggaagcaac

SEQ ID NO: 881 - DNA, 416 bp, Gossypium hirsutum
  Clone ID: uC-gsronu33B032h01b1
tcctattgctgttgaaagcaaatttagggggagtcacatgtcccatgcctacgacttttacaagcccaaccttgctagtgaatatccggttgttgatggaaaactctctcaaacgtgctatctcatggctcttgatacttgctataaatacttctgtcacaagtacgagaaacaagagggcaagcaattttccctttccgatgctgactactttgtatttcattctccatataataagcttgtgcaaaaaagctttgctcgtttggtgttcaatgactttgtgaggaatgccagttctgttgatgacattgctaaagaaaagttggctccattttcaactttgaccggtgatgaaagctaccaaagcagggatcttgagaaggcatcccaacaaggttcaaagcccctttacgatg

SEQ ID NO: 882 - DNA, 617 bp, Gossypium hirsutum
  Clone ID: uC-gsronu33B032h02b1
agaccctggtgtttttctcatggcctacgtcgagggaggtgttttgaaatcaaagcgttcaatatggcgactgagaactatcactgattttttctgggcaattatcaatttcattggagtgttcttctcgaccatgttctcgatggaaaagtccgatgcctacagaaaaggctttggttcaagcaagaaatgggatgatggtccaggaggacctggaagtggaccatatggagagggtggtggcccacgacgaccaccacggggaatggacaatgttcggggaattgaccatagttcccttcctgcctgtggctcctgctgcggtggctaaatgctgcaagcatacatcttgtgcatgtacactgttatatagctaaagtcctcttattataagtaaggattttccacatgtttttaatgtcaatagattgcctgtgaaacaggcaactttgaacctctatataaccagagatgcttttatgtactttcaacttttgctaatggtgggctgatactgctctgttttacaacatgtcgatttgattcgagaacatgtccattagctctctggtgtaactctgtttgagagattatttaggtgtcacgatgctttcagt

SEQ ID NO: 883 - DNA, 512 bp, Gossypium hirsutum
  Clone ID: uC-gsronu33B032h03b1
cattctcactcattcactccttcacagttgaaaaaccctttaattttaaaaaggatattttggttatatactgagaaatccaacttcttttgtatctttatccttttggtacttcaattatcaaaagaaagaaaagcatcaacaacaacaaaaaaaagcccatacacttaagtgaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacggaaagtgaaaaaatcagtggaagggatgaaaggggtgacacaagtggacgtggagcggaaggccagcaagttgacggtcgtcggatatgtggacccgacgaaggtcgtggcacgagtggcgcatcggacggtgatgaaggtggagctatggccctatgttgccgacgacgtggtggctcacccata

SEQ ID NO: 884 - DNA, 102 bp, Gossypium hirsutum
  Clone ID: uC-gsronu33B032h04b1
cacgattgtagcgatgagcactgctccaagtttttgaagacgtgctattatggtataccgtgctactttttatgaaggggggtttttcaatgctaacacaga

SEQ ID NO: 885 - DNA, 322 bp, Gossypium hirsutum
  Clone ID: uC-gsronu33B032h05b1
cgcgcgatttatttcggcttactagccaaaaaaaaaaaaaaggagcctgtttactggatctggagaatgtaccaggcaatcatgggttgcttcattagcaaacatgctgatgagttggctaataacgctgcttacgttgcaacccctggaaagggtatccttgctgctgatgaatccactggcaccatcggcaagcgtgtttcaagtattaatgtaaagaaggctgaagacaacaggcctgctccccaaaagctgctattcacagctgctgaagcacttgaggacctcattgctgttactctgtttgaggaaaccctttatg

SEQ ID NO: 886 - DNA, 421 bp, Gossypium hirsutum
  Clone ID: uC-gsronu33B032h06b1
gcggcaagagcttggtgttttatttccacgacataatctacaacggtcataacgcaaagaacgcaacatcagccattgtaggttcaccacaatggtggaacaagaccattttaacaggacaaaaccatttcggagacctggtcgtgttcgacgaccccattaccttggacaacaacttgcattcgaaaccagtgggtcgggcccaagggttttatatctacgacaagaaagacatattcacagcttgggtgggtttctccttcgatttcaattctacccaacataaaggaagtataaacttcgccggttctgatccattgatgaacaagacgagggatatatcagtgattggtgggacaggtggattcttcatgggtgagtgagtggctactttgatgactgaagcctttgagaggaagta

SEQ ID NO: 887 - DNA, 297 bp, Gossypium hirsutum
  Clone ID: uC-gsronu33B036a02b1
cttttgttatcaatgctgtaatggaagccatcgaagggatgagggtagccttaggtgctgcaattgtgctgaactactgtctccagggactcttccatcctgctcgtaaggttagggaagtgtattggaagatttataattcactttatattggatcccaagatgctctagttgcagcgtatcctattctagaggacgagcagagtagcgagcagaacaacatatatagtaggcccgagttaatgatgttcgtataaattgctgctatgataggcagatatcacttttggcctgatt

SEQ ID NO: 888 - DNA, 553 bp, Gossypium hirsutum
  Clone ID: uC-gsronu33B036a03b1
ctcatttttccctcttttatcttccttttagattcttgaattatcccccgatttttatccgattccatcccatcgccgatctatcctctttacattttcatctacccaacgattttttcctgatctaaaaacctttgcttcggagaaaactacgccgaggaacagcatagcaaaatcggcggttgtcggttcgggaggaaggcaaaaagaatgtcggccgaacagaaagaacaagaacctaaccctaaccctaatggttgcagcaacggcaatgaaaatttgaacactgaaagtgaacatgaagaaagacaagaagacagacaagaacacgaacaggaacgagaacagccgccacgtcagtcttcgacaagaactcctttcactaatctcagtcaggttgatgctgacctggctcttgctcgaaccctacaagaacaggaaaggggcgtatatgatgcttaggatgaataatgatggtgggagtgaatatgaaagtgggaggcttggagctatttgcatgatgatgacgatgatgatgattttggggattcca

SEQ ID NO: 889 - DNA, 563 bp, Gossypium hirsutum
  Clone ID: uC-gsronu33B036a04b1
gctttctagtatctctctactggaaaatcttcagagaaaactgatgtttttgggtatggtatcatgcttttggagcttataactggacagcgggcctttgatcttgctcgtcttgcaaatgatgatgatgtcatgttgcttgattgggtcaaaggacttctgaaggagaagaagctggaattgctagttgatcctgatctgcaaaccaattatgtagaaactgaggtagagcagttaatccaggttgctctgctatgcacacaaggttccccaatggaccggccaaagatgtcggaagtggttagaatgctggaaggtgatgggttggccgagagatgggatgagtggcagaaagttgaagttctacggcaggaggttgaacttgcccctcatcctaattctgattggatcgtggactcaactgacaatctgcatgctgttgagttatccggtccaaggtgactacggcataattacagtaaaggaaagtttttactagttattttttaagattaactttttttttttttgttaatttgatgaccatatcctgatttatgtct

SEQ ID NO: 890 - DNA, 609 bp, Gossypium hirsutum
  Clone ID: uC-gsronu33B036a05b1
cccacgcttccgcccacgcgtccgcccacgcgtccgcccacgcgtccgcccacgcgtccgaaagaaagagaaaaggttgatttcaggaatcatgtaattcagtggtttgaagttctggatggattgttggggaaacattggagaaacataggtctatttttcaactgcacttttctgctgtttggatcagtgattcagttaattgcctgtgctagcaacatctactatataaatgacaaccttgataagagaacttggacgtacatttttggagcctgctgtgcaacaactgtgtttattccttcattccataactacagagtttggtcatttcttggccttatgatgacttcttacactgcatggtacctgacaattgcctcccttctccatggacagattgatggagtgaagcactcaggtccaaacaagatggttctctacttcactggagccaccaacattctttacacctttggtggtcatgctgtcactgtggagatcatgcatgctatgtggaagccacaaaagttcaaaatgatatacttgatagcaacacttttatgtgtaaccctaactttaccatcagcttctgctgttactgggctt

SEQ ID NO: 891 - DNA, 80 bp, Gossypium hirsutum
  Clone ID: uC-gsronu33B036a06b1
cctatgtttccggtcggattgtacggacagctacatcagtccttttcctagataccggatcttaaatggattactctatg

SEQ ID NO: 892 - DNA, 565 bp, Gossypium hirsutum
  Clone ID: uC-gsronu33B036a08b1
tccatgcgtccggaaccactttgttcaagagtttaaaagaaagaacaagaaggacattagtggtaaccccagagctcttaggaggttgaggactgcttgtgaaagggcaaagagaactttatcgtccactgctcaaacaaccatcgaaattgactccttgtatgagggtatcgatttttactctaccattacccgagccaggtttgaagaacttaacatggatctattcagaaagtgtatggaaccagttgagaaatgtttgagggatgctaagatggacaagagcactgtccatgatgttgttcttgttggtggttccactagaattccaaaggtccaacaacttttacaagatttcttcaatgggaaggagctttgcaagagcatcaaccctgatgaggccgttgcatgtggtgctgcagtccaagctgctatattgagtggtgaaggtaatgagaaagtgcaagatctcttgctcttggatgtcacttcattgtcttccggtttggaaaccgttggtgttgttatgaccggtttgattccaaggacaccccattccaccaaa

SEQ ID NO: 893 - DNA, 116 bp, Gossypium hirsutum
  Clone ID: uC-gsronu33B036a12b1
tccacgcgtccgcccacgcgtccgcttgcatttgctttcttccccattgtggacattaattaaatttcatattagctcttcatcatttaaactttaaagattatcaaatttaactt

SEQ ID NO: 894 - DNA, 570 bp, Gossypium hirsutum
  Clone ID: uC-gsronu33B036b01b1
gctgtccttatcgctcgattccatacccgacgcccatgtagccgttcaactcctcttcatctctgttgatccttatcttcgtaccagaatgagcggccaagaagacggcttatattttccgcagttcagccttaaccaggtgataactgcttttggagttggaagagtgatgagatccaaggacgaaaagtacagtgagggtgatattgtgttgaatgctttctttcctgtagctgagtactgtgtggtgccatctagtgtcctcataagaaagattgacccagaggctggaattcccttgccagaatatctcagttgtcttggggttcccgggtttgcagcgtgggtggggatagaagtgctgggagaggcgaagccggggtcaaacgcattcatatcagcggcggcaggtggtgtaggaatggttgcggggcaattggctaagctcaagggttgtagagtcattggaagcaccggatctgatgccaaggtgagactcataaaggaggaattcgggtacgacgatgtattcaactacaacaaagagttgattttgatgcgactttgagc

SEQ ID NO: 895 - DNA, 465 bp, Gossypium hirsutum
  Clone ID: uC-gsronu33B036b04b1
catttgttaaggtttttcttatgcggatagtgcttttatttcaagcggtatatgattttgtatgttcgttactctctggtcgaaagttgtttctttatcaacctttaggttcgagttttctttggaaaatgtagttaacgataatccattcaagttgtaactttaattttggattaaaacaaattattatctatgttttatgtgtttggaaaacaaaaaaacaaactcatattaccacgacaatagtaaagaccaggtggccagtaaacgtatcaaataagcactaacaaaaacgaatcacaatcattgaaagataaaaatagaggggcgccccttttaggggcccagaattaccttccggctgatgtccctgaaaactcttttgtttagggcccccaaaattgaatctgctgccgcgggtatcacaaattcagacttggaaaaacccgggtgcctcccacttaa

SEQ ID NO: 896 - DNA, 413 bp, Gossypium hirsutum
  Clone ID: uC-gsronu33B036b06b1
cctatgtgtccggtgaagtctccggcatatacaccgaaaccgtcggttgagaagcctgcgccatatacacccaaaccgtcggatgtgaagcctccgccatatacacccaagccaccttactatccaataccggcggtcatatgaccaccaacactgcctacaaagacaccagtctaccagagtccaccactagtgaatccaccaacaccgccggttgagaagcctccgccatatacacccaagccaccttactatacaataccggcggtcatatcaccaccaatactgcctccgaagccaccagtccaccccaggccaccaatagtgaacccaccaacagcggcgattctaccaccaccattaccacctattgggaagtcaccaacgcctactattgtgaagccaccttcacc

SEQ ID NO: 897 - DNA, 435 bp, Gossypium hirsutum
  Clone ID: uC-gsronu33B036b07b1
tccatgcgtccggtaaatatgcagcataatgttatgattgaggcagttgagaaccatatgccagaaaccatcataatcgatgagattggtacagagctcgaagcattagctgccagcactattgctcaacgaggagttcagctggttggcacggcccatggaatgaccattgacaacataatcaagaacccttctctacagatccttgttggtggcatcgagagtgtaactcttggtgatgaggaagcaaggaaaagaaaagtgcaaaagactattctcgaaaggaagggcccatcgacttttacatgtgctgttgagatgatatctaggactgaatgtcgtgttcatcatagacttgatgcaacggtggatgctatactggctgggaaatcttctttatttgaaatccgccagatggagccctgagctaatgtt

SEQ ID NO: 898 - DNA, 457 bp, Gossypium hirsutum
  Clone ID: uC-gsronu33B036b09b1
ttcttgaatcaacctctgcttgtttaagaaaagaaggaaaacttgtgaaacaagaagaagaagaagagaagagcaaaaaagtgaaatatgtacgtgagagcggtgccaacgacagatctgaacaagaatacggagtggttcacgtacccaggggtttggaccacttatatcttgatggttttcatttcatggctcctcgttttatctctctttggcacctctgctggaaccgcttggacaattgttcatctcgcgcatttctttgtcacatatcacttctttcactggaagaagggaacaccgtttgctgatgaccaaggtatctacaacggtttgacttggtgggagcaaatagacaatggcaagcaactgacacggaacaggaagtttttgactgttgtaccttgtgtgctgtaccttatcgcctcacatacaacagattatcaaaacccaatgc

SEQ ID NO: 899 - DNA, 541 bp, Gossypium hirsutum
  Clone ID: uC-gsronu33B036b10b1
taaataatgtaaaggataaaattggaagagaattagtataaaacaacaacccgctcttctgaattttatatcgttaaagcgaagctgccctcttcttctgttgctctgaacttattgtctctatttgaggagcaagttttgaggttgtggtctaaaaaacgaaaatggtgaagatctgttgcattggagctggttatgttggtgggcctacaatggctgtgattgcacttaaatgcccatctattgaagtggctgttgtggatatctctgtgcctcgtattaatgcatggaatagtgaccagcttccaatctatgagcctggtcttgatgctgttgtgaagcagtgtcgtggaaagaaccttttcttcagcactgatgtagaaaaacatgtgcgtgaggctgatatagtctttgtttccgtcaacactccgaccaagactcgagggcttggagctggcaaggctgcagatcttacatattgggaaagtgctgctcgaatgattgctgatgtatcaaaatctgataagattgtggtcgagaa

SEQ ID NO: 900 - DNA, 360 bp, Gossypium hirsutum
  Clone ID: uC-gsronu33B036c01b1
gatttctttcgattgtctcttcattttcttacctctcaaacaccaagcctagatcttttcctttgtcatttatattcacttccatggctttaatcatacactagggttctcctggttgctatttcgttttctttttttcacttaaaaaagaaagaaaagctaagagattttcaataatccaattttttttaaccaatggcaaccacgaaccctttcgatcttttggacgatgataccgaagacccaagtttggttattgccgctgctgagcagcagaagcttgaaaagcccaagaaagctactgcttccgccccagctcaagctcagccggctaagcctgctaagttcccttccaagcca

SEQ ID NO: 901 - DNA, 193 bp, Gossypium hirsutum
  Clone ID: uC-gsronu33B036c02b1
cttttcttttttgggtttaccatataatcttcgcagttgaattaaagtgagaaaacagttatcgagcggcgtcgtaatggaagcacacggcgccggactccggcgagttttggtgttggcattttgcgttgccgggatttggtctgcctatatttaccaaggctttttttaggaaactctgttcaccaagcga

SEQ ID NO: 902 - DNA, 92 bp, Gossypium hirsutum
  Clone ID: uC-gsronu33B036c03b1
aatttattataaaagaagaaaaaaaaaaataaataaaaaaaaaatattagaaaaaaaaaaaaaagataaaaaggaagttgggtaattgggtt

SEQ ID NO: 903 - DNA, 400 bp, Gossypium hirsutum
  Clone ID: uC-gsronu33B036c04b1
tgattattgtggtaggtttgttctttatttcatcagtttgtttatggaaagtgctcctaaaaacttcagtaccactggtggatatccttactttatgaaggaagactggtttgctcctcaagactttgattgcttttgcaagagatttaaactctgcagctagtgaaatgaactctttttaactttgacttttacatatggactatattacttggattcggagttgactattttacttaaattatgagtgcgattgtcaagtataggtatataatcgacacgaatatgttcaacttttaattttttaatgtatagcttgccttacatattgaccatggttctggcattgggtattgacaatgttacttaaaactcatttggttaaaaccatacataattc

SEQ ID NO: 904 - DNA, 467 bp, Gossypium hirsutum
  Clone ID: uC-gsronu33B036c05b1
cctttgtttccggtatcttgccgctgaggttttggaattggctggaaatgccgcaagagataacaagaagaacagaatcatcccgaggcatattcaattggcagagaggaacgacgaagaattgagcaggctgatgggaggtgtgacgattgcgaacggaggtgttttgcctaatatcaatcaaagtctattgtcacggaaggccgggaaaggtaaagtagagaccggttccgcttctcaggcattttaggtaattttgtgtaacatagtatgtaatggaattacgttcctgttattgcaaatatcattcctagtaatgaaatcgttgaattgagttttgttgtaagcatttttttgccttttctccattgtcttgggtgattcatatattttcatcatttcccttggaagtactttccgccaacgctgactgtaacctacctatttggcacaataaatgaaacttt

SEQ ID NO: 905 - DNA, 561 bp, Gossypium hirsutum
  Clone ID: uC-gsronu33B036c06b1
cccatgcttccgggacgctcttaaggtacctacttcaactatagcttctaatgctggttatgatggctctctggttcttgggaaactactggaacaagatgatgataatttgggttttgatgcttcaaaaggtgcatatattgatatggtgaaagctggaatcatagaccctctcaaagtcattagaacagccttagtcgatgccgccagtgtctcattgctattaacgacaaccgaggtatctgtcctggaaaatccagatgagaagaaaccaccaagtcgtatgccagacattgataatgactactaggtggactataccagttggagtacttaaaacactttttgtcatcctgcttaaaatagcagagaacttaaattgagagccaaggttcaaccctgatgaactcatttaagaggaatacatgatgatggtaaccaattataaaagaaaagataaataggatcatgcttattgatgtcattgcacaattagtgatctgggatttttgtagtacaaagaaaattagttgaggactcgtttattgcaactgttatttt

SEQ ID NO: 906 - DNA, 594 bp, Gossypium hirsutum
  unsure (1)..(594): unsure at all n locations
  Clone ID: uC-gsronu33B036c08b1
tccatgcgtccgcccacgcgtccggaaaatggagcatccatatgtgcccagggatctgcaactgcctggatatgtccccgtctccctttctcagtccaccattcttaccgtctatggtctctcttccctgctcgtcgtctcccttgtttggttcctctctgggcgatcgcgcaacatatctaaacttgatagaatggtggagggctggggggcctttaacgggacttaccccactaaattttggagggaaatttggcattctcccctgaattctataaagacaagactggattttatctagctgaagtttggaaggaatatagcaaaggtgattcaagatatgcaggaagagactcagcaattgttgctgttgaaggaatgacatcagttcttgaaggtccaccttgccttctagcagtgtatgctattgccaaaggaaaaggatatagctacatactttaatttgccatctctctgggacagttatatggaacattngtatatttcataacagtttacttggagggtgataacttttctgcaacccatttatactatgcatactatgttttgcaaatcgtttggctttgatcc

SEQ ID NO: 907 - DNA, 376 bp, Gossypium hirsutum
  Clone ID: uC-gsronu33B036c09b1
ttaaaaagcaaagttgggtatctaaaatgaagctccaagagtgttgtaaaatgcgaattacgtaacaagttaaactactaataccgtgaaagaaagagaaaaatggggatttggagctgaagaagaggcacagagatgggttgatatggccgccgaaagagggcttaaagcatatggcgacaccaggccaggcgtgcgggaatgattaggtcgtaattgatagtacttatcttttttcgctcttctgctgtaaatggaaaaaatctcccccactccattgggggaaaagtaaacaaaatcatcaatcatcattttcttttatcttttctttatgcaatatagtaacaaatgatgaaagaattttagtttttcctaa

SEQ ID NO: 908 - DNA, 516 bp, Gossypium hirsutum
  Clone ID: uC-gsronu33B036c10b1
ttctacgcgtccgggactttacagagctgtcgacgtataccttaaggcgcatccatggatacctgaatcggagcgggaaaagatatgcggagtattagactgtcaaaagcttacactcgaagcatgcactcacgcggcacaaaatgagcgtttaccattacgtgcggtggtccaagtcttgttcttcgagcagttgcagctacgtcacgcgatcgccggtacattgttagcggcggaaacggcgccgatgaatgcggggagattgtcggggacgagaagagacgacgacgaagaagaagaagaacaacaagatgaggaggaggaaagggtggcgatgtcacgtggtgaacaaggaagcaccacgtggagagcagccgtgagggaaaatcaagtgttacgactagacatggattcaatgaggacgcgggtacatcaactagagagggaatgtttcacattgaagaaagtaatccaaaaaatcgaaaagggaaatccacgtggcagcggatggagagg

SEQ ID NO: 909 - DNA, 483 bp, Gossypium hirsutum
  Clone ID: uC-gsronu33B036d05b1
cccacgcgtccgctttttctttcttctttcccctaaattgcattttctcaaaaatgtcgctcctccaatcttccgtctatcctccgtcaacacttcgttcttcgccgtcactgtcatgcacagcggcacaccccatcgcctcctcccatagagttccttccacttcgaattccttcgtcgcgttagaatcgtcatcgttaaagaccgttaactctatttcgagcgctaagaacaatagaaggaaaggcgttgtcggaaaggtgaggtcgagcctggagacggcgggagcaacggtggggcaggtgacggaggttacaaaggacaccttctggcccatcgttaacgccgcgggggataaaaccgtcgtcctcgatatgtatactcaatggtgtggtccatgcaaagttatagctcccaagtttcaacaattatctgagaaataccttgacggtgtctttctaaagcttgattgcaatcaagaaa

SEQ ID NO: 910 - DNA, 658 bp, Gossypium hirsutum
  unsure (1)..(658): unsure at all n locations
  Clone ID: uC-gsronu33B036d06b1
cactaaggaaaccaacaactacaatggcaactattacaatggtaacaatgaggccttgttcactgagaaagggtggagtactaaggaaaaccagaatagcaacaactattacaatggtaacaatgaggccatgttcactgagaaaggatggagtactaaggaaaaccagaacaacaacaactattacaatggtaacaatgagtacaacaatgttgagaagcaaggtatgagtgatactaggtacttggagaatgggaagtactactatcgtgtgggttctgagaacaactactacccgaaccggttcgagaactcgaggggagtcggttcgaggaacgagttcaacgagaaccgttacaataacatgggaaagtacaatcagaatcaagaggagttcgaagaagagttcgagccatgaaaccatacgtatatgctaattaattagcaaaatgagagtaaagaattaaaggctttatttattgggttttgtgtttactttgtgatctttttttattttatttgcagggtttgatagcatcctttgcttttgatattgaatgctaaagattgatatgggagcctatgtttttacttttcttaaccatgtatgcaataaaatgtaatatatgtcaatttnaaaaaaaaaataataattttt

SEQ ID NO: 911 - DNA, 583 bp, Gossypium hirsutum
  Clone ID: uC-gsronu33B036d08b1
ttatggttgacgaagagcttggccgtggagttaggtgagcatggaattagagttaattgcatttcacctcacgcaactgtgaccccattgttccaaacaacattggggctgttcgataagaagaagggagaggagatgattgcgacttcagcagtgttgaaaggcaacgttttggagcctgaagattttgcacatgcagcgctgtatttggcaagcgatgaggctaaatttatcagtggtgtcaacttgccagtcgatggagggtatagtctcagcaaccagtcatggaagatgggattcgcagcactttttgggtaaaccaacaagtcctctgctttactccttggacaaaatttcctttgaataaggaaataaaagttacccaaaactacgctacttgtaataagattgtattgtcgatcatctcatttaatgcttttgatgtgtactttttttaccagtaccacttatatcgttttgaaagattaaacgatgtcaatttcatttccaaaaaaatatattttttttctttttatttttttcttcttttcactttttctcttttttttctctttttttctaa

SEQ ID NO: 912 - DNA, 451 bp, Gossypium hirsutum
  unsure (1)..(451): unsure at all n locations
  Clone ID: uC-gsronu33B036d09b1
gctacgcacagcaactgtctggacaatagtgaatcttacttgtccatcgagtcctggtgcaccttgcaggcttgaaaagctgcgcaatgctgggatagtttctcaaataaagaatatggttaatgatccttgtgttgatgttaagctccgtgtgagaactgtgctagggcaatctatggctttcggggacaattaagcatgtctgtgttcattcattactcggaatacaaaaggcaagagattttgaagcagttagtttttcagtcttctttaccgcttttcttctgtaagatattttcaaggctttctccagtggcttgtaaaaaaatggtgagttttggttgatttttaattgctttgattgaaaatggtcaaannaaaaaaaaatatttaaaataatataaaattaaaacaaaaaaaaaattccttaaaaaaaaaaaaggggcggccg

SEQ ID NO: 913 - DNA, 605 bp, Gossypium hirsutum
  Clone ID: uC-gsronu33B036d10b1
tctacgcgtccgcgaggatccttctccaccttataacatgctcagaaatgttctagatatgaatgctcgttatggtggtttaaatgctgcattactggaagcagggaagtctgtctgggttatgaatgtagtctcaacaagtggacctaactaccttcccctcattcttgacaggggctatgttggtgtattacatgattggtgtgaagcatttccaacatatcctagaacttatgacatggtccacgcagatggacttctatcccttgagactagtcaacatcggagatgcaccatgcttgatctattcactgagatagatcggttgcttcgtcctgagggttggatactaatccgtgacgccgctcctcttgttgaatcagccagagctctaacgacacggttgaagtgggatgccagaatcatagaaattgaaagtaacagcgatgagaggctcctcatttgtcagaaacctttctttaagaagcaagcaatgtgagaacaattctccattaaaccctagtttatgtcttggaattaaaactcctcttggcagtacctaatcatataaagctccaccatgaaagaggaatccatatattttg

SEQ ID NO: 914 - DNA, 586 bp, Gossypium hirsutum
  Clone ID: uC-gsronu33B036e01b1
cccacgcgtccggagagaaaatcccaccaaaaaaatggcgatttctaatgacaacaacaacgacgagcaccatgaatcgagtcctcttttgagcaaacaagtggcagaccaagatttgaaggagaaaccaagtggtaaaaaggcaaaagaagctgccgccgaggtgccagctcatccggtagttgctaccggagatgggtttgggtggacagctgatgggttgccgttggtccaccggagtgtcgtcggagaacccttgggtcgatctcaatggaactcatctctccttgcttgtcttggccgtaacgatgaattttgcagcagcgacattgaagtttgtctccttggaagcttggtcccttgtgtgctatatggaaccaatgtcgaaagacttggatctgatcctgggacatttgcgaatcactgcttgccatactcggttctttacttaattggtaattcattttttggctggaattgccttgcaccatggttttcgtaccctactcgtactgccattcggcgaaagtttaatcttgagggaagctgcgaggcactccataggtcatgtggatgttgtggaagc

SEQ ID NO: 915 - DNA, 424 bp, Gossypium hirsutum
  Clone ID: uC-gsronu33B036e03b1
gaaaaataaggagagagaaagggttagtttctctgaagaaggcctgggaccggccaagggatccggccattcccccgccgtggctccgccgtgccggccaccgtacacggtggcccaaaatcccctgaaggtacacggcggtggatgtgacaatggcggtgctgcaggtgttggctggtcaaaggtccctaggtgcggtgcacctagggtttgtttattatttttctgattttgggtagtgggctaactgggctagggttaggcattaggtcttgattgggttctggggttatttgggcctgttttaggttgggctttagttgggttagttgggcctgcaaattggacttgtacaaagctaaaacatatataaacttttattttgtatgcctgcttacaaaaaaaataaaaattacaataattg

SEQ ID NO: 916 - DNA, 288 bp, Gossypium hirsutum
  Clone ID: uC-gsronu33B036e04b1
ccctcgtgtccgcccacgcgtccgcccacgcgtccgaaaaaaaaaaaaaaaccccaaacagacaatagcctaggacaggaggatctctcagggtttaggtgatggcttcaaagcggatcttgaaggagctcaaggatctccagaaagatcctcctacctcttgcagcgcaggccctgttgctgaagacatgtttcattggcaagcaactattatgggtcctcctgacagtccttatgctggtggagtggttctagtcaccaatcaattccctcccgactatcccattt

SEQ ID NO: 917 - DNA, 465 bp, Gossypium hirsutum
  Clone ID: uC-gsronu33B036e05b1
cctattgtttccggaaatcaggaaaaaaaatggaaagatacccagatagaatctgtgtagtaaagaaagggaggaagagaaaataaaaaaacaatactaaaaagaaaagaaaaagaaagaaaaaatcagaataaagggagacagaggagacacaatttacaggagaaagaaggatctctcatcaaggatttagagagacgtcagaagctgtttaatgtatcatttaattatcaaaagacactatgatacctgtaggcctggtccgacctgaacttcgacaatgttaaactcacaacagtaattttaaaccaggccaaaaattggatgaaaatctgtaaagtgaatactcaggaatgtgtcataacaaagaatcaagaaaaacttccttgcgaatgtcaaatatccgctatgccctcgagtttaagctgatggccaagccatgactgttgaagcaagctcccacac

SEQ ID NO: 918 - DNA, 97 bp, Gossypium hirsutum
  Clone ID: uC-gsronu33B036e07b1
tccatgcgtccgtgtatttatttcttaatttctgcactatattgtaccaaaggaatatgaaatttaagtgtgtgaaatttagttggtattattcatt

SEQ ID NO: 919 - DNA, 646 bp, Gossypium hirsutum
  Clone ID: uC-gsronu33B036e08b1
gatttactgccacttttgttaaactttacaatgctgggaagagagaggaagatcctttgactgatgtgaaggatccaaagcaattcttagtagcttcattggcaaaactttctgcacataccccagggagatacccccagatcatcaatgaaaatcttgagccagcaaatcaagcagctttacttcagctttgcggcatttacaattgccaaatagtttgagttgcagggtttttatctttattttggtgcattaccttgagcattcgtttgtcagcaattgatgcttttcgacacaaaagttggaaggattcagatgtggtgatggattttgcggttctactggttggcagcaaagtgagcccccacaatagttatggatcttgtttgacatgcctatatatatccacaagttgcaggtcctgttgtgttatggtgaaagagagcttgtagtgtaaaagattgccttcaattttccttatttttgaaattacttgaatgctgaaactcaaagttggcaccaggggatgagacttgttcctctgaatcgggtttttgcctctgttgaccggcgttgttttgaaacataacaacttttgtttttgttctgggttataaatgaaagccaaattcaatgtttttttttt

SEQ ID NO: 920 - DNA, 472 bp, Gossypium hirsutum
  Clone ID: uC-gsronu33B036e09b1
ttataatgacctacattatgtccatatttgtggaactacttgttggtgttgatgcatgccaatgcattaccagggctgtaaagctctttcattgcttttgtgtgtttttgcagtcggagagtgcacagggagaagctgctgcaagtgccatgggtggcagaggtcgcggaggtggtttccctggccgtggacgaggaatgaggaggcgttgagatagctgtttcatttttttgtatcgaattttggttgtgttatttccttttatgccgtagatgaactaccgttttaagggccaaaatgtgaaggtgcctatttagatgtggcatccgaatgaccaaaatctgggattgaatgttggattttttgtgaactgtggctggtgctttcgtttgttgagaaaaatacacttgttccttaaatttatttttcaaaggaatttttgtgagtgaaggaaaatgaaaaactgttttta

SEQ ID NO: 921 - DNA, 616 bp, Gossypium hirsutum
  Clone ID: uC-gsronu33B036e11b1
gcctcttttgctttcttctctttcttctcaatattttcctctgtggagaacccatccccctcctttagggtttagcagttaaaaagagaaaagcaaaagtatggcgaccgccactgtccccgctgccgcaaggcagctttctcctaaggaagccgacatccaaatgatgttggccgccgaagtccatctcggtaccaaaaactgtgacttccaaatggagcgttacgtcttcaagcgtcgcaatgacggaatctacatcatcaaccttggcaagacctgggagaaacttcaacttgctgctcgtgttattgttgccatcgagaaccctcaggacatcattgtccaatctgcaaggccatatggtcagagagctgtactgaagtttgcacaatacactggttgtcatgcaattgctggaaggcacactcctggtaccttcactaaccagctccagacatcgttcagtgagcctcgtcttcttatcctcacagatcccaggactgaccaccagcccatcaaggaagcagctctcggaaacattccaaccattgctttttgtgatactgactcaccaatgcgatatgttgacattggtatccctgccaataacagggaa

SEQ ID NO: 922 - DNA, 370 bp, Gossypium hirsutum
  Clone ID: uC-gsronu33B036e12b1
aatgaagcgttgaatgagatttatgtagaggaagaagattatgatagattgagagaatctattgacttgcatgataactttgatcagattggccttgctcaaaagattgagaaacatgagctgcttgagatgagacgtgttgctgcatacatatacaaaaaggcgggcagatggaagcagtccattgccttgtcaaagaaagacaacctttacaaagacgctatggaaactgcttcacagtctggtgaccgtgaacttgctgaggagttgcttgtttactttattgagcagggcaagaaggaatgtttcgcagcgtgcctctttgtctgttatgacttaattcgaccagatgttgctcttgaaatggcct

SEQ ID NO: 923 - DNA, 473 bp, Gossypium hirsutum
  Clone ID: uC-gsronu33B036f02b1
gtaattttctttgagagaaataaccccatcttttccctttatacaagtttcaatttattcactctttcaaattcagtaattgacatagttctctaattttttagcctgtcattctgatccgaagcttgttaaaaagaccctctgttttcagttgtacttattttcacttatgtcatccaattttctcactaattcacgttgctctagctcttcctggacacctaaacaaaacaaaacgttcgagaaggctctggctaaatattacccggacacttctggcccgttgcaccatggtggccaaggttggggggggaaagtctgttgaggaagtcaagctgaactatgatgccctagtcagggatctcaaagacattgagtctggccgctacccttatccatatccaagtggaagcaacagctaaagcggttcccaaagagttaaatcctaaaatgaacaagaacatgatactcgc

SEQ ID NO: 924 - DNA, 414 bp, Gossypium hirsutum
  Clone ID: uC-gsronu33B036f03b1
ctcattttcacattatttcccacaccaaaaatggctcagaaagtggtattgaaagttctaaccatgaccgacgaaaagaccaagcaaaaatccatagaagctgctgcagatatcttcggggttgattcaatcgctgcggatctaaaggatcagaagctgacggtgataggacaaatggatgcagtggcggtggtgaagaaactgaagaaagtggcaaaagtggatataatatcaataggacctgctaaagaagagaagaaggaaggaaaaaaggaagaaaagaaagaggaaaagaaacaggagaagaaagaagagaagaaggaagagaagaaagaggaaaagaaagaagaaaagaaggaagaaaagaaataaatttaaaaaaaataagagctttgtgaaaaaataaacaaaatg

SEQ ID NO: 925 - DNA, 291 bp, Gossypium hirsutum
  Clone ID: uC-gsronu33B036f04b1
cccacgcgtccgcccacgcgtccggcttgaaggaaaaagcaaggacatggatgaactcttgtggcttgggatactataagcattgttatccatttcgaaaaatgttatatttatgtgacagcatcagcttttgacatcacattgtggttgtcgttgttgttgatgtgatgtctttaaggttcttctgattgtgtttcatctgggttggttgttgaaaattcggttcattaaaaaaaaaaaaaaaaaaataaaaaaaaaaattaaaaaatatatatataaaaatactataat

SEQ ID NO: 926 - DNA, 332 bp, Gossypium hirsutum
  Clone ID: uC-gsronu33B036f05b1
cccacgcgtccggccatgcaaaacaaagtttgaagctggtttgggaagaaaagaaaggagtcctgcaaatccatcttcattatgtaacttccgagatgagtctaagaaaagatgaagttccacaacttttataagagcgagctgacatgtatgttctgcatctatagctgcttctcttcatggaatgttctggctggtagcttgctccagtttttcaaaatttttccaaagtttttcagctttcatggtctggaattttgacaatttgtcaaaaagtttgttttaaagtgtagaaataaattgcaacaccccctataagcagttctctgttt

SEQ ID NO: 927 - DNA, 592 bp, Gossypium hirsutum
  Clone ID: uC-gsronu33B036f08b1
tttctgctgctctcttcgagctaagcgtaggtggtgcttatctggaacacctatacaaaatgctatcgatgatttatacagctatttcaggttcctgaaatatgaaccatattcagtatatacagcattttgccatgggataaaaggttctatagctaaagactatgtaaaaggttacaagaagctgcaagctattctgaaggtagtaatgctgcgacgcacaaaagcaaccttgattgatggggagccgataattaagttgccgccaaagtcagttctcatgtctaaagtggactttacagctgaggagcgggatttctatacccagctagaagctgattcacgttctcaatttaaggcatatgcagctgctggcacggtgaaccaaaattatgcaaatattcttttgatgcttttgcgccttcgtcaggcttgtgaccacccactccttgtcaaaggatttgactccgactccattcgaaagtcttgactctgttggacaagtttctgtggaaatggcaaagtcactttctagagaaatgctgattaattagtgaactgtttgaagcttctgcatatgtcttgatgcaaa

SEQ ID NO: 928 - DNA, 412 bp, Gossypium hirsutum
  Clone ID: uC-gsronu33B036f10b1
tttttcttcttctacgtttctcgcttttttttttgttttcaatggcgtctctcttaaacccttctactcttcttccacccacaaaaccctttcttcccactcgtttccgactcacttcttcacctactctgcgagttaactcactgactccccgtcttccatcaccatcgactcgtcctcgtcgagttatcaaagttgcagcagcactcgacagcgattattcatccaagaggagtagcagcaatgagcaaagggaaaccaaaatggtacctgggtgggaatattacccatggcttaacggtatgggggttcctaaagaccctgcttcgaccagagaaccaatgaatgggaccttattttaacactcttgccattgggcttggcagcatggaagaggcaaagaagaacatgt

SEQ ID NO: 929 - DNA, 561 bp, Gossypium hirsutum
  Clone ID: uC-gsronu33B036f11b1
ttttatacccctagtttctcccctttaattgtaggcttaatctgccctttcgcactcaaatattgcttcaatttaagggttggcgttgctcggctttacgttgatttaatcgatgcgggcaggctcttcttttttcagttgaatcggatagtccttgaagcggatcatcaaccagcagcagctccggccggtaatggtagcagatggcaacgagcactccggttagtttgccggaggataataacccatgcgagaaggtcgccgccaacgttagaattcgacgtggctagcttccgtactctcgccatgctttcgctttaagcactcagattctatttcagggtgagaaacataagaatcttatatgatccgaaaaaccagaaatttagttttcatatgagtgtatatatctaggtttcaaatctctttaaaggtttaattttgattttagtcccttttattatgctgaaatttaagatttgatccttggcaaaatttaaccatggtttttgtaaattgttattagtatgtgcgaattgataacaccgttgttgttggctt

SEQ ID NO: 930 - DNA, 429 bp, Gossypium hirsutum
  Clone ID: uC-gsronu33B036g01b1
aaggatactaccacttcttttcaagatgaggcgtttaacacctttgttgctgaatttgatagtaataagatcagttctggaattattaataaaaatactggaaaagaaaaagcattggaggctgaaatagtgaggctgaaagaacagctaaaacaatccaacttggagaaggctgagatgacttccaaatttgaaaagttatctgcaatttgtcggtttcagcggcaggaaatacaggagctcaagcaaactctagctgctagaactccatctcctaataaaagtacttcaagatatcataactcaccaggaagtctgggagagaaggttgaaggaacatttttggaatttgcacaagaaaaagtctgttactggaaaactgctagcccagaatcaaagccatggcaggcttttccagaggatgccaaa

SEQ ID NO: 931 - DNA, 510 bp, Gossypium hirsutum
  Clone ID: uC-gsronu33B036g03b1
cccacgcgtccggagaaatgtgacattctccttcttggtggtggtatgattttcacattttacaaggcacaaggcctatcagtcggttcatccctggtagaggaggataagcttgaacttgcaacatcacttcttgcaaaggccaaggcaaaaggagtgtctcttttgttacccactgatgtggttatcgccgacaagtttgcccctgatgcaaacagcaagattgtgccagcatctgctatccctgatggctggatgggattggatattggacctgattctgtcaagacattcaatgaagctttggatactacccaaaccatcatctggaatggaccaatgggagtgtttgaatttgagaaatttgcagttggaactgaggctattgcaaagaagctagctgaacttagtggcaagggagtgacaacaatcattggaggtggagactctgttgctgctgtagaaaaggttggagttgctgatgtcatgagccccaatataactggtggt

SEQ ID NO: 932 - DNA, 539 bp, Gossypium hirsutum
  Clone ID: uC-gsronu33B036g05b1
cggtcgcgtgggtttagttttctcttcctccaattaagatgcagatcttcgttaagaccctgaccggcaagaccatcaccctcgaagtcgagagttccgacacgatcgacaacgttaaggcgaaaatccaagacaaggaagggatcccaccagaccaacaactctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggccaagatccaagacaaggaaggcatcccaccagaccagcaaaggctcatctttgccgggaaacaactcgaggacggtcgcaccttggccgattacaacatccagaaggagtcgaccctccatttggtattgaggcttcgtggtgggatgcagattttcgtaagacgttgactgggaaaaccataactttgga

SEQ ID NO: 933 - DNA, 109 bp, Gossypium hirsutum
  Clone ID: uC-gsronu33B036g11b1
ttttgtcgattgtatcaatcgtacgtatttccagattttatctgagttctaaaacgtgtaggaagcttcttaatgtattttctcctttatacatttcatacggtttggt

SEQ ID NO: 934 - DNA, 245 bp, Gossypium hirsutum
  Clone ID: uC-gsronu33B036g12b1
tttttgcgtccggagaatgttgaagctggcccgaagggtcttttgggggcgggcaagggaaactctttggcttaacttggaaaatacttttcccagggtggaagggaaaaaaccaaaaaagggatggttggtaagggctataccttttaagggcgtagacactggaatatctggtttttgggcatttaagggtttttgtgccaaggataataacttgttgtaggaaaggtttttaccaattattg

SEQ ID NO: 935 - DNA, 463 bp, Gossypium hirsutum
  unsure (1)..(463): unsure at all n locations
  Clone ID: uC-gsronu33B036h01b1
cccattcgttcgctgaaaacggcggctcaacccttgtgcatgaacatgccggcggccactctcaccatgtgcccatcttgtgaaagaatcggcggcgttgccggcgatgggaattccaagaatccattttcgatgccgacaaagcctcgtttctataaacccgtcactaatccttctgcagcatgttaatcaattaagttttatatagaatttagtaacaaaataatgggagagaacagaaaaaaacccacatcctctctatttttgggttaaaaagggtttgcagtggattaaaaggtagtgtaactgtaattaattaattaatttctagacaagaaaagaacagtagaattactgatcaatctcctctcttttttttaattttatattttgaaatgatcattagaaagatacagnatctatatgtattatttttattccatgctactatccctttggtcca

SEQ ID NO: 936 - DNA, 470 bp, Gossypium hirsutum
  Clone ID: uC-gsronu33B036h02b1
tgaatcatttgtcaagttgttcttttgatctcattcatgaattttcttttcaatggctctctgctgtttgtatgattagaagacggattccgtttgaaataaattcttattttacattacattttttttttcagatctagtgttgtaatatgcaagttcaacataatgtaaacaccatttagtttaaaactggtttttcttatatttatatactatttgttatgtgttttaaacaaaactaaaaagcctatgccaattaaaatcaagccgaagaaaaaacactattgccaactcgaagtagactgaaacatgatcccgccaaaaaatctctattttccatatgaacctggcaaacaggttaggagcccggcgaggataaagggccctacctagtcaaatgcagtttttaagtttccaactacagcaccaaaaagtttttttatgcgccctccgaatgctaaccttgcccc

SEQ ID NO: 937 - DNA, 391 bp, Gossypium hirsutum
  Clone ID: uC-gsronu33B036h06b1
gtctaatcgaagagaaccggacgtgggtgtttagttcaagactgggccattgcggagtttgacaaaaatgctagaggaattttggaggatggtctctcttatgcaatagggagctctccgctgtgaacaacatggatactaataactgcatgtctactcctaccagaggagagtcgaccatgatcacaggtgattgaggaacccagatggtgacaaggtcacgaccgagaatccttaataacggaagggcaacactgaagaggaacggtacattttctggacaagagggttaaaatgaactgatgaaaatatttcccacgtttgaggaaaagaattttactgcgcccaacagccagattgattacctaaagagaatatctttgaagatgct

SEQ ID NO: 938 - DNA, 495 bp, Gossypium hirsutum
  Clone ID: uC-gsronu33B036h09b1
ttgttaatccccctgagtttagggagacatgccaggagtactgtagagaggtggagaaactggctttcaaattgctggaactcatatctttaagcttaggtttgcctgctaaccggttgagtgatttctttaaacaccaaactggtatgttgaggctgaattactatcctccttgcccttcacccgagctagcacttggcgtcggtaggcatagggatggtggtgccttaactgttcttgctcaggacgatgtcggtggattacaaattaggaggcattcagatggggagtggattcctatcaaaccaatcccaaatgcctacatcattaatattgctgatgctcttcaggactggagcaatgatctttatgtgagtgcggagcacagagttgtggtgaaattcgaacaggaaagattttcgattccgttattttccttcccttcccactatggcaaagtggcgccctctagatgagctagtgaatgagcaaaac

SEQ ID NO: 939 - DNA, 721 bp, Gossypium hirsutum
  unsure (1)..(721): unsure at all n locations
  Clone ID: uC-gsronu33B036h12b1
ttacatttcgcccccagaaattatagtaaaggaaagcagaaacaatgagaggaacattgatgttgacttggattctgatcatctgcctctcccaagtagcagcgcagagccaaaggcaatactactcggagacccgaccacatattcccaggccaattaaggtcaccaatcttcacttctttatgcacgaaaatttgggcggtacaaacgcatcagcagtcatcgtagcccaatctaacatcacaagcaacgacaataattcatcggtgccatttggcaccctatttgccgttgatgatcccctcaggataggtcctgagccagactccgaggtgattggaaatgctcagggactttcacttctggccggaacaaatccaagaacctcgacgacatactttgattttggatttactaccggtaagtataacggcagctctataagcatgttttcaaggacagatcttgagcttgcggtggttggaggaagaggacgattaaggatggcaacagggtttgcactacttaatccttacctcataaatgccaccactgtcattattgaanttgatgtgactctatttcatcactaagatgttatttacagactcatttctctgggttgtgaagagtcatcggttctgctgaccttattgatagaaaaagactaatacttgaccatgactttatcatcaaattgaaataagattattcccttgat

SEQ ID NO: 940 - DNA, 394 bp, Gossypium hirsutum
  unsure (1)..(394): unsure at all n locations
  Clone ID: uC-gsronu33B037a02b1
cccacgcttccgcccacgcgtccggatggcttcgcaggcagagtcatggatggaaacgtcaaagttgcagtgaggcgcagggttgtccatgtcgctcaagttactagcaatgctcttgcattagtgaatcgctatgctgcaagacaccgagctgctatacctactgagaagccttagtttcaaccttaaaaaaatctccggtttatgtaaaaaaactgctctgttttccaaaagtaagggttatacctgtcaggattttgtctaaaaggatctagggcctgcttgaattacatgtaactatatcatataatgaatccaagtgtgtgcttgccttgtatgatagtgaagtaattaagtataatggaataatatgctacttctggttcagcnnaaa

SEQ ID NO: 941 - DNA, 276 bp, Gossypium hirsutum
  Clone ID: uC-gsronu33B037a04b1
attcccctccgcctccccccattgactcactgctatctctctttccctctctctaatgacgcttagctcaggaggatcgagtgcagaggagcctctgcacttacgattgctggaggagcttgagcgtggagaaaaaggtatcggagatggtactgtcagctacggaatggatgatggagatgatatttacatgcgctcttggaccggcaccattattggtcctctcaataccgtacatgaaggtcgaatctatcagctgaagctgttctgcgataa

SEQ ID NO: 942 - DNA, 299 bp, Gossypium hirsutum
  Clone ID: uC-gsronu33B037a05b1
gaaaatctttccagtttcaattttctcacaacaaaactgaaaatgtcttgctgttcaggaaaatgtggctgcggcgctgattgcaagtgtggcagtggctgcaaccggatgcagtatgttccctgacataatagagaagactacaactgagactattgttcttggtgtggcaactcagaaaatgcactttgagggatctgagatgggagttggggttgagggtgcgatgcccgtgtggagacaactgcacatgcaacccttgcacttgccggaagtgaacaacaaacagaagcagagtg

SEQ ID NO: 943 - DNA, 350 bp, Gossypium hirsutum
  Clone ID: uC-gsronu33B037b02b1
cggacgcgtggggaaaaatgggtgactggagcatttgctggtcatactgcggtttgcttgaaggatgacatgcgtaatctatgggttgctgaatcacggcatgaaaatgaaaagggtgaagaaattatagtgggtattccatgggatgaatggtgggagctgtcactgaaggacaattctaatccacagatagccttgctttctttacatccagatatacgtgcaaagttgaactccaccgcagcatgggagtatgctcggagcatgtcaggcaagccatatggttatcacaacatgatatttagttggatagacactgtagctgacaactatcctccaccttttgatgc

SEQ ID NO: 944 - DNA, 196 bp, Gossypium hirsutum
  Clone ID: uC-gsronu33B037b03b1
ctcatgccctccaagaatgtcttcaagcatccctccctctccctctctctcacagcggtcctctgtcagaagcctgctaaaaccctcaagccaagtcatcacactgcttgactaagtcccccagatgggagctctactgcgaggataccgaaggtcaaggttgcatggaaaagggcgaaaagaaggccgtccattg

SEQ ID NO: 945 - DNA, 356 bp, Gossypium hirsutum
  unsure (1)..(356): unsure at all n locations
  Clone ID: uC-gsronu33B037b04b1
acaacactgagagtactggacctgatgggttgttggcttttaactgaagatgctatctcacaattcataaagaaacatcctcaagttgagatacgacacgaaattgttcaaaacctttcaacagagcagcaaacaatttcgaactggctattccacataacaccatttttggaggggacttaatgggaccaaaaagcagggaaatctgcctatgcctcagttttttgttgatcaaagattgaaatataacagagaggagctacttgcgctacagttttcacctctagcccttcaatctccccatgantgcaggtagtgtcacacccaatatataatcatatcaaatgggctaattc

SEQ ID NO: 946 - DNA, 510 bp, Gossypium hirsutum
  unsure (1)..(510): unsure at all n locations
  Clone ID: uC-gsronu33B037b05b1
atgctgcatggatccttgacaagtatggtgagcgcagcatgtgcatgggtgaatctggggtttgcacagatgcagaaaggcatcaacgtgctcattctttgtggtggcaagcttctgagcagggtaacgaacatgcagcattacttattggggatgcatattactatggcagaggaactgtgagggattatgagcgtgcagctgaagcttacatacatgcaaaatcccaatcgaatgctcaagctatgttcaacctgggatacatgcatgagcatggccaaggacttccttttgacctccatcttgccaagcggtactatgatcaggcattagagctaagatcctgcagcaaagttgcctgtcacactggcactggcaagtttggtgggtacgaaagaactatgctgactgtttcctggtccacgtaattgattccctgcgggaagtttatcntagagttgaaagatgggtggagaatggtgatcatggagggagggaaatgcaacaata

SEQ ID NO: 947 - DNA, 502 bp, Gossypium hirsutum
  Clone ID: uC-gsronu33B037b06b1
gacataagcaagtgaaaggcagtgaaaaccccagaagttactacaagtgcacgtacccaaactgcccaacaaagaagaaagttgagagatccttagacgggcagataactgagatagtttacaagggcagccataaccatcctaagcctcaatccactaggagatcatcatcttcttcttcctcttccattgctattcaggcttccagtgctgccacctctgagatccccgatcattcgtttataagccatggcagtggccacatggactcagctgcaacaccggaaaactcctctatatcagttggggatgatgatttcgatcgtggttcccaaaagagtaaatagggggagatgagtttgatgaagacgagcccgacgccaaaagatgaggggagaaggtgaaactgaaggaatttcagcactgggagtaaaccgtgagggaacaagagttgttgttcaacaccagtgacattgatatttgatgagggatagatgagaaa

SEQ ID NO: 948 - DNA, 364 bp, Gossypium hirsutum
  Clone ID: uC-gsronu33B037b07b1
gttcggagcttggcttagtccgtactgttacagagtaatttgggctctgaaactcaaaggcatagcttacgaatacatcgaagaagatctctccaacaagagtcctttgcttcttcaatataatccaattcataagaagatcccggtactccttcacgacgacaaacccatctgcgaatccaccgtcatccttcgatatatcgatgaaattcggccgcaaaatcccttgctgccggctgatccccatgagagagccgttgctctgttttggatcaaatttgctgatgacaagagtcctttaatctcaaagcttttttcgaaccgacggtgaagaacagcaggcggaagcgaaagagtgctttga

SEQ ID NO: 949 - DNA, 275 bp, Gossypium hirsutum
  Clone ID: uC-gsronu33B037b08b1
attttcaaattcaatagaaaacatttttttgttgaaaaaaaaagaaaaaacacagatgaatttgaaagaaccattatggagcaagagaacagagtcaaacgaacctccatctccatcatcgtcattgccaagagacccagaaacagaggctgccgcggctgctgcaacgagtgcggttgaagaacttgttaactctctcaacaagcaacgaatctacagagaagtcaccctcgctctatgcactggcttgcgcgacgtccgcgccgagttctctt

SEQ ID NO: 950 - DNA, 141 bp, Gossypium hirsutum
  Clone ID: uC-gsronu33B037c01b1
tttgatgatgacgattctattattttgggttcggatggttgatagtattggtggtgtgacacgcgtaaagaccggatggttgtagagattggactgttgtacatctaattacagtggaataaaaacagcttgttattcttt

SEQ ID NO: 951 - DNA, 445 bp, Gossypium hirsutum
  Clone ID: uC-gsronu33B037c02b1
gcttactattcctgcctcccctcgccgaataccaattcagcattaaaagttttcatctttacccttctcatttctttctcatctgagcatcttcttttttttctcacctctgcttcccatttccttccaacagtcctcgtagcctccacaaattcatcctcaagctcaacagtttcaatttcctcttagttttctcgagaaaatccgacttcggtgtgagaggaaagggctatcgatccaacacccagatgttaaattggtgctgcatcgagtgaagcagttcgctgacaagggagaatcgactgcagtttgcaatgaggaaatttgataaggatgcccttactagccttctgatggttctttgatagttataggaagcaagaaacttggagattgtgcaagcaaatactacgatttctcaggatgctttcatttgtgctcaagc

SEQ ID NO: 952 - DNA, 242 bp, Gossypium hirsutum
  Clone ID: uC-gsronu33B037c03b1
cactactactgctgcttctgtttcaacatctatgggaaaatcaagtgctgctaagatgaaaactgaagtgtctgatattggaagaactggtcttggaaatgggtgctatcatgaccttcaatctagatcaatcctatgagcttcacctcagagttcttatcttctagccttattgagaactaccccaacccgtaccgctaacacttttgaccactaataatgcctgatagtaattaaggaag

SEQ ID NO: 953 - DNA, 500 bp, Gossypium hirsutum
  Clone ID: uC-gsronu33B037c06b1
cttaccagatccttctattaagaaaatggcctcccacattgctggatatccccgtatgggaccaaagagagagcttaagtttgctttggaatccttctgggataagaagagcagtgccgaggatttgcaaaaggttgctgctgatctcaggtcatccatctggaaacagatgtctgatgctgggatcaagtacatccccagcaatgctttctcttactatgaccaggtgctcgatgccacatccatgctcggagctgttccacctagatacggctagagtggtgcgtgagatcaggatctgacacttacttctccatggccagaggaaatgcctctgtccctgcaatggaaatgactagagtggtttgacaccaactaccacttcatggttcctgaattgggacctgatgttaacttctcttatgcatcttacaggcagtggatgagtacaaggaagctaaggcgcttggagttacacagtcccgtccttatcggccctg

SEQ ID NO: 954 - DNA, 274 bp, Gossypium hirsutum
  Clone ID: uC-gsronu33B037c07b1
gattcacccacgtattgtattatttgaactcgaagacgtaggtgataggagattcttgggatagggcattgagacatgtctagataactgcggaggaagctgttactggcttcgcatggactatactgcaggatcggccattggataatgcactggtgccctatacgcaggactctgtatagcggtggaagataattgtagctgtggaagcctcgaaaacattagctgagatgaaggagtactatgcgcatatatgagggtgacatatacgagg

SEQ ID NO: 955 - DNA, 383 bp, Gossypium hirsutum
  Clone ID: uC-gsronu33B037c08b1
tccacgcgtccgcccacgcgtccgctcatcgccattttgctccctcctttgggtgtttgcctaaggcacggttgttgcagcgttgagttctgcatctgtctgctgttaacgattctgggttacatccctgggataatctatgccctttacgccattgtttttgtggatcgagacgagtactttgacgagtacaggcgaccactttattattcaagtgcctaatctagtcaagtcttccttaattatgtgatatgaatatgatgatgatgcagcaactcctcctcctgggttttaattttaatttgatgttgagggtgttgctactcttgaactggtcttgatgtactttgtgatattataaattgaaatggatctttggtctt

SEQ ID NO: 956 - DNA, 382 bp, Gossypium hirsutum
  Clone ID: uC-gsronu33B037c09b1
attcaatccttctggttttgagtggcagaagattgttgatgattggactgattggaataagtggataaacaaccgaggtggtataggtgtaccttcagaaaaaagttgggaatcgtggtgggaagaagagcaagagcatcttcaatattctggcaagcgtggtattattgctgagatattgttagctttacgtttctttatctaccagtatgggcttgtctatcacttgcatgttacaagggaaaccaaaagttttttggtttatggtgcatcatggcttgggattgttctaatattgtttgtaatgaagactggatttggtggaaggggggaggttcagtgcaaggtatataacttggtttccggcttatcaagggattaa

SEQ ID NO: 957 - DNA, 376 bp, Gossypium hirsutum
  Clone ID: uC-gsronu33B037c10b1
tggtcgcgtgggcggacgcgtgggcttttttgggacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaataagtaaataaattaaagaaagggtggttttttttaaaaaaaaaaaaatattttttggaaattttgaggaagaacaaagtttatgttattatctaaaaattatttgttggaaggcattttttaaaatgtgttgtgttaaaaaaatttgggatttacaattatttttgttg

SEQ ID NO: 958 - DNA, 443 bp, Gossypium hirsutum
  Clone ID: uC-gsronu33B037c12b1
gtataaagcaatgttcttcatgtgatttcatttcattggatcactacttatacacagtttaatgcttgtttttactctaatgcatgcagatttaagcacattttgatcttgtttcgaatccctgctgttatcggtatcgagaaaagttcaatttttgtcataaattcggtgtagctttggagatgaaaagttttcaggtaagctgcgattgatggacagtttatcgccgagaagcagtgataagaagacattgaagaggtggtttttcatagataaaagggttggctaaataagtgtacttcgataaaaaaggtgatttgaagctaatggatttgaagcctaatcattcatctcctgttcttactgatccgattccgataaacaagtcaaggttaggcattcattcaaatctgctttcgtatccacatctgggggatctttgt

SEQ ID NO: 959 - DNA, 493 bp, Gossypium hirsutum
  Clone ID: uC-gsronu33B037d03b1
acatcatatcagtactgctggaatggcggcaagtggaaccagcaatatgaagttcgcgatgaatggttgcattgtaatcgggacctcggatggtgccaatgttgaaatacgagaagaggttggagaagaaaactttttcctcttaggtgctaaagctcacgaaattgctggacttcgaaaagaaagagctgatgggaagttcgctccggatcctcagttcgaagaagttaagaagtttatcaaaagtggcgtattcggatcttccaactataatgaactcctgggatcattagagggaaatgaaggtttcggtcgtgcagactattttcttgatggcaaagacttaccacgttacatagaatgccaagaaaaggtcgacgaaacatataaggaccaacaggtatggacaagaatgtcgatcatgaatacagcaggttctgacaatttcagcagtgacagaacacttcatgaatatgctcgagaaatatggaac

SEQ ID NO: 960 - DNA, 580 bp, Gossypium hirsutum
  Clone ID: uC-gsronu33B037d06b1
aacttggagtgggaattgagaataaaattatattgcactttgacaaggtgttttggcctaatgtggagtttttgggagttgttgctgacacatcttatcattgcagctactttctaaaccttcataaggcgacaggtcattctgtcctcgtttatatgcctgctgggcagctggccagagacattgagaaaatgtctgatgaagctgctgtggagtttgcttttatgcaactcaagaagatccttccagaggcatgtgccccgattcagtatcttgtttctcgatggggcacagatgtgaacacactaggctcctatagctatgatgcagtaggcatgtcccatgatctgtatgagaggctaagagtgccagtggataacatattctttgcgggggaggcaaccagtatgagctatccagggtccattcatggtgcattttcaactgggcagatggctgctgaggactgtagatgcgtgtactggagcgatatggagagttgaacttgctcaaccagtatgggtgagaagcgggttgtgtgtccgcttttataaccgtttgtaacacctactgttagcat

SEQ ID NO: 961 - DNA, 407 bp, Gossypium hirsutum
  Clone ID: uC-gsronu33B037d07b1
ttatcatggaccatttgaactattatggtgtcgatttaatgtgccaagaatggagatcatgcagaatcgtgatggatcctcgtgttgcggagtatggcaaaacggatcacaaaggaaatttcattttgtccagagcaccagccatgcgtgttcggtcgaatgaaggggaagttaaagctagtgcataattgatcaatttatggtttcaccctgccacggtttatcgagttctgactgcttcaggtaactacgttttcgttctgccattgaagcaaatgtaaaaaataattgaaaaagagcattactaatgtaggttttcgttaggaatgaattcatgtaaatatcctccaaaatgtgtacatttcttattatacttatggatattaggctaatggccagttcctaat

SEQ ID NO: 962 - DNA, 421 bp, Gossypium hirsutum
  unsure (1)..(421): unsure at all n locations
  Clone ID: uC-gsronu33B037d10b1
ggacatttcatgtgctacactgaggaaaggcgtatttgctgctggagctgctctaactttgttgtcattggtgggatcagtcttctattactgggctcactctagagctgatactggtggatggcagaaacatcggaatgaaggcgttggaatgacagagcagcctcccgaatttggtaaggtctgactctattgtgcctcacggcgttttaattccctaaaattttggtggtacctgtcaagagaggtattgatagatccaagaatgaatagactgaatgagctatggatgaatataagttgtgtagcttcaaagataaattatagatataggatgctatcgttgttaatattttacctacttacttggccacgttttcaatgatgatatggtgcatttctcananaaaaagannnnnnt

SEQ ID NO: 963 - DNA, 508 bp, Gossypium hirsutum
  unsure (1)..(508): unsure at all n locations
  Clone ID: uC-gsronu33B037d11b1
tttttgatccatccatctttttctcttcttcccagcagaaataataatagcactaatcatggagtccaaacatgggagttggagactctcattaatgttgcttctggttatgcttgggttggcaaaagctgatatcaatcaagacaaaacagaatgtcgtaatgagctagtagggctggctccatgtctcccttatgttggtggagacgcaaaaacccctaccatagattgttgcagagggctgaaacaggtgctggataagagccggaaatgcctgtgtgtactgcttaaagatagagatgaccccagccttggcctcaacatcaacgctactctcgcggcaacacttcctaccacttgtcgtgcccctgtcaacatgaccgactgcatctctcttctgcacttgactcccgattcccaggaagctaagttatttcaaggatatcagaagctgacacacactggcaactncaactccactaccactgctgctgctgctgctgctgca

SEQ ID NO: 964 - DNA, 540 bp, Gossypium hirsutum
  Clone ID: uC-gsronu33B037d12b1
tccacgcgtccgcccacgcgtgcgggacactcacgaaagatgtgatttgtagctcctgctgctctaccacacccagaacatgttgctcgacttaggagtcttctgaagtgcagattcacccacgttggaatataattgcaggctattcgccaaattgcaatttttatcttcgaaggtagatttaggagccagatatttttgtaaaaattcctagtttcagtttgtcaggcataagccctacgattattttcattgccctgtaatagtttataggctcttctcagggtaaactctcccgaggactcccccctctaggctggaaaatctttgtgaggctctctagcacgcagaatgcagaggattctctcagctatctccattggaaaggtagactcagtcaagtctttccccttcctctgactttcatcaattagatctgcaactttacagtcacgtaattataccttaacgtacattttagctgaagaaatacgagaagttagggtaagactcactgatgtggcaagatgtctgaatcat

SEQ ID NO: 965 - DNA, 516 bp, Gossypium hirsutum
  Clone ID: uC-gsronu33B037e02b1
attgtaacctgcatccacaggtagtggtaatttatcattttccgatctactccaacaatctacagaaaagaaagtggagatggctgaacgtgtgattgaagagagggaacttacagtaagcaaggaagcagcaacggtggaagctgcaggaactattcaagccaaagaattaaaaactgatgaagtacctgaaggagaggaacagaataagaccgactccggctcggatgctccagtgatggtggaagcaccgagagaagctgaaactaaaccacccaagaaatctcaaaacatactatcaggtgttggatccaaagtcaagaactcaatttctaaggtgaagaaagcaattactggtaaatcttctcatccaaaagaaccaaaagcaatatcaccaaagtgaagcgagaaatgaagatcatccttaattcttagtacataatcacatattttatgatttgtttttaagggtttggtttctgtaaagattttatgatttgttagcttggtgagttt

SEQ ID NO: 966 - DNA, 131 bp, Gossypium hirsutum
  Clone ID: uC-gsronu33B037e05b1
gtcatttactacctctacccaccgtcgtaccgttttcttttcttttctttttctcttaatattctgtctagaactctccattttctcttttgctgtctttgggttctttttaatttttcgtctcttaaatc

SEQ ID NO: 967 - DNA, 474 bp, Gossypium hirsutum
  Clone ID: uC-gsronu33B037e08b1
cccacgcgtccgcccacgcgtccgccccagtttataacattggagttcagggttatcttcctgagttgatatattcatcagctaccacaaataatggattctctatctgcagtcttctggtcttggctatagcatacttaatctcctcttgaaaagatttgaatttggctagttaatagggtatccctaagggaaaacagtattgctggtggtaattcaaattacggagaagatgaaactttcaggggatgagtaatttccaggagactattgccaagacagtgaaaatcactaacagttgatagttgaatttaagtcaaatatatatagattctttaacaaaaattcttaataaaaaaatggttttgatgttgttgtctacactacagtggtcggaaatgtatttgtataccaaaatagattggatttagtattgttatataagcaacattaagaacttacttgtctttactt

SEQ ID NO: 968 - DNA, 85 bp, Gossypium hirsutum
  Clone ID: uC-gsronu33B037e10b1
tccattcattcgctgcgctttgaagtccgtacatgctgtcggaacgatcttgatgaagatcaaaaatggagcacgtgagagatgg

SEQ ID NO: 969 - DNA, 566 bp, Gossypium hirsutum
  Clone ID: uC-gsronu33B037e12b1
gcaactgtgcgagttacctcctctagtatcgttcaagcttcgatcccgaaccgattcacgagtgccattgtcaaggccccgacttctcttggatcttttaagaacatctccaaaccttttggcttgaaatgttcctccaatcacaaaacatttatggcagcttataagattaagcttgtaggaccggatggtgaggtgagcgagtttgaagcccctgacgatcaatacattttagatgcagccgaggaagcaggagttgaactgccatactcttgccgagctggagcttgctccacatgtgccgggaagatggtgtcgggttcagttgatcaatcggacggatccttccttgacgaaaaacaaattgccgatggttacctgctgacttgcgtttcgtacccgacctcagattgtgagatccacactcacaggaagctgatcttactaggtatttatggtttgaaatcagtagaatctatctaaaatacccagaaatttatctgaatctgttggaaaataaggggtaatgactaaatgcttatcagggacaattgatgcttatatgc

SEQ ID NO: 970 - DNA, 502 bp, Gossypium hirsutum
  Clone ID: uC-gsronu33B037f01b1
attgtttcagatctatcggtcgatagaatatcttagcagaggagacggaagaaaatggctggaagcccagatcacttgttcaatttgaggaacaatttctatttgggttcgtaccaggctgccatcaacaacagcgatctgcccaatctctcccccgacgacgccgtcgagcgcgactgtcttgtttatcgctcttacatcgccttcggcagctaccaactggtgatcaatgagatcgattcctctgctgccactcctctacaagccgttaaattgctcgctctctatctctccaaccctcatgataaggaatcgacgatttctagcttgaaggaatggttggcagatccagctattgggaacaatcccatttaaggttgattgctggaatcattttcacgcacgaagaagattataacgaggctcttaaacacaccaatgcttgtggcaccatggaactgcatgcactggatgtgcaaatattcattaagatgcatcggtc

SEQ ID NO: 971 - DNA, 211 bp, Gossypium hirsutum
  Clone ID: uC-gsronu33B037f02b1
atcgcgtgcggcgcccttttttatttttttttttgtgtgtatttattttctatgatatgtattcttctatttggtcatagtcgcattcttagcccaagtcgtagtcaaacctttattcgcagccgtaggccaagtcgaagttcaacccctattcgcagttgtagtcaagtagattctccaagggctggaaggcgaagggcccctttacaga

SEQ ID NO: 972 - DNA, 596 bp, Gossypium hirsutum
  unsure (1)..(596): unsure at all n locations
  Clone ID: uC-gsronu33B037f03b1
cccacgcgtccgcatcaaccatgtatcttcttcgagttccggtaattcaagcgctccgagcatgtcgtcagatgaatgttttgactcaatggctttcttacaagatctagatcaagacctagttttggaacagaatgacataggtaaaaagcttgatgtctctgcatccaacaggttggacgaggtggttttggttccggctactttagtatctgttgttagtattgaaggcaatgattcgtctagtaatgaattgttaaaaaccactagctctgtacctaattcagctaataacaatgagatctcaaagcatgctacggggaaccaaagggatgaaggtccatcatcatcatcatcatcatcatctgttaaaccgaaatctagtagaaggaagagagatgctntgggtagaatgaaagagcttcgaagaagtactatgctntatgccattttagatctcagaggtatgtgctttttttgtaagatatccaaatatgagtatacanagtgtagattaaattataactctcacctagctcttaacaagcttagcggattattgactattatcatattcatgtgtagattttactgtt

SEQ ID NO: 973 - DNA, 358 bp, Gossypium hirsutum
  Clone ID: uC-gsronu33B037f05b1
gctgattacgagaaaagacaagagattgacttctttggggagatttcgggagtatctctgagtccagacgatgaatctttgtatataggaatatgggacagaacgtatgcaagtttgctgcaatacaacaaaagacacacatatgcatacttggattcgtacttgtgataatgtcaactgcgtgctgttgtagttatggcgctctcttttgtgctctgttttgtttgtgtagggtgatatgaatgaagattaaatattatatgacagtataataagtgtatgttgtgttagaacttttctagaaaggtgcatgtacagtacaatatcatcctctaaatcatatgctatttgtatgatc

SEQ ID NO: 974 - DNA, 422 bp, Gossypium hirsutum
  Clone ID: uC-gsronu33B037f06b1
ctcttcgtcaccactttctctcccgacggccgcgttttccagatcgagtacgccgccaaagccgtcgataacagcggaactgtgattggaattaaatgcaaagatgggatcgttatgggagtggagaagctgatagcatcaaagatgatgttgcctggttctaatcgaagaatccactcagtccatcgtcattccggcatggcagttgctggattagcagctgacggtagacaaattgtggctcgtgctaaatctgaagctaccaattaccaaagtgtgtatggtgaacccatccctgtcaaagaacttgctgaacgtgtagcaagttatgtgcatttatgtaccctttactggtggctccggccctttggctgtggcataattctgggtggttatgatagagaatggtcctcaatatacat

SEQ ID NO: 975 - DNA, 474 bp, Gossypium hirsutum
  Clone ID: uC-gsronu33B037f08b1
aggttttcctcaagttcccatctttgtttggctttcgcatcagctccatggatcgggcccagctcctcctcgtaggattacctctcttcctcttcgccaccgatctcttcagcctcttcactcctccgcccccaaagccgccgtcccatcaccatcaccaccatcatccccacctacccaaacctccactcaatcctgaaaccctagatatttctttacagaaacccagcgctattggaggaatcggctatggcagcacggctaatatcaatttctgcgcttcatgctcttacaggggaactgctgtgacaatgaagaagatgttagaagcccagtttcctggaattgatgtaatccttgataactatccaccatcattgccgaaacgtttgctttcgaaagtggttccagttttccaatttggagttatgggattatgatggcaggcgaacagaatttttctatgattgggat

SEQ ID NO: 976 - DNA, 486 bp, Gossypium hirsutum
  unsure (1)..(486): unsure at all n locations
  Clone ID: uC-gsronu33B037f09b1
tcctcgcgtccgctttagctcacaggttccattgtttttcagtagtaaagagcaaaaaacagaagggaaatcaatggaagggaaagaagaagatgttagattgggagctaacaagttctcagagaggcagcctattgggacagcagctcagtcccaagatgataaagattacactgagccaccaccagcacccttgtttgagcctagtgagttgacctcatggtctttttaccgagctggaatcgctgagttcgttgctactttccttttcttgtatatctcggtgttgaccgtgatgggagttgttaaggacaaaaccaagtgtacaactgttgggattcaagggattgcttgggcttttggtggtatgatctttgctcttgtttactgcactgctggtatctcaggtggtcatatcaactcagcggtgacatttgggctgttcttgggtaggaatttgtncgtgacaagggcaatatactacat

SEQ ID NO: 977 - DNA, 381 bp, Gossypium hirsutum
  Clone ID: uC-gsronu33B037g01b1
ataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagctttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggc

SEQ ID NO: 978 - DNA, 285 bp, Gossypium hirsutum
  Clone ID: uC-gsronu33B037g07b1
tttgatagataaaatgaaggaattggagagtgtttgtaaccctatcattgctaaaatgtaccaaggtgctggtggtgatatgggtggtagtatggatgaggatgctcctccgtctggtggaagcggtgctggccccaagattgaggaagtagactaagtaattggtgtgggctctattttaaattagattcgcttaaaatacagtttattgcttgaacttgggtaattgattttgatattggtttttagacttgtttttcaatgagatgacttttaatcctttat

SEQ ID NO: 979 - DNA, 417 bp, Gossypium hirsutum
  Clone ID: uC-gsronu33B037g09b1
tcctcgcgtccgcccacgcgttcggatatgtggaaaggataggcacgactccaaagagatttgaccatgagatagacatgagtggctaccatgtgatgatgatggagcccctgttgtacacctcctcctccgccgtacgactgctccacctgcggccgcttcacctgctccggcgattgctgagaaggtcattgtgaaacccattgtgcctaatgaagtaactgcagggccttgtgccaaaacaccaaagccatctacattcgcgaggtcgttcaccattgcaggcgtgaaacaatatacaaataggttacatcaagagaatggtttggggggtggcatgcttggaagcgtctataggagaaaactctctgatggaaagtcacttgcagtcaagaaactgaaccagagagttgccag

SEQ ID NO: 980 - DNA, 471 bp, Gossypium hirsutum
  unsure (1)..(471): unsure at all n locations
  Clone ID: uC-gsronu33B037g10b1
aaagacaggcatgaagttcttgtttcagtgtgcttgctgttcttgtttctgcttcatgaagcctaagaaagggaaaccaaagatgaaggatgacaaggctgagacaaaaaaggaagtgaaggctgaaaaagagaaggaagcgaaggctgagtgaaaatgatgatttacttacattatattcttcactgctgctcaagtaaattgtatgtaacttttgtttgaatgaaaaatgctgccttgccttggttattgtagtattatttgcttgtactgataataaacttgacatttctattatgttttgtctttgtattttgatgtcatttatgttctgcaaatgttgcttgatgatatagatatcgacggttctggtttgttctgattttatgagatgtacttgaaagaacagccagatctgcttgtatacctatatttactgaggaatttgatgataaaattcattgngggctt

SEQ ID NO: 981 - DNA, 382 bp, Gossypium hirsutum
  Clone ID: uC-gsronu33B037g11b1
aaatatttcacccatgcaccctttcagtttgtgtatttcccatttgatccttttgtttttgtatatgtaagaatgtgtgtaatatatattatttacttcaatggggggagagcctttgtgtcctttttttacttgctttttttttttaagctaaaaaaaggagagggtgctgatggcaaatattggacccatttgtaatttgtatggctatgatttgtgaaaaaaaacatgtcattttcataataacaccgaccaatacctactttcaatggctttttgttgtaaattatggatttgacttggcatgatttttgtgttccttgtattatatttgctgcactgaggtgtgacaaagatataattatatggtaataattgagat

SEQ ID NO: 982 - DNA, 429 bp, Gossypium hirsutum
  Clone ID: uC-gsronu33B037g12b1
tccacgcgtccgcttgatttctcacacaataggaaattccaagactgcccttttcgagggagcgagaggttaataatgtttggagggtattctagagtttttcttttctttgattttttttcctttttaaatttgggttatatagtttatttccaattaccttattttttctttttttttttgtaaaatcatttagttgtccatattgttgttcattattttacgaggaacttaaatataatgtgaagagaatcccgtgtgttagtctgatagtcaagatgtttactatcccagttgtggtctaggtttgagttgtgccagtctcgttgctgttagagctttaagactgtgagggtgttaaaagggattgtatttacgaacttacatttttttaatgatttttcttttttcataatacatttttttgga

SEQ ID NO: 983 - DNA, 93 bp, Gossypium hirsutum
  Clone ID: uC-gsronu33B037h02b1
tttaattatatcatgtatatgtaaaagctatggtcattgaagagcgactgtatggcaccattgttactgaaaagcaacatcatggcaggattc

SEQ ID NO: 984 - DNA, 496 bp, Gossypium hirsutum
  Clone ID: uC-gsronu33B037h03b1
aaatctcagaatcaacagatcgaagtgaaaatggagtgtgtgttcggtttagtgggcaacgactttgccatagtggcggcggacacgtcggctgttcacagcatccttgttcacaaatctaacgaagacaagatcatgatcctcgattctcacaaactcatcgccgccagcggtgaatccggggacagagtgcagttcacggagttttatacaaaaaaacgtggccttgtatcagtttcgaaacggtattcctttgacgactgccgccgccgctaatttcactcgcggtgagcttgccactgccttaaggaagaatccatactttgtgaacatccttcttgctggctatgacaaagagacaggcccatctctgttctatatcgactacattgctacacttcataaggttgataagggagcatttggttatggatcctacttttctcttgctatgatggacaggcactaccacagtggcatgacagtgaaagaagcc

SEQ ID NO: 985 - DNA, 233 bp, Gossypium hirsutum
  Clone ID: uC-gsronu33B037h09b1
ataatttcttccgttgatctttgatagagattagcgtgtgaatttttcattatgggcaagaacaataccataatggctggggacacatgggttgcacacagcattcttgttcacaaatctaacgaagacaagatcatgatcctcgatttttacaaactctatcatcgccagtggagaatccggcgacagattgcagttcacggagtatattcagaaaaacgtggccttgtatc

SEQ ID NO: 986 - DNA, 436 bp, Gossypium hirsutum
  Clone ID: uC-gsronu33B037h10b1
tccacgcgtccggttttcctccaaaaggaacaacagagaagaaaacttcatcaaacaaggaaaaaacttgaagtaaaacaattgagagaagatgtcgtggcaagcgtatgtcgatgatcacttgatgtgtgatatcgagggcaaccatctctctgccgccgctatcattggccaagacggcagcgtttgggcccagagctccaatttccctcagttcaagccagaagaaatcactggcatcatgaatgactttgctgaacctggatcgcttgctccgactggattgtaccttggtggcacaaaatacatggtgatccaaggtgaacccggagctgttattcgagggaaaaagggccccggaggtgttactgttaaaaagaccaacctggccttgatcttgggatctatgacgagccaatgactccggccagtgcaa

SEQ ID NO: 987 - DNA, 501 bp, Gossypium hirsutum
  Clone ID: uC-gsronu33B037h11b1
ttttggaggcttccagaactggtacttgtggttaagtttacagggcataaacgagggatctggtgtgtagagttttcacctgttgatcaatgtgtaataacagcatcaggtgacaagactgtaaagatatgggctatagctgatggttcgtccctgaaaacatttgaagggcatacatcaagtgtattaagagaatcatttcttacacgtgggaccaagtttgtatcatgtggtgctgatgggttggttaagctgtggacaatcaaaacaaatgaatgcatcgctacctatgatcagcatgaggacaaggtttgggcattggccgttgggaaaaagacagaattgttagcaccaggtggcaggaatgcagtgatcaatctgtggcatgattcaactgctgttgagaaagaggaagcttttcgtaaagaggaagaagggggttttgagagggcaagaattagaaaatgcactgttagatgctgagtacacaaaggcaataca

SEQ ID NO: 988 - DNA, 550 bp, Gossypium hirsutum
  Clone ID: uC-gsronu33B038a03b1
cccactcgtccgcccacgcgtccgggttaagcacttgtaagcttagtgagaaacagtttaggtcagaaatgaataggttaggacaacttaggcatccaaatttggttccgctcttagggtattgtgttgtggaagaagagaggcttttagtttataagcatatgcctaatgggacattgtattctcagttgcatggaggaaatcttattggttttgggaatgggaagtttgaggttttggattggtcaactaggcttaagattggcgttggtgttgctagaggcttagcttggcttcaccatggatgccaaccgccgtatgttcatcagtattttagttccaatgtcgtgcttcttgatgatgatttcgatgctcgaatagctgattttggtctagcaagattgatggggtctcgtgattcgaatgacagttcatttatgaatggggatttaggggagtttggatatgtggcttctgagtattctagtaccatggttggttcctggaaggcgatgttttagtttggggtagtgttgtggaactggttaca

SEQ ID NO: 989 - DNA, 388 bp, Gossypium hirsutum
  Clone ID: uC-gsronu33B038a08b1
cgcgcttgtatgctgccactcgcccgagtcaagcgcgcgctagctctgtgggactcacggatagacatgatggaaccggataggacacctcaagactaccaaggagcctgcacattcatggtcttgaggtgcgggaaaacataggacgctagagtactagcgtagcgcgaatgaggcagagttttgtgagcactgtggaagctattctacagagaacggtaacgcctgagatactcgaggtgagcattccaaaaaaataagatacatggtgggtgctgccttaagaagtctagctggggcagagcttggtacacaggcgcattccgtttatcaagaattgagtgccacaggggagcttgttgatcgccagctttttgctggaataacc

SEQ ID NO: 990 - DNA, 382 bp, Gossypium hirsutum
  unsure (1)..(382): unsure at all n locations
  Clone ID: uC-gsronu33B038a10b1
cccactcgtccgtgtaaagcataagcactagggtcattttcgaagctctgtaatagttcataggcacttcttactgtgaattctcttgaagactctccccgccagaccaggaagtcatcgtgaggctcttttgcaagtgggatacagaagattttctaagatatctccgcaggaaaggattcagtgagttacaacctgagagtctgtgccttagcttcccacatccgaagcaaaaagtcggcaatttttcatatttaaaggaaatccaccatttattcttattattcactgagacaaaaatacctctttaaaggggtttctgcacatagagatttatttttagacganntaaaaaacaanaaagaacagaaaccttaaaaag

SEQ ID NO: 991 - DNA, 603 bp, Gossypium hirsutum
  unsure (1)..(603): unsure at all n locations
  Clone ID: uC-gsronu33B038b01b1
ggacataggccgaatgcaatggaaagaatagaattagatgaagcaatgctacaagggcaagcagagatatggcgttacctgtacagcttcgcagatttcatggcgcttacgtctgccgttgagctccgcatagctgacataatacactctaatggtggcgctgccactttgtcgcaaatagcttcatgcattagtgatggccttacttcaccagatatcaccgcccttgctcgcataatgagattgcttgttcgcagaaagattttcactatccaccctcctttagacggtggagatcccttgtacaacttaactcactcatcaagatggcttctacatgactcggagcaaaccctagcgcccatggtactaatggagaaccatccatggcaaatggctccttggcactacttcagtcagtgcgtgaaagaaggtggcacagccttcaagaaagctcatgggtgtgagatatgggatttaacatcgagggatcccaatttaacaagcttttaatgatggcctggcttgacatncaagtcataccagtgcatcctgtcggttacaaacaggggttcacttcattgatcgttgttgattgtcgag

SEQ ID NO: 992 - DNA, 397 bp, Gossypium hirsutum
  Clone ID: uC-gsronu33B038b05b1
agctttttcactgtgtttgggacttgccccatggcttgctgcacagattccgattctcgtcgattccgggatgatcaagcataaggatgatgcatccacatcaaatgagttttagcatgccgatgctcggatgatcaagtataaggattatgcatgctcgtcgaacaagtcttagcacattggatgttaaaggcgaagcttgagtttttcctaaataagcgcacgggcaataattatacaatttcattgacaaattaatctgccttgtgatgaattgataatgtcgaagcctcttgatttcttacttctgaaatacatataggatctaatactgctactgaatacttattgtcaaagattgaactgtatgtgcctatcaaagattagctctcttgct

SEQ ID NO: 993 - DNA, 459 bp, Gossypium hirsutum
  unsure (1)..(459): unsure at all n locations
  Clone ID: uC-gsronu33B038b06b1
ccctttcgtccggccgataataatattcaatttattacccaagatgaaaattgaagaatccaggcattgatcaacaccaaatttaatcttttccattgacttttggaggttagtgtttctcatggattccttcgttttcatcctgcccaaggcctctttagatgctactatattttctccggaaaaatctagagctggggaaagaagagggtggattttgaaactgcagttcttttgcattgttgatgaacccagtttaatggaattatcattcagtgaaaataagacactggattaatgaatcctcaatttgcttctatatttcagaaatgaagatgaaacttatattattgggcatacttcaattttatccaatgtactttaaagttgttttgaatcaagattaaaattttatgttcttaaaaaaaaaaaatnaatataaaaaaaaaaatatatttt

SEQ ID NO: 994 - DNA, 429 bp, Gossypium hirsutum
  Clone ID: uC-gsronu33B038b07b1
cggtttcgtgggcggacgcgtgggatctggtcctgcgtcttcgaggtgggatgcagatcttcgtcaagactttgaccggtaagacgattactttagaagtggagagctgggatacgattgataacgtgaaagcgaagattcaggacaaagaaggaattccaccagatcagcaaaggttgacttttgctgggaaacaactggaagacggaaggactttggctgattacaatattcaaaaggagtccactcttcaccttgttcttcgtcttggaggtgggttctaagccttaaggtctcccttaatgtgggttttctggtttctacgtgaaggactgtgccctgtaatggccatttaaataatttctaggctttgattaccggatgcatctatgtttggcttctcttagaatggaatttgcatatttacct

SEQ ID NO: 995 - DNA, 358 bp, Gossypium hirsutum
  Clone ID: uC-gsronu33B038b08b1
cccactcgtccgcccacgcgtccgcccacgcgtccgaaattgttgggtctttgatgattttgggatgggattttccttgcataaaagaactagaggggagcaaaaacaaggttgattgcccccactcttgttagggttcctttttctttttttgctttctttaattattaattactgtatttggtgagaggagaggatggatgggagacttttttgtaatatatcgtgtttgatcaatgacactctcatccttcctccttcgcatgtaattgtaatttgaaggaaatggaggttttaatttttctttaaaaaaaaaaaaacaaaaaaaaaaaaaaataaaaaaaaaaaaaaataatag

SEQ ID NO: 996 - DNA, 505 bp, Gossypium hirsutum
  Clone ID: uC-gsronu33B038b09b1
ctttttcccctaattttttgagaacttgccttgttagttaatgttaattgtcctcacttgaagaaattatgtttgaaaatctttagcttgtttaacttaaattttgttctcacaaaaaaaaaacccccataaattctgtaaataggtctgatatatgttggcttgtaataaatagcggcaagaatgagggtggctgccaatgagaaagctgaagcagagaagatattgcagatcaagagagcagaaggagatgccgagtcaaagtatctggctgggcttggtgtagctcggcagcgacaggctattgtagatggacttagagacagtgtgctggccttctctgagaatgtacctggtacatcatcaaaggatgtcatggacatggttcttgtgacacagtactttgacacaatgaaggagatcggtgcatcgtcaaaatccaactctgttttcatcccacatgggccaggtgctgtaagagacattgcttctcaaatcagggatg

SEQ ID NO: 997 - DNA, 604 bp, Gossypium hirsutum
  Clone ID: uC-gsronu33B038b11b1
ctttctcgtccgttcatcccgttgtcattagtttctgttactacttcactctccctctgtcttcaagaaatggatcgtagaagtgcatttgccgttgctttgatttgctttgtggtgaccgctgtcggtggtcaatctccggcagcctcacctactaaagctccgccggcagcgactactcctgccactgctcccgctactgcccctgttagcaaacctaaatcaccggctccaactgctgcccctaccacttccccaccaacttcttcaccaccggctgcggctccggagaagtctgcggcggttccagccccatctaaatctgctccggcttcttctcctccggctgctgctccggtgagttctccaccggctccagtacctgtgagctctcctccagccaaatcgcctcccgttgctgcaccgacgactccaccagagagctcggcctctccttccgctcttgttgcggcaccaactactgctgaggttcccgccccagctccaagcaagagcaagagcaaaagcaagaaatccaagaaacaccatgctccggctccttcacctgatatgctttggacctcccgctccaccaactggagct

SEQ ID NO: 998 - DNA, 478 bp, Gossypium hirsutum
  Clone ID: uC-gsronu33B038c01b1
gcgcccattattagacagatactcatgacgcccacacggagaactgaggtgatccggacccgctggtggacccgatctaaacggcatgtgcacgtgaccaccgaaagtcaagcgcgtggtaggcatggactctgacgtggaggcgcgagtagtgcgggggtggaggtggaagccgtgtgtggcgagggcagttgagggttacagcgcaaggctggttggtagggttctgtcaaaaatgttgttttagttagggcttaaaagttgggctagagtttaaatgtttgtattgcgctgtttgtattttgggctatggtttaaaatttgggtttgaattggtaaacaaaaatgaactatttattttggttttattcaagggcccaggctgaattgagccatatcaacgatattttaataaaaatataaaagacagtttattaataaaccatattataattatggtcatttgttctccttacaa

SEQ ID NO: 999 - DNA, 489 bp, Gossypium hirsutum
  Clone ID: uC-gsronu33B038c03b1
gaagtttatggcgagaaggcaatcctagtcactgaagtaaaagagcttgaaaatcgcttgctcagcttgtcagacgaaagagacaaatctcttgctattcttgatgagatgcgtcaaaccctcgaagctcgacaatctgccgcacaggagttgatgaaagcagcagagcaggaaaagctggaaaaagaagaatctgctcgtaacgctcttgctgaacaagaagccattatggtgaaagtggtcgaagagtccaagattctaaggcaggaggcagaagaaaattccaagttacgtgagtttcttatggaccgtggccagattattgactcactacaaggagaaatatctgttatttgcgaggatataaggttgcttaaacagaagttcgatgaccgtattccattaagcaaatcaatatcctcaagccaaaccagctgcatcctggcctcatccggttcatctctgaaagcagatcaacagatcttggtt

SEQ ID NO: 1000 - DNA, 613 bp, Gossypium hirsutum
  Clone ID: uC-gsronu33B038c05b1
ctttttctgtgttttgagatattataacaagaataataataatttgtcatagtagagataaaatttgggttcgtgtttgattgatcgatctgtcgatggaggattctgcgagcagcgatgaagattactaatattcttccaatcgagattccctcgacagtctcgagaatgaggattctaatttacaatgggccccttcaaagggtcccactaccaaggagccatcctgaattaaatgacaagcctgtagctgtatgccattcagacaatccaaaaggaactgctgaaatctcttctgcaaattatcctactcgagcttatggataggagcaaatggtttggagaactccgttgggaagaaagtttgcgggatgcacacgagtttggaaaacttattctgtttcagaacttggatctagcttactcatcagcagaagtggaggtaatatctattatgaatcacaattaagttgtgtttgaagcattttgtatttacacgcataaatttatgttttctatcacttttcctctccctacatgtgtggtttggaccctttatctttttatgagtaatgcatgtttatattgcaagatatagtttggaatgccttca

SEQ ID NO: 1001 - DNA, 588 bp, Gossypium hirsutum
  Clone ID: uC-gsronu33B038c07b1
caggtatttaagtgacagtgatgatgatgacgatgagtcatcaactaaaaagggtcggatggacgattcgtatcattttgatgctgatgagcgacgtgaatggagagccaagatcagggaagttatcagtaagcatcctgaaattcaggaggagattgaccctgctgaaaagttgagcaagatgcaaaaactcctggctgattatccgctggttgtagatgatgatgatccaaattggcccgaagatgctgatggctggggtttcaacctgggtcaattttttgataaaatcactatcaagaatgccaagaaggaaaacgatgacgatgatgattatgatagtgagaaggaagtagtgtggcaagacgataactatattcgtccaatcaaatatattaagattgctcagtgggaagagactgtattcaaggacattagtcctttaatcattcttgtccataaccgctacaaaaggccaaaagaaaatgaaagagcttgggacgagctggagaaagctgtgcacatcatatggaattgcaggctgcctttaccaagatgtgtagcagttgatgctatagtcgaagatgc

SEQ ID NO: 1002 - DNA, 476 bp, Gossypium hirsutum
  Clone ID: uC-gsronu33B038c08b1
caacttaaaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggttcttaattatgtgtaatgtgggcttttctgctatgtcagaatgtattatgatatttaagaaagtttggtttcaattgaaagaatggca

SEQ ID NO: 1003 - DNA, 591 bp, Gossypium hirsutum
  Clone ID: uC-gsronu33B038c09b1
gatgattcccaccaagcccatggttgtggagaccttctccgagtacccacccttgggtcgttttgctgtgagggacatgcgtcagaccgtggctgttggtgttatcaagaatgttgagaagaaggacccaaccggtgccaaggtcaccaagtctgctgctaagaagaagtgaaccgtgctggctaaacctaatgaagtttccgcagatggagtattttattatgataataatagtttgatagactttatcatttatgatatagttggtcttttgcttggttttgcatgttatagtgtggtgccattgttgtctggtaactgttctcagtattgggtgcttgacagacggtggcatagctatggcaggtggtctctagcgttatctggttttgtttaatttactactgtatcttgtcattgtcaagagggtgccccctttggttttccaaggtggctcgaaactttatgattttcgttgaagctgcggaattattattatgaaatcatgctgtattttttgcggtttggttaacaaaagttttttattttttcatctttgttttttatattataatttttatatctttttta

SEQ ID NO: 1004 - DNA, 497 bp, Gossypium hirsutum
  Clone ID: uC-gsronu33B038d03b1
cccactcgtccgctaatttcaatctgttcgttttaaaacttgttttattattcttttgaagaatatgtcacttcttacagatcacgttaaccttaatctctcagactgcactgacaaaatcattgccgaatacatatgggtgggtggatcaggcatcgatctcagaagcaaagcaaggacactttctgggcctgttagcgatccttcaaagcttccaaagtggaattatgacggttccagcactggtcaagcctctggcgaagacagtgaagtcatcttatatcctcaagctatattcaaagatccattcaggaggggcaacaatattcttgttatgtgcgatgcttatactccagctggtgatccaattcccacaaacaagagacgcgctgctgctaagatttttagccatcctgatgttgtcgccgaagaaccctggtatggaatagagcaggagtacaccttgttgcaaaaagatgttaaatggccaattggat

SEQ ID NO: 1005 - DNA, 520 bp, Gossypium hirsutum
  unsure (1)..(520): unsure at all n locations
  Clone ID: uC-gsronu33B038d04b1
ctattatcagctttttcaaaaatggtgggctatgctcttaaggcagctgagatacttgaaaaggagggaattgatgctgaggttataaatttgcgttctattaggccactggatagatcaacaattaacgcttctgtcaggaaaaccaacagattaataacagttgaagaagggtttccacagcatggtgttggtgctgaaatctgtgcatcagttgtggaggagagttttgcttatcttgatgcaccagttgagagaattgctggagctgatgttcccatgccatatgcagcaaatcttgagaggatggctgtgccacaggttgaagatattgtccgtgctgcaaagcgagcatgctacagagttgtaccattggctgctgctgcataattgaaccaatataggaactagaagaatacacgattgtttgccctctcaatnggtttggggaggagttggttcatttaataactgagacattgttggaaaggctggaaatttggtgacttcatttgtcatg

SEQ ID NO: 1006 - DNA, 493 bp, Gossypium hirsutum
  Clone ID: uC-gsronu33B038d05b1
gtgtgttttcaggttgtattggatctaataggttcaagtgatccagatacatccattcaagctgctatgtttgttaaacttctattttctaacaataccattcaagagtatgcttctagtgaaacagtacgagccataactgctgctattgaaaaggatttatgggccagtggaactgtcaatgaggagtatctaaaagctctaaattctttatttagcaacttcccacgtttgagagcaactgagcctgcaacacttagcattccccatttggttacatccctcaaaacaggttccgaggcaactcaagaagctgctttggatggtctttttctgctgaggcaagcttggtcagcgtgcccggctgaagtttcaagagctcaatcagttgctgctgcagatgcaattccattgctgcagtacttaatccagtctggcccacctagatttcaggagaaggcagaatttctgttgcagtgcttacctgggacat

SEQ ID NO: 1007 - DNA, 514 bp, Gossypium hirsutum
  unsure (1)..(514): unsure at all n locations
  Clone ID: uC-gsronu33B038d10b1
gttttggaggtgtacgagatactgagaagtagcccgcagtggaaagagatggcgcttctgatcacgtacgatgagcacggagggttttatgatcacgttccgacacctgtctcgggtgttcctaacccggacggaataattggacccgacccgttttatttcaagttcaataggcttggtgttagggtccccactctcttggtctctcgctggatcgataaggcaactgtgatccacgagccaactgggccaacaccgtcttcccaatttgaacattcttccatccctgcaactgtgaagaagctcttcaaccngaattcaaatttcctgacaaagagggatgcctgggctgctacatttgaaaattattttaagctgcgtactactccacgaactgactgtcctgaaacttttccagaggtgacgacttcattgaggccatgggggccacaagaagatgctagcctctaagaattccaagttgagctgggtcagnnntcatcacagctcaatg

SEQ ID NO: 1008 - DNA, 255 bp, Gossypium hirsutum
  Clone ID: uC-gsronu33B038d11b1
ccctctcgtccgtccacgcgtccggggatttaagggtattcttataaatgccaccaatgtcattatggaatttaactttactgtagttcattactaaggtgtcatttacatgacttaatactcttggattgtgaaaaaggttgtatgattcccgctccactcggatagaataagagtatgagattgacattctcatacttcatcattgcactttattattttattacaaatatatttattcagattttatcttaa

SEQ ID NO: 1009 - DNA, 630 bp, Gossypium hirsutum
  Clone ID: uC-gsronu33B038d12b1
cccacgcgtccgattttggagagccctttttcttggtgattcatgaaggtgagactttggctgaaataaaagtccgaatacaaaagaagctgcaagttcctgatgaggactttgctaagtggaagtttgcattcctctcacttggccggccggagtaccttcaagattctgatattgtatctagtcgttttcagagacgagatgtttatggtgcttgggagcagtatcttgggctggagcactctgacaatgctccgaaaagagcttatgctgctaatcagaaccggcacacctttgagaagcctgttaaaatatacaattagggactattttagattttacctccctttggtgacattgcacaaaagagtggcactctacatgaactaaaagcaaatgacaatgtgaggcaacaagttagcactgaaatggcatctgtgacctttgcttgttgatttgttggataaatgtaattctttcggtagtgtcaatttgaaggactacttccttttacgtaatcaaagtgtgcatctgcaaatgacaattacgatccgctgagatgtttgctactacttccgtctttaaatcgaggttgtttgttggttcaatctttaatcaaaacgtaaatgg

SEQ ID NO: 1010 - DNA, 605 bp, Gossypium hirsutum
  Clone ID: uC-gsronu33B038e01b1
cccacgcttccgggggaggaaaaacctaagtgcccgccctcttcttcgttctgctaaccgaccatcctcattccaccattgaagttggtaggcgatggcacgtagaggaaccatcttatctccccactttggtcctcgtatagagactgagttttagcctcgagagatcgattccgagctttgatttttggcgaagaggaaatcgtccccaatggctcgttcgcgaaggtaagcccttcttttcttattctttgatctcttaacaaaacaatgaagataggcttaacgagaaaacgaatcaactcgtagaaaactaaagcaaaaaacctagaagaaaaaccaaagaaatcaccttttgttatttctttctattcaatatgtgaatcagctcttttttttgtgtgagtatattgccttttttagaaaaggagtttccccccgttacaaataaaagaaaaatggctttatagccggaatcaaatgaaaaaatacagagaaattccttgctattttttctttgctaccatttgctgttggcctactggcattttgtttgtttttgttaatagtgcggagcaaggcgcgtgtacgggggtcgtattggc

SEQ ID NO: 1011 - DNA, 583 bp, Gossypium hirsutum
  Clone ID: uC-gsronu33B038e02b1
tgtggtttccgcagaatcaaacaaaactctagatgaacctggtaagttggtcgagcctgctgagaaccatcaccctttgtctgacaataaaactgctggtgcgccagagaccaaggagaccgatacaaggccattggacgaccggcatcttgacactgtcgagaagctgaagaagcgaagtgagagattcaaacttccaatgcccaaggaaaaagatgccatggcaataaagaaaatggagagcgaggcattgccttcagccaagaatgaaactcctgcggattccgaagttaagccagagagaccagcccgaaaacgaaggtggatcagcaagtaatagtggaacaagtaagcccacattgttgctgtgctgcaaggtctttaattattggaccccaaaggtcctgccataagggtttctgaaatgttcatgtactattaataccttcatatcacgtatgagattgtaacagtgctgccgccatgtacttttttctctcaatactacgtgtatatactagagaatgtaacattgaattagtcataagtggtgcacatattccatttactgttaatttgggat

SEQ ID NO: 1012 - DNA, 530 bp, Gossypium hirsutum
  Clone ID: uC-gsronu33B038e03b1
gttcctagtaaaaagattcaggaattgacaaacaaattgattcagttcatggaagttcacatttatcccttggaaaatgaattcaacaaacttgcaaggtctgatttacgttggacagtgcatccagaggaggagaggttaaaagagcttgcaaagaaagaaggattgtggaacttatggattccttttgatagtgctgctagggcaaaagaacttatttttaatgggagtgaacgtgctcactgtacacatgatcgtttacttggtgcgggcctctcaaaccttgaatatggatacgtttgtgagattatgggtcgctccctttgggctccgcagatctttaattgtggtgcaccagacactgggaatatggaggtattgttgcgatatgggactaaagaacagctaaacgaatggcttgttccactgcttgaggggaaaatacgctctgcatttgcaatgacagaaccccaagttgctttctcagatgcaaccaatatgagtgttctattaaaagacaaggagattcg

SEQ ID NO: 1013 - DNA, 605 bp, Gossypium hirsutum
  Clone ID: uC-gsronu33B038e04b1
ctcttatcaaagacttcagccacccacgcagcccctttaccgatccaaacaatgggacgcgtccgtacgaagactgtgaagaaatcgtctcgtcaggtaatcgagaggtactactctcgcatgacgcttgatttccacaccaacaaaaaggttatcgaagaagtagctattatcccatccaagaggctccggaacaagattgctgggttctcaacccatttgatgaaacggatccagaagggtccggttcgtggcatttctctgaagcttcaggaagaagagcgtgagcgtcgtatggattttgtccccgatgtatcggctattgctgttgattcaatagaagttgataaggaaaccattgatatgctttcacttcttggaatggccgatcttcctgggattgttaaggttgatccggttgctgttcaggttccttaagtcgggttcggacgtggtggtggacccggaaggagggtttaagtggggggttttccatggatatgatggggtctaattttaaagttgaattggtttcttttgggaatttggggttttgtgggaaccattttagtatggcttaaggttctgaaatttattaggttggt

SEQ ID NO: 1014 - DNA, 478 bp, Gossypium hirsutum
  Clone ID: uC-gsronu33B038e05b1
cggtctcgtgggtttttaccattcatagcatagcagcttagtccaactccacacccaccaccattggctgtttgtaatcatccgaaaaagaatggtgaccgtggaagaagttcgtaaggctcaacgtgcccaaggccctgccaccgtgttggccatcggcacatcaaccccgcctaattgtgttgatcagagcacataccctgactactatttccgtatcacaaatagtgagcacaaaaccgagttgaaagagaagttcaagcgcatgtgtgaaaaatcgatgatcaagaagcgatacatgtaccttacagaagagattttgaaagagaatcccaatgtatgtgaatacatggctccttcactggacgctaggcaagatatggtggtagttgaggtgccaaagctaggcaaagaagcagccaccaaggccatttaggagtggggccagcccaagttcaagatcacccaccttgttttt

SEQ ID NO: 1015 - DNA, 622 bp, Gossypium hirsutum
  unsure (1)..(622): unsure at all n locations
  Clone ID: uC-gsronu33B038e07b1
ccctttcgtccgcccacgcgtccgcacaaacccaaatctccaattctgtttcatttttcagcaaagctagaaagacaatgactaaggatattgagactgcagagcaacgtggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcaccgctggtatctctggagggcatatcaacccggctgtgacattcggtttgtttgtgggacgcaaggtgtcactcatccgagccctgatgtacatggtggctcagtgcttgggtgccatatgtgggtgtggattgctcaaggcttttccagagacctactacaacaacttcnggggtggtgcgaacgagcttccaccagggtttaacaaaggactggactgggtggtgaatcattggtactt

SEQ ID NO: 1016 - DNA, 668 bp, Gossypium hirsutum
  Clone ID: uC-gsronu33B038e10b1
gtttgcaagtttttaaatcaatgtggttttaaaagcaatttttttaatgttctgcatatactttggagattggatacctcaaactttaatatgtctgcttcatgtttcgactatcctaccttttttttgaagaaaatgaaaaaagaaagattcattttctcaagggaaaaaaatgtcaatttttttttgaaaataattagtcttttaaaaacgtctatttgcccttcttaattggcattgagcttgcctcatatgaagcttttttgagctaatttgttgatgatataaccagaaggttagttaatcttttcttttccttcttttttttcgtttttaaaatttttctatctttgtagtttggattattttatttaggaatttagatattatttatcataaattttaatattatttaattgtcataaagataaattttatttattttaatatttaaatttgttattttatttttggattaggtagttttggttgctgttagctcactaggaagctcatcttttttactcatgaaccttagattaggtattaatagatactttatttaatattaattacttaacagatggttgtaaaagttggatggtgcttcaagattagcaccatacctactggatagaagattttatcattgcattgaaatcattttt

SEQ ID NO: 1017 - DNA, 534 bp, Gossypium hirsutum
  Clone ID: uC-gsronu33B038e12b1
ctctctcgtccggtcaaaaaaaaaaaaaaccctagccgtagtcctcttggtttttaggtttctttctagaagggagagttctgtaagagatctattattttttagttcataagttttttcgtatactgaacaatcttctgttactgattcataaatttctcgtggaagttcttgggatttcgaaaagaaaaatccgataatgtcttggtgctttccttacccgcccccaggatatttaaggcaggggtttgcggaatccattaagctcgagaatgagaaggtaccgtccaaaacagaacagaaaatacacaagagaagtgagaagaagcagaaaaagaaggaaagagtaagaaaggataaaacgcatggtctcgccaagaaatttaagcatgatgattccctaaatgtctataaatatgaccaattggagaatagtgatcttaccgaagaacatgggccacctgtttgctacacattttttggctgtcaaaacagcaacaagaggaaaagggaaacttttttctttagtgaatg

SEQ ID NO: 1018 - DNA, 647 bp, Gossypium hirsutum
  Clone ID: uC-gsronu33B038f02b1
cccacttttccgattagtggaggccaagatgaagaaactctgtgatttactgagtaagacaattgaacaaacaaaagaaaatgtagtaaagaagcaagcgttgacatatgaggaaatggaacaagaacgggaggaggaagagacacaagttgacactgaaagtgatgatgaagatcaacagatctataatcctcttaaattgccaatgggttgggatgggaagcctatcccttactggctttacaaacttcatggtcttggtcaggagtttaagtgcgagatttgtgggaactacagctactggggtcgtcgggccttcgagaggcatttcaaagaatggcggcatcaacatggcatgcgatgccttggtatccctaacactaagaacttcaatgaaataaccaatattcaggaagcacaagaactgtgggagaagataagagaacggcaaggagtgaatttagacgagaatcccaagaaaataggtgggctttaacttcagccgattttctttgtattagagaaagaacaatgaattttcttctatttttaattaattttccttctttttttttgatattatgccctttacattgaaaaatggtagtttatttttaatgaacctgttttgttgtttttgagcaacc

SEQ ID NO: 1019 - DNA, 593 bp, Gossypium hirsutum
  Clone ID: uC-gsronu33B038f04b1
cccactcgtccgagagcatgaaggaagtggcagcttttcttggacatgtcggcagcaaaacttcatgtggttatggagtggcaactgggggaccattggcttggggtctatgctacaacaaggaaatgagtcctagcaaattgtattgtgatgattactacaaatacacctacccttgcactcctggagtttcttaccatggccgtggtgccttgcctatctattggaactacaactatggagaaacaggcgacgcattgaaggtggacttattgaaccaccctgaatacatagaaaacaatgcaaccttagctttccaggcagcactctggagatggatgacaccggtgaagaaacaccaaccgtcggcccacgacgtgtttgtcggcagctggaaaccgaccaagaacgacacgttggccaagccggtcccggggtttggagccaccatgaatgtgctctatggagatcaagtttgtgggcgaggtgatgttgacaccatgaacatcatcatctctcattacctttcttaccttgacctaatgggagttgggagagaagaggcaggaccccatgaagtgcttacatgtgaa

SEQ ID NO: 1020 - DNA, 523 bp, Gossypium hirsutum
  Clone ID: uC-gsronu33B038f06b1
ccctctcgtccggtgaatcgaggcagaattcatcttatcgtacgagttcggcttcatgggattctcatactggcaatcctcagtatggtcaagaaagcccgagttatatatcacagtatagctctgcctccccgcagtattatccacctccgcaaaaccgtggcagtgataaaaggacactagaccggaggtattccagaattgcagacaattacaactccttagatcaggtgacggaagctcttgctaatgctggtctcgaatcttccaatctcattgttggtattgatttcacgaagagcaatgagtggacagggaaaagatcattcaatagaaaaagcttgcaccacattggaaatagtttaaatccttatgaacaagcaatctcaatcattgggaaaacgttagctgccttcgatgaggacaatttaattccttgctttggattcggtgatgcatcaacacatgatcaagatgtctttagtttctacccggatgacagattttgtaatggatttgagga

SEQ ID NO: 1021 - DNA, 597 bp, Gossypium hirsutum
  unsure (1)..(597): unsure at all n locations
  Clone ID: uC-gsronu33B038f07b1
attttattattattgttataaattacattatatagtaaaaatagcataatataaaacattacaaacttgaaaaacgggccaggtcgggtttgggcttgagcttggccgttgaatgctctagctcgagcctagtgtttttgcctaaacccttacaaatttcaggcaggcttttgggccgcctaggacaatgaataggtctcagtggtaccatgtaccccaacaagtgacctatatggaataggttagggggtcaaacccagtaagggcgagacactcaggttgccacttgttgtgtggtcgtacacccacttacgatcgaggcgctcctggctttgtgaactaggcccttagggcagccgctcgtggcatactggctctcagcagagcacgggagacaataccttctcccggaggacaataccttatgttgttaagggaccggatcgactgcttggtggacgacactttgaagacttctccctaagatttcttttagtttagccctggaaatatttctgttttctctgaatatgattttggatcaatttgggttagttttggatagtcaaacatatattatttgggattgtacttgng

SEQ ID NO: 1022 - DNA, 174 bp, Gossypium hirsutum
  Clone ID: uC-gsronu33B038f11b1
gcgtgcggctgccctttttgttattaatcatttgatcgttttttttttttttttttcttttttatttccttttttttttttttttttttttttatttttttattagggaggacaaaaaagcaccgacaccccgcaggatttcccctcctccaactacctcaaaccaacaaaaac

SEQ ID NO: 1023 - DNA, 591 bp, Gossypium hirsutum
  Clone ID: uC-gsronu33B038g01b1
cccacgcttccgcttttatctcatgaaatgcaagagtttctcctctttttgataaatacttaatttcgcttcatttgagtcttctttcttaaatttcgtctaaaaatcctctcccaatttcatttccaaagcttttcaattctcttgattgttcatatattataaatttcttctttttcagccatgggtgttgcagttctaaaaccagacgattgtttgaagctaccaaatcccgtgaaacaacgaaatagtctttgccttaatccgaaccgatcgaatcggtcacacccaaaccgtaaaactcggtctcctactacctcccctccttcccagtcggccggccccaaggtaccggctaaagatctcgtgatgggtcaagttaagatcctcaaacgcggtgaggttctaaaaataccgacgccggagaaatccgtcaggttcgaaaaggaaaacattgacgttgcagatctgggttccactaaccgtttgggtcctgaaacccgttccgttcctacccagatccgactgaccaagtcaaacaacaataagaaggtccgtccagcctctttttatgctgggtcgcctttataa

SEQ ID NO: 1024 - DNA, 521 bp, Gossypium hirsutum
  Clone ID: uC-gsronu33B038g02b1
cccacgtttccgcaccaacccccacagatcccatcaaaatttctttccattgatggctcacatttgaccttaccaaccaaacctactcttctttggtttccctttatttttatttgtttggtatttttaggttcaaccccagcacacagagtttgtggttggttagtggcaaccacaagacaacaatattaagttttgggttcagtttgaacagctattctgtgctgcccttcttcttcttcttcaaacaagcagaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatc

SEQ ID NO: 1025 - DNA, 425 bp, Gossypium hirsutum
  Clone ID: uC-gsronu33B038g03b1
aaaaatgtagcttctttttattgggaattctggatattctttctcaagtttgctgagagagaaagaaatggcacaacgatctcatgtacccaagtttggcaattgggagggtgaagaagatgttccttacacagcttattttgacaaggctcgtaagggccgaaccggagggaagattgtgaatccgaatgatccccaagagaatccagacttgcgtcgtgattatgtggctccaaataaagctcctccggcgtcgagaacgaatccggaagcaaatgaactggtaggagatggacctgttagaaggggacatgagtgtggaaggagcagggatgaagttgacttcaaacagtatgccgactctccggtacgccatgacaatggcaaccgtagagctttggtggacagtacacctacacgttatg

SEQ ID NO: 1026 - DNA, 225 bp, Gossypium hirsutum
  Clone ID: uC-gsronu33B038g05b1
cccacttgtccggctagtaataagtttgggctagggcattggtttgggtattgggttagggtatagttattgggccatgtaatggggacattttaatggcccattcaattaatttatatttggtttatttttatttattttggtttttttgggtgttgggcccaggcaaatttggcccattacaatatgatttacaaaataagttatataaaattacttttttat

SEQ ID NO: 1027 - DNA, 504 bp, Gossypium hirsutum
  Clone ID: uC-gsronu33B038g07b1
cccattcgtccgagacgtggttcatgtcagagctagaagaggtgaagctactgatagtcacagtttagcagaaagggttagaagagggaaaattaatgagagactaagatgcttgcaagatattgtcccaggatgctataagacaatgggcatggcagtcatgttagatgagatcatcaattatgtccagtccttgcagaatcaagttgagtttctttcaatgaagctaacagcagcaagcacttattatgacttcaactcagacacggatgccgtggaaagaatgcagagggaaaaagcacagggggcaaaagatgaaatggacaaatttatgagagaaggagatactgaaagactagcttgcttccactcatcaacatggtcctctttgacttaatttctacatccatgcctatacttaattgccttacaaaacatatgatcatggagatgctatatttttcaactctttttttttctttctatttaaatgtattatgatca

SEQ ID NO: 1028 - DNA, 228 bp, Gossypium hirsutum
  Clone ID: uC-gsronu33B038h01b1
gttctcatccttgtcgttctgcacatcctgctcgtttctctcctgatgataaatttagtaaagaacgtgttacatgtaaaaaacgatttggtatcttacccacacaacaaccagctgtacgatattaagcaacagcaatcacacacattcaatcacatgtcatacatagaatagaaaaacgcagcacttggataggtggaaaaaagcaacaaacacgcatcgtcttgg

SEQ ID NO: 1029 - DNA, 593 bp, Gossypium hirsutum
  Clone ID: uC-gsronu33B038h03b1
agaatcttatgtccaatagtagcagaaatcggtgccgatgaacgattaccagaatctagttggacaccgcctcaatgttccgatctgggtatcaagcacacaatgcatacattcactcagacaacaccccatgtaacagcgcggcatggaatgaagagtgtgaccattaaggctacatacagggaagatataatcagatttcggatctccttaagtagtgggatagtggaactgaaggaggaagtggccaagaggctgaaactggaggaatgtctagatgtttcaagatcatcaggcagcaatatcattcgattatcagttcacgacacgatggccaatttagggagttcctgtgagagcactggagagttgtgattatgttgggtatatatatatatttaaagtgtaattcttatagtcagtcctagaatttaggcgagtgaaactgaagattttgtttccaatagctttctcaagtgtaagaaacttagaaaaaaacttccatgaatccaatttgttatctttgctaatgaataaggacgttttatttgtattcttacaactttatttctaatgcatcaggaagtctttgt

SEQ ID NO: 1030 - DNA, 261 bp, Gossypium hirsutum
  Clone ID: uC-gsronu33B038h04b1
gggagatatcctcacattgctggagtctgagagagaagcaaggaggcttcgttgaagggttatttttatactttttggggtttgtgcttgttttgaattgtctaccgtatttcttttgaattacgtttagtaggtattcgtatatcgagacttgcgatttgggagaatggttgtttcttaaacctggattttatgatgattatgttgaaatgaactgaattggttttgagttttggttatatttttgcctcccgttttgag

SEQ ID NO: 1031 - DNA, 577 bp, Gossypium hirsutum
  Clone ID: uC-gsronu33B038h05b1
ataatttcttccgttgatctttgttagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacctacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaaggctgctgctcacttgaagggtggcgcgaagaaggttatcatttctgctcccagtaaggatgctcccatgtttgttgtgggtgtcaatgagaaggaatataagcctgaccttaacattgtctccaatgctagttgcaccacccactgtcttgccccattggctaaggtgatcaacgataaatttggcatttgtgagggtc

SEQ ID NO: 1032 - DNA, 93 bp, Gossypium hirsutum; identical to SEQ ID NO: 983
  Clone ID: uC-gsronu33B038h06b1

SEQ ID NO: 1033 - DNA, 247 bp, Gossypium hirsutum
  Clone ID: uC-gsronu33B038h08b1
attattttttggttccccttttctttcttcttccccctttaacgtgcttgtgcattattagtcatcgctgagataatctccttagtttgaatatgcaagcaaaaaccctattgatgcagcagaaaggaaaattttaatacccaacaaattcaaaagaaaattaaggatcgtgaaagttacccagattatttgaccattttaatcttgtaccaagatgaagttgggaatgatgttttgcaagtaactg

SEQ ID NO: 1034 - DNA, 597 bp, Gossypium hirsutum
  Clone ID: uC-gsronu33B038h09b1
gcggtttcgtcgacgttggatttcaactccgggttaccggctgactcagtggttgctccgttaataaggagccgaaaggtggataccttttattacgtcggtctgaccgggcttagcgtaggcggccaacctgttcaactcccgccgggctttttcgagttggaacaatcgggaaacggaggagtgatcgtcgactgcgggacggccataacacggttgcaagcggaggcttacaacgcactccgcgacgcgttcgtgaaattatcgccggacttgccgaccaccggtggggttgcgttgttcgacacgtgctacgacttgtcttcaagaaccagtgttagggttccgtcggtggcgtttcatttcagcggcggaatgtcactggacttgccggcgaaaaattatttgataccggtggactcatcgggaacgtattgcttggcgtttgcccccacgacgtcgtctttgtctataattgggaacgtacaacagcaagggacacgtgtgagcttcgatttgctaataataaggtcgggtctcttctcataatgtaagacagtaaaaaatagcctatggtgatatttactaattacctat

SEQ ID NO: 1035 - DNA, 542 bp, Gossypium hirsutum
  Clone ID: uC-gsronu33B038h10b1
cgagtttagttgttggctgcaagaaagtgtatgtcaccgtgtacaagaagaagtaagctctgtgaacgattcaggttacttggaacacttattctttctcttgactgggcgacaacttgatgcagctgtggagctggcagcttctaaaggagatgttagattggcttgtttactaagccaggctggtggaccaacagttaatcgttctgatgtttcaagacagcttgatatttggagaattaatggtctggacttcaatttcatcgagaaggacaggattcggctttatgagttgcttgctggcaatattcatggtgctttgcatggtattaagattgactggaagagattcctaggattgttaatgtggtatcacctaccttcagatactgctttgcctgttgtgtttcgaacttatcagcaccttcttgatgatggaaaagctccgtttcctgttccaatttatattgatgaaggaccagttgaagagaatgcaaatttgagcagagtggaaagatttgatctttcatactaatctatgc

SEQ ID NO: 1036 - DNA, 592 bp, Gossypium hirsutum
  Clone ID: uC-gsronu33B038h12b1
cccactcgtccgctttgatgtcaatctgcccaacttcagatgaacatagtccaagaaacaacaacaatgtttacagtcgagagtttcagtcgatgttagaaggattcgatgaagaaggttgttttgaagaattaacagtcggccatggcggcggtgccaagaagagaagattaagtgtggatcaagtgaaggcattggagaagaattttgaagttgaaaacaaactcgaacccgacagaaaatcgaaactagctcaagaacttgggttgcaaccacgacaagttgctgtctggtttcaaaaccgacgtgctagatggaaaacaaagcaattggaaagagattatggagttcttaagaccagttatgaatctcttaagctcaattataataacctccgccatgaaaatgaagatcttctcaaacagattagtgagctgaaggcaaaactcatcgagccgccgccgggttcatctttgggtacctcatcggagccggcggaagtgaactgcgagagcttcaacgacggcggccgcaatggatcagttggtggtggtggcgacacttttttttcggacttgaaagacggatcatc

SEQ ID NO: 1037 - DNA, 198 bp, Gossypium hirsutum
  Clone ID: uC-gsronu33B039a01b1
gcctgctctcttccactacccccccccccaagcggagcggcgctcaaagagtatcagcaccttcaaagaaaccacaactcaaagcaatggcggacaaggctgttaccataagaactcggaagtgcatgaccaacaggctcctttcaaggaagcaatttatcatagatgttcttcataccggacgaccatttgtttcat

SEQ ID NO: 1038 - DNA, 161 bp, Gossypium hirsutum
  Clone ID: uC-gsronu33B039a04b1
caatactttgatgtactttgggttcataatcccgtatttcttcatgaaattggttctttaagcagtttgtaagattttacttcgcaataatcgagttttatgttggataactccaatatggtctcaatacaacagacaacattgtagttgattgatttaga

SEQ ID NO: 1039 - DNA, 426 bp, Gossypium hirsutum
  Clone ID: uC-gsronu33B039a05b1
ccctcgtgttcgaaataatatctgctcgttcttatcctgctcgctactctccactcaaatggcgctatccttaaccatcagcaatggcatcagtagcagtagcaatgcaaatgggggcccaatccttcccaacaaccagctacctttcggtctccctcatcgccgcaacgtcctcttcccaatctgccccagaaccttccacttgacctccgatgccaaaaagttctctttccgaaccggacgcttcgatagcaagaaccggaggagcaatctcaccacaaaagaacaagatgaggaacaggagctcaaacggacggcggagattgaagaatcaaacattgctattggagttggattggaggacgttggtgggagtttcgtctgagatttcggctgatggtaagccgttccccgatcttacgggcc

SEQ ID NO: 1040 - DNA, 81 bp, Gossypium hirsutum
  Clone ID: uC-gsronu33B039a06b1
cgagtaagttggggtggaacccggtgtggtttgtttgtttttatcctcgaagttaggcacatgatcccctgctgctacaag

SEQ ID NO: 1041 - DNA, 445 bp, Gossypium hirsutum
  unsure (1)..(445): unsure at all n locations
  Clone ID: uC-gsronu33B039b01b1
aatctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggctcttaattatgtgtaatgtggcttttctgctatgtcagaatgtattatgatatttaagaaagtttgttttctattgaang

SEQ ID NO: 1042 - DNA, 253 bp, Gossypium hirsutum
  Clone ID: uC-gsronu33B039b02b1
gtaatgatatattgtcaaggatggatgcctgcaaggtctataattatgtctctgtctgtgtcttgtgtaatagaagctttgattgtggtgaaaataatgtataagccatgtggttgagagcatattgaactttacttcaaaggattttgattggtcattcatggtgacttggtttatggttttatctgttgatgttaaaatattataaaaatatttttttggttgcaacttctttttttcaatcaaatacatt

SEQ ID NO: 1043 - DNA, 343 bp, Gossypium hirsutum
  unsure (1)..(343): unsure at all n locations
  Clone ID: uC-gsronu33B039b04b1
ccttcgtgtccggcgccgctcatctgcttctcttctccttctcttgcctttccaggttccaaactctcgttcttcctccagctcctatcctttaacaggaaatggcggttacattcaacgacttgggttctgctgccggcttgaagaagctcgatgagtatctnctcactcgcagttacatctctggataccaagcttcaaaggatgatattaccgtatacacaaaaaaaaaaggggggccccttttgggggtcccagtttttcttccccgggctgggaacgaaaaagtttttattgggggccccaaaattaaattcccggcccgggttttaacaccgtgggg

SEQ ID NO: 1044 - DNA, 391 bp, Gossypium hirsutum
  Clone ID: uC-gsronu33B039b05b1
attctgaagaggatccacaaattatgaggctaaagagaagcttaaggccagaactaggagaacctgtgattttgaggtgtcagccttacaaaattccattgaccgagcttctcttgccacataaaatttcacctgtcgagtttttccgtctatggcctagtttgccagctattgtggaatacactggcacatacatttatgaaggaagtggcttcaaggctactgctgcgcagcagtatgggtcttctccatttttgagtggactgaaatcactgtatttcaagcctttccacagagtttgttcacacatcattcgcactgtggctggatttcagctatgttatgctggaaaaacttgacatgggggctttattgcgcatgaatgattttt

SEQ ID NO: 1045 - DNA, 777 bp, Gossypium hirsutum
  Clone ID: uC-gsronu33B039b06b1
ataggtacaattaggagttccttagttgtgttgtaggagccaaagataaaaaaatggtgaagatagcttttggttgtattggtgatttttttagtgttgtgtttttttttgtataatttttgttttttttttttattttttgttttttattttttttttatttttttttttttttttattatttttttttttattattttttttatatttatttatttttattttttttttaatttttttttgtttgtttttttttttttttttattattttttaaattatttttatatttattatttgtttttttttatttttatttattttttattatattttttttattggatatttttttttatttttttttttttttttatattatatttttaatattttttttttgtattttttttttattttttaatatttttttttatttatttttgttttgtatttttaatttatttatattttttaatttttttattttttttttattttgtttatttattttttttttttttttaatttatttattatttttattatattattatattatgatttttttttattattatgtttttctattattttgtatattttttattttatcttatctttattttttatactttttttttctatttttttttttctttttttattttgtatttattttgttttatttttttttaatctttacttttttttcttttattctttatttttattcttattttatattaatatacttttttttatatatatttatttt

SEQ ID NO: 1046 - DNA, 312 bp, Gossypium hirsutum
  Clone ID: uC-gsronu33B039b10b1
cccacgcgtccggcttgttagtgtctggtttctatcgatattttttcttgtattatcaggagttttaaaacatgaaagtggaatgaagtaaatgctttcttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaggaaccaaagttaacttccccgggatgggaattaaaaatttttttaatggggcccccaaaataa

SEQ ID NO: 1047 - DNA, 475 bp, Gossypium hirsutum
  Clone ID: uC-gsronu33B039c01b1
gctcttgcgaatacgaggatgtgcgagtgatgtgggaaatgctgagcagaaacgaagcagaaaccattcgatccccaacaacaagtaaaggaagatgcagaaagagaccattgtggaattgctttgaatgggcaaagcgagctccttttttttgtcgaagcttctgaataactgtcagagagtgtgtcttgttgccactcagggttttcagtttatcatcctatcttagacctttgtttggatatcatcgatccagtgataataaaagaaaaaaaaatagggagagaatggagggatttgtttgtgagattgcccctcttctttcctttggtgtttttttttctgttatgtatgactcagttatctgtagatatcaaccgtctgtcatgtccatgcttttatctttgggtctatgtaataagctgctatatatatgtgcatgttcttctccaggctctttaatcttgagggtggt

SEQ ID NO: 1048 - DNA, 264 bp, Gossypium hirsutum
  Clone ID: uC-gsronu33B039c02b1
tcatagtacgtttgctggtttgaaatccgtggaaggattagtatgtccatgctttcacccatgacgcactacaaggttaaatttgttttgcaggtagatgaagtgtaagggtttgatattaatgttttaacatattattatgtcttattctatttttgtcttttatatctctttcttaattggattaaattagttttaattagccttcctgttttggttccagttattaaaataattaattcagttttttttggttgattgggt

SEQ ID NO: 1049 - DNA, 194 bp, Gossypium hirsutum
  Clone ID: uC-gsronu33B039c04b1
gatggttccaaataccccatcagctttagataaatttaatgacacaataagcaaggattcccaaatatacaagagttctagtctttcagaagcctttatagcccctgggaatggtgaagtaactgaacttgattccaagaagctcgttgctgataaaattgtgactggagaccaccaggatgctgtccttttaa

SEQ ID NO: 1050 - DNA, 210 bp, Gossypium hirsutum
  Clone ID: uC-gsronu33B039c05b1
ggctcatggagttatgtatgtaagatggataatgcattactcaagtatgctgtgatcagccatcctctgactagtccatctgtttcatcatccactctgattcagaaggttccacctgaattagatatgataaacggtgatgcactttcagcagcctctgcctcgatggccacttttgaaccagtttatgatgaaccccagtgagaaaag

SEQ ID NO: 1051 - DNA, 105 bp, Gossypium hirsutum
  Clone ID: uC-gsronu33B039c06b1
ccctctcgtccgcccgacttttacgtttccaattctgaaaagaaaacgttggttagggattttgaggatgagttccaccggaggatcagcgaaaggagggagagg

SEQ ID NO: 1052 - DNA, 308 bp, Gossypium hirsutum
  Clone ID: uC-gsronu33B039c07b1
cccacgcgtccgggataatcttgtatgggtggctttgcctgcttgaatatatggagaaaaattcagtagatatcatatttcatgtgatgttatttgtaatgttattgtatgatatgaatgttaatatataacaccatgttcgagtcggctcagtgatttagaaccacgccataaatggaataaacgagttcaattagcctccctgtttgtgtaccagcaataaaataataaattcagttttttttgttgcaagggtttataaaaaacaaaatttaacaaaatccaacctatttttttttataatattg

SEQ ID NO: 1053 - DNA, 176 bp, Gossypium hirsutum
  Clone ID: uC-gsronu33B039c08b1
gatctgaccttcgattcttgggttatatagctaatcaaattcatggttttacactgtggcttggagtggaacacatgactgttctatctgctgctgcctgctttggtttgatgaaaccattaatgagcagttaaagcttgttataggcccggctctgcttgaaaaacatggtagga

SEQ ID NO: 1054 - DNA, 165 bp, Gossypium hirsutum
  Clone ID: uC-gsronu33B039c11b1
tcaacactgagagtactggacctgatgggttgttgtcttataactgaagatgctatctaacattttatatggaaacatgctcaagttgagatacgacacgaaattgttcaaaaccttttaacagagtagcatctcaattttgaactgcctattcacatcacaaca

SEQ ID NO: 1055 - DNA, 176 bp, Gossypium hirsutum
  Clone ID: uC-gsronu33B039c12b1
cccacccacgcgtccgctcatgcgaacctgttgaaggctttaattttagtactactagcgttgttaacaagatatctacaggcaagttctgatattccagctgagccactcactcttctacctcggatataactgtcttggtgctgtcggccttattgcggtatgccttgcactac

SEQ ID NO: 1056 - DNA, 194 bp, Gossypium hirsutum
  Clone ID: uC-gsronu33B039d03b1
aaaaaataaaataagaaacaatcaaaccaactggtttaacctgtggtccagtttctttaacattggcatttatgtcatttaatgtcgaacttctacatttatgtctttcattttgaatttttagatgatagtagtgtcaatcaattctttgtcccttgttatgctattagttcctttgttttgttttttctttc

SEQ ID NO: 1057 - DNA, 100 bp, Gossypium hirsutum
  Clone ID: uC-gsronu33B039d05b1
gcctcatccgcgtcccagccttttctgtctccaaattacaaaacaccctctacgaatttttttttattttttggttcttttaaagttaaagtactggttc

SEQ ID NO: 1058 - DNA, 555 bp, Gossypium hirsutum
  Clone ID: uC-gsronu33B039d09b1
cccacgcgtccggcagctcgcacgctctcatcattttcctccgggaccgtcagtctccccaaacaccttctttccgagaaaaagaaaagctcaagagagaagaccatggccgatcaacttacggacgatcagatctctgagttcaaggaggctttcagcctttttgacaaggatggcgatggttgcattactaccaaggagctggggactgtgatgcgatcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagatgagaggttgatgagatgatccgtgaagctgatgttgatggtgatgggcagataaactatgagagttcgtcaagtcatgatggccaagtaggat

SEQ ID NO: 1059 - DNA, 440 bp, Gossypium hirsutum
  Clone ID: uC-gsronu33B039d12b1
cctacgcgtccgcccacgcgtccgactctctctcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgccttctgttcaaccctgctgctctttcatccaaggtcttgctgatcttgaagcttgccgtttgtctttgcacggtaataaatgcttatattttgggcatcaaccttaatg

SEQ ID NO: 1060 - DNA, 329 bp, Gossypium hirsutum
  Clone ID: uC-gsronu33B039e05b1
ctggaataaccattctcccactattttcccaggccacaccaaaagccaatttgcctgaagaggatatcaaggctctaacaaagcgaacacaagatggaggcactgaagttgtggaagcaaaggctggaaagggatcagcaacattatcaatggcctatgctggtgcaattttcgctgatgcttgccttaagggactgaatggtgttcctgatgtcgtggaatgttcatttgtacagtcaactgttactgaacttcccttttttgtttctaaggtaaggcttgcaatgaatggtgcggcgttacgttatttttctcattcttcctcatta

SEQ ID NO: 1061 - DNA, 137 bp, Gossypium hirsutum
  Clone ID: uC-gsronu33B039e06b1
catagtcaaggctggaattattcggcaaatggaggcatttcgagctggatttaatcaggtttttgatgttgcatcattacaaatatttactccccaagagttggactatttgctatgtggtcgcagtgagttgtggt

SEQ ID NO: 1062 - DNA, 1008 bp, Gossypium hirsutum
  unsure (1)..(1008): unsure at all n locations
  Clone ID: uC-gsronu33B039e12b1
tgctcacgcgtccggcgtaaaagattacaatgaacagatcctttggctttatagccggagaaataaaatgatagaaaataaataatgaaaaatacaatattctttgtttttgnttttttttttttntttttttttttttttttttttttttntttttttttnttttttttttttttttatttttttttttattttttttttttttttttttttttttatttttttattttttttttttttattatttttatttttttttttatattttatattttatttaattttttaattttttttatttattttttttttttttttatttttttttttttttatttatttattttttatttttatttattttatttactttcatttcttaattcttattttctttcttctcttttttttttttattcttctttttttccatttctatttttttaattcttaatcttttattttactacttatttcttctcttttttcacttttccttttactttttcttcttttattttttttttccctttttcctcttcttatttctttttcttttatatttatattttacttttttctaatttattattcttcttttcattcttattttttttttatatttaattctactatttctatcttattcttttatttttttccattttcttcattttcttataatatttttattactttctttatttttttttttttcttattttttttttatttttttttaataatctctttattttatttttatttttttatttctttctctctcctttcttcttttcttttctttttattttttttctttttttcatttctctctttattttttctttttttatttttacttttctttttctctttattctcttctttttttttttaattctttctttatatatctcttctacctttctttttttctccccttttttccttttcttctttttccttttttttttttaatttattattcccccccccccccccccc

SEQ ID NO: 1063 - DNA, 429 bp, Gossypium hirsutum
  Clone ID: uC-gsronu33B039f03b1
ggttgatgagacacctatggtcagttacgtgaatgtacatgctgtactcgaaggacgaagaaaccgtgctaaagctttgtcaccaaatgactctgaggcatcccagggacccagagtgattgttgtggggcctactgattctgggaagagcaccttatcaaggatgcttcttagttgggcagctaaacaaggttggaaacctacctttgtggatttagatataggccaagggtctataacagttcctggatgtatcgctgctacacctattgaactgcccattgatcctgtggaaggaattccttttgagatgccttttgtttatttttacgggcctacaacttctagcaataatgtctatttatataagacactcgtgaatgagctggcttaaatgctggagactctatttgcttgtaatgctgagtc

SEQ ID NO: 1064 - DNA, 67 bp, Gossypium hirsutum
  Clone ID: uC-gsronu33B039f10b1
ttttgacagtatatactggtttgcatgattagcttgtttggaaggtatattatggtggcttcttttt

SEQ ID NO: 1065 - DNA, 232 bp, Gossypium hirsutum
  Clone ID: uC-gsronu33B039f12b1
gtcgactgtcttcttgttatcaccgcgtactgatggagggaaacgaggctaggtatagcatcggattgtttgcaaggccaagaggagggtacctagtaaaggttccgaaagagcttgttgatgacaaaaatccgatgctcttcaaaccctttgacctggaagaattttagaaaacttttctccccccagattgttcaaggacgtggtaaatttgctacttaaagcttactgc

SEQ ID NO: 1066 - DNA, 279 bp, Gossypium hirsutum
  Clone ID: uC-gsronu33B039g01b1
gttgtttctggagcatcttgatctgtctggatgtgctaacttaaccagtcgggacattctgaacgcgacatcaaatctgaaggatatgaaggaggaacagaagccaaattgttatcttccgatttttacatgagactccctatcttttattcttgattgtttccaaatatacgatgatcgaatctttgaatcagataattatgggaagttttccacttcattatcatcatcatcatcatcttccatggttgcttcttctgctagtactaagattatttt

SEQ ID NO: 1067 - DNA, 428 bp, Gossypium hirsutum
  Clone ID: uC-gsronu33B039g02b1
ctctcttttttcctcctagcccaaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctatgaggaaaccctttatcaaaaaaccgcttcgggcaagcccttcgttgatgttttgaaggaaggtggtgtcctccctggcatcaaggttcgacaagggtacccgttgagcttaacggaaccaatggcgaaac

SEQ ID NO: 1068 - DNA, 89 bp, Gossypium hirsutum
  Clone ID: uC-gsronu33B039g04b1
cggtagtaaaatggaataggtttgagtctttggtgcaatttaatccgaagagagaattccggaatggtacggatttgatatggtaaata

SEQ ID NO: 1069 - DNA, 158 bp, Gossypium hirsutum
  Clone ID: uC-gsronu33B039g07b1
ctcacgcgtccgcccacgcgtccgcccacgcgtccggaacaattgtgtcaagagtgattccaagtttcttaaaatggtaggattgaacacaccatggaaagataatgctccactgcttcaatgcactcaccacatgtgcccagtgctagctcactgtc

SEQ ID NO: 1070 - DNA, 175 bp, Gossypium hirsutum
  Clone ID: uC-gsronu33B039g08b1
tcttctcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatga

SEQ ID NO: 1071 - DNA, 260 bp, Gossypium hirsutum
  Clone ID: uC-gsronu33B039g10b1
tcttatctcttatttgcaatcccaaaagagaatggctatcagcaggaaatcaaacaaattggcacaaacagcaatgataaagcaaatcctgaaaagatgttccagcttagggaagaaacaaagctactcttgtgaacaaggacttcttttgtatgtccctaatgtttcattttttatccttattcccctttacttatttccttattttttacttttttttttttttttctcttctttttttttatcttttttttttctta

SEQ ID NO: 1072 - DNA, 171 bp, Gossypium hirsutum
  Clone ID: uC-gsronu33B039g12b1
gtcaaaggaaggatccgaaaaggtgatcggacatggcagattgcattcgggtcagggtttaaatgcaacagtgctgtatggaaagcattgaagaccatacatccagcaacggagaagagtccatggcttgatgaaatcgatgaatatcctgtttatgtgcctaaaggcgca

SEQ ID NO: 1073 - DNA, 465 bp, Gossypium hirsutum
  unsure (1)..(465): unsure at all n locations
  Clone ID: uC-gsronu33B039h01b1
gtggctttcagttcatactgactcacttagatggcagacaacttctcattaaaacccaacctggggaagtcgttaagcctgatcaattcaaagcaataaacgatgaaggaatgccgatttatcagaggccatttatgagaggtaaacttttcattcacttcactgttgacttccctgactcgttgaccccagaccaatgcaaggcactggaggctgtgcttcctcccaaggcatcggttcagctgactgacatggagctggatgagtgcgaggaaacaaccatgcatgatgttaacattgaggaagagatgcgtaggaaacaggctcaagctcaacaagaagcttatgaggaagatgaggacatgcatgggtggtgcgcanagagtacaatgcgctcagcaatgataaaaaagccgaatgttcgagacacagacggtggtttttggcgatgaatgtactgtggtt

SEQ ID NO: 1074 - DNA, 106 bp, Gossypium hirsutum
  Clone ID: uC-gsronu33B039h02b1
ctcactcgaccggctcctcaccttccggaccagacaggcgcagattctatcagcccagcgaccatgacaaagagaacgaagaaggccggaattgttggaaaatatg

SEQ ID NO: 1075 - DNA, 268 bp, Gossypium hirsutum
  Clone ID: uC-gsronu33B039h05b1
ccctcctttcctcctagccaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacacgcgtgctctccgtgagcttctattcacaccttctggagctc

SEQ ID NO: 1076 - DNA, 428 bp, Gossypium hirsutum
  Clone ID: uC-gsronu33B039h06b1
cagtgttgttgtgtctcactatccaggaagctgagaagcatctttctgaaatggttgtctccaaggcactggtggcaaagattgaccgaccaatgggaatagtctgcttccaggtagcaaaggatagcaatgaaattctcaattcgcgggcttcgaacttggaaaaacttcttgatcttgttgagaagagttgccaccaaatacacaaagaaaccatggttcacaaagctgctctgaaagtatgaaaacgatgaacattcaccaaactacaggtttgtggccaagttgaaatgtgctttttggaggcaagtggtctaatatgatggtaaaaaaaagtatgttgctatgaccttttctataactgaaatttggttacttatagggaaaaccaaaagatggtgcctgttttttattgcagttgggaagaa

SEQ ID NO: 1077 - DNA, 128 bp, Gossypium hirsutum
  Clone ID: uC-gsronu33B039h08b1
atcccgctgctcaagaaccctaggagaccctcactttattacgtcaatttgattggaattagggctggaagatgcatagcacggttatgttcaaaatgcagtttccttgcatctagagatgatctacc

SEQ ID NO: 1078 - DNA, 338 bp, Gossypium hirsutum
  Clone ID: uC-gsronu33B039h09b1
gataaagaacaaaagggaaatggaaggtcttatcccttttgtttacagggctatagtccagtacaagagcggtaaagaagatcacgttttagcaacatggttcaacgagtcaccctcggcttcttacatgagactccccaccggagattctgatcgcttccaaatatccgatgatcgaatctttgaatcagataattatgggaagttttgcacttgatcatcatcataatgatcatgtatcggtttctatagtctggacagtattcccattttattatgggctattgtgaacacaagggttttattgggccttacttttgggtatcgggaaatgtttg

SEQ ID NO: 1079 - DNA, 325 bp, Gossypium hirsutum
  unsure (1)..(325): unsure at all n locations
  Clone ID: uC-gsronu33B040a01b1
ccctctcgtccggtggtgtttggtcaagttgttgaaggtatggatgtggttaaagccattgaaaaagttgggtctagcagtggaaggactgctaagcctgtcgttattgcagattgtggacagctttgttaagaacaagaacaagaacaagaaatggaataatgttgactctggtctatgaatggtgattcatgtctgaaatttatcatttttatgtgttttcttttgctggttactggatttggcttagngttgttctctaagaacatgactgccataaataatgtacgctatttatcatcatatttgaccatataattgagtt

SEQ ID NO: 1080 - DNA, 172 bp, Gossypium hirsutum
  Clone ID: uC-gsronu33B040a02b1
tcctactctatttttctctagtaattgctgcaatcggatttgttgaaagatggctgagggttcagctgcagttcccagcactgagttgttggaatggccgaagaaagataagcgtcggttccttcacgccctgtaccgtgtaggcgatcttgatcgtaccatcaagttctac

SEQ ID NO: 1081 - DNA, 377 bp, Gossypium hirsutum
  Clone ID: uC-gsronu33B040a06b1
atctcgatgccgtctttgacgattacgacgactttttcgttgaccctacccgtgaagggaaggaagaagatactcaaaaggaattattacccgttggagcattcaaatggcggaaggggcgagttgtgagtgagtcacctaggtttcttgagaaagcgcccaagatcgtgaatgtgaaagtgagtccgaggaatattcaccaaccaaggtagatcgattcctgcagatttgaaattgggaggtctccttagagccgaaaaccgtcagctttagggtttatctgctgctacctgtaacttgcttttctttttctttttttttttttgaatttgtaaaattattgggtacagaagtttaggtcctgaatctgaaccttt

SEQ ID NO: 1082 - DNA, 303 bp, Gossypium hirsutum
  Clone ID: uC-gsronu33B040a07b1
aattttcaaaaatcttaaaaaaaaaaaaaaaaaaagaaaaaaatttaaggtcggccaaaaaagagcgcacgaagcctccatactcgtgcctgcctcgttttgggcccctcctttagtgtctcccacgctcactgccccggccgtcgttgttcaaccccctgactgggccacccctggcgtcacccatcttaatcggcttgcaacacatgccggctgcgccagctgggcgtctcccgaggtggcccccaccgttggccccccccactgttgcgctggcccgatcgccttacgggcccccccctt

SEQ ID NO: 1083 - DNA, 275 bp, Gossypium hirsutum
  Clone ID: uC-gsronu33B040a10b1
cgctgagttctttgctactttcctattcttgtacatctcggtgttgactgtgatgggagtccttaaggacaaaaccaagtgtacaactgttgggattcaagggattgcttgggcttttggtggtatgatctttgctcttgtttactgcactgctggtatctcaggtggtcatataaatccggcggtgacatttgggctgttcttgggaaggaaattgtctttgacaagggcaatattctacatggtgatgcaatgcttgggagctatatgtgggg

SEQ ID NO: 1084 - DNA, 376 bp, Gossypium hirsutum
  unsure (1)..(376): unsure at all n locations
  Clone ID: uC-gsronu33B040a11b1
ccacgcgtccgcccacgcgtccgctgaaatgaagaaaatgtttgagctgatcgacaagtacaacttgaacggccaattcagatggatatcatctcaaatgaacagaatccgaaatggtgaactttaccgatacatttgcgacacgaaaggtgcctttgtacagcctgcattgtatgaagcctttggattgactgttgtggaggcaatgacttgcggtttgccaacattcgcaacctgtaacggtggaccagccgagattattgtccatgggaaatctggtttcaacattgatccttccatggtgatcatgctgctgacatactcgncgatttctttgaaagtgtagaaagatccatctcactgggattagatctcc

SEQ ID NO: 1085 - DNA, 498 bp, Gossypium hirsutum
  Clone ID: uC-gsronu33B040b01b1
ccgaaaccaaatcctttgaaagttcaaacctccgcaacttttttcttggccatgacaacctacggcacgatcccagcttccacactcccttcggccaaccttgaatacctatctcgagccaaagaacgtatcaaagatggcctcggagctcgacatccatggaaactcatgttcaacatccactccctcaactgccctcgaaccttctctgaagccatttccaggtttagagctaacttagcttacttccgcatgaattatgccataatcgtgcttctaatccttttcctcagcctattatggcaccccatctccctcgtagtcctcattatcatgatggccctttgggttgttcttgtacttcctacgggatgagccattggctattttcaaccgcacgatcgatgaccgtgtagtgctggtcgtgttgggcgtttcgacttttgtgtcttgctgttgactgatgccaccagcaatatcttagtgtcagttatgatt

SEQ ID NO: 1086 - DNA, 460 bp, Gossypium hirsutum
  Clone ID: uC-gsronu33B040b02b1
accatacaataaaatcaaatttgcttttcattatccgtatacaaggcaaaaatgacatgcatccaaaaactagaaagatcctatacaacctgagattgaggaaagttttcagtggatgttttgttatattattcttatttgtacttatcatccttttcttatttttttccttttcttttttggtctactctacattctttattcttttttttttttcttttattttacccttaattacatttttttattttttatttattttttttatattctttctcttcttcttttgtttttttaattttttttatattactattttcttttttattctcttattttttatttttttcaatcttattatttttctttctcttttattctctttttttttatatccttcatttttttcttttattttttttttttttttcttatttttttatattcttttttttttttt

SEQ ID NO: 1087 - DNA, 506 bp, Gossypium hirsutum
  Clone ID: uC-gsronu33B040b07b1
ggtttagcctaattaggcggcggcggagaaaaagcctgataaaccgaaagaggcagcggctgcgccgccacagaaggttgcggaacctgctgcagctgctcctttaccaccgatggcgtatgcagttgggtatacttgctccgaaggttattataatggctatggtggaggacctagctattatggtggaccaccccaacaaccgttcccatgttacgagacttacggtaggcccgtttatgacagctggggcggcggcggcggtggctactacaggtacggcgggcgtacaggtgaatgttttagtgaagaaaacccaacaggttgctcgatcatgtaaaaaaccgcgggaatttgctgctgaaagcaatatatagctgaatttgatatactggaatagtaataataaattctcttgttactggtgtatgaatctggggggagcattttgtggattttatttatttctagtttattgagttataaaaggcgaaagatcattaaca

SEQ ID NO: 1088 - DNA, 242 bp, Gossypium hirsutum
  Clone ID: uC-gsronu33B040b08b1
atcctaaaaatctttgttttgacttttttttccctctgttatatcaaaccgttacaattgaaccacagatgaatttccaggatgaaagcagaatttctcaggaaatatccaatttgaaaaggatgagttaataataaaatttggcgtgtaccctagcttagactagatcaatggaccattcaattgtgttgctcataaatggaaattcattgctcatcggttcccatgttggaacccgtttt

SEQ ID NO: 1089 - DNA, 197 bp, Gossypium hirsutum
  Clone ID: uC-gsronu33B040b09b1
ctaagaacaagaacaagaacaagaaatggtatcctgtttactctggtctatgaatggtgattcatgtctgaaatttatcatttttatgtgttccctttcgctggttactggatttggctaaggttgttctctaagaacatgactgccataaataatgttcgctatttatcatcatatttgaccatataattgagttt

SEQ ID NO: 1090 - DNA, 255 bp, Gossypium hirsutum
  Clone ID: uC-gsronu33B040c01b1
agctatcttgtttcatcttcaatccgtcaagctcttgacaaccctttgaattatgcaaggatttatttagctgacttacttgaaacatgcatccaaaaagtgatctatttagattcagacaccattgttgtagatgacatccaaaagctatggaacataaatctgactggttccagaacaattggggcacccgagtactgcaatgcaaactttgacaagtatttcacaagggatttctggtcaagcccaagattt

SEQ ID NO: 1091 - DNA, 85 bp, Gossypium hirsutum
  Clone ID: uC-gsronu33B040c02b1
ccctcgcgtccgcccacgcgtccgcccacgcgtccgcccactcgtccgatttattcccataacccccggaccgccaaagcttaaa

SEQ ID NO: 1092 - DNA, 460 bp, Gossypium hirsutum
  unsure (1)..(460): unsure at all n locations
  Clone ID: uC-gsronu33B040c04b1
gcttggttgcctgtgaaacatgcacgaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactttacaaagcgtccagaagagattggagccggtgaccagggtcatatgtttggttatgccactgatgaaacccctgaattcatgcctcttagccatgtccttgcaactaagctcggtgcacgtcttactgatgttaaggaagaatggcacctgcccctggctaaggcctggatggtaaaacccaggtcactgtttgagtactacaatgacaatggtgccatggttncggttcgtgtgcacac

SEQ ID NO: 1093 - DNA, 104 bp, Gossypium hirsutum
  Clone ID: uC-gsronu33B040c07b1
ccctcgcgtccgtccgacaagaattatactaaggcagatgcacttcagaagaaaattactatttcaggatacagggtgttgaatgttctgaacccgtatattct

SEQ ID NO: 1094 - DNA, 169 bp, Gossypium hirsutum
  unsure (1)..(169): unsure at all n locations
  Clone ID: uC-gsronu33B040c08b1
ccctctcgtccgtccacgcgtccgcgtgcaacaaaccccgacttctggatgggatgcatttattagataaaaggtcgacgcggnctttgcccgttgctctgatgattcatgataactcgacggatcgcacggtctctgtgccggctactcattcactctaatttttttc

SEQ ID NO: 1095 - DNA, 296 bp, Gossypium hirsutum
  Clone ID: uC-gsronu33B040c11b1
gtcttcgatactccaagtgccatctctgactgtagcacaaaccaaaagccaaacaacgagtcaacctccagctttgagattggacagcttgaattgagatccatatagcgaaattgcaagctttgtgatcaaaagctggcatatggatatggaacagccaacaggtcattggtgtacaggcctgcaatgctttcaatggtagcagttgccgcagtatgtgtctgtgttgccctactatttaagagctgtcccgaagttttatacatcttttcgtccttcaggtgggaaattgttgg

SEQ ID NO: 1096 - DNA, 169 bp, Gossypium hirsutum
  Clone ID: uC-gsronu33B040c12b1
tttttagaagttcatcacaccagatatgacaagggtggcattttgagttactcaaatgacacccacccaagcctcagacgaggaagccaacttattcgctatgcaacttgccagtgcatcagtattcgccatggtgctgaaatcagacatagaacttgacttgctgtag

SEQ ID NO: 1097 - DNA, 117 bp, Gossypium hirsutum
  Clone ID: uC-gsronu33B040d03b1
atgttcaatggctcactggaggcaagggaagctgagaaaaatggatccgtttcctcgggaaaaggattggctccgagggctgagcacggagtgatttttagatttgagtgagaactt

SEQ ID NO: 1098 - DNA, 198 bp, Gossypium hirsutum
  Clone ID: uC-gsronu33B040d05b1
ccctctcgtccgatcatgcccaaggatattcaacttgctaggaggattagaggagagagagcttagagtttgattttcggctgggtagcgtctaaagctggagatctaagcttttcatcatttgtacgttttgctttctcagcaaatgttcatgttaattgatagaaaacagttggaagctttatgatttcgttggtt

SEQ ID NO: 1099 - DNA, 68 bp, Gossypium hirsutum
  Clone ID: uC-gsronu33B040d06b1
cccacgcgtccggtggcacacgagaaattgaagattttctattgaaccacttgggggaaaggcccaaa

SEQ ID NO: 1100 - DNA, 310 bp, Gossypium hirsutum
  Clone ID: uC-gsronu33B040d07b1
ccctctcgtccgcccacgcgtccggaagttcttgtttcagtgtccttgctgttcttgtttctgcttcatgaagcctaagaaagggaaaccaaagatgaaggatgacaaggctgagacaaaaaaggaagtgaaggctgaaaaagagaaggaagcgaaggctgagtgaaaatgatgatttacttacattatattcttcactgctgctcaagtaaattgtatgtaacttttgtttgaatgaaaaatgctgccttgccttggttattggagtattatttgcttgtactgataataaaactgacatttctattat

SEQ ID NO: 1101 - DNA, 95 bp, Gossypium hirsutum
  Clone ID: uC-gsronu33B040d10b1
ccctcgcgtcctcataaaaaaaaaaaaaaaaaaaaataaaaattacaaataaaaaaaaagaaagcaaaaaaacaaaaaaaaaaaaaagcaaaccg

SEQ ID NO: 1102 - DNA, 239 bp, Gossypium hirsutum
  unsure (1)..(239): unsure at all n locations
  Clone ID: uC-gsronu33B040d12b1
gaggggccggtccggaatgaccctcgcggcccgggttttgagcctgggcggccgcgaaagaggcacgaagactggtttggttatggacgctggagcgattaccacccaagcccacgtagactatgagaagattgntggcggtaccagccgccccacaggattagaacctgatgatgacggtctcgatgctgacaattgacaggatttggttaacatagagcagcagagccctgatattg

SEQ ID NO: 1103 - DNA, 364 bp, Gossypium hirsutum
  Clone ID: uC-gsronu33B040e03b1
ctttcgtgtttttctattgaattctttccttcactttctcgagaaaaaaaaaatgtcttcaggttgcaattgcggatctagctgcagctgcggcgacagctgctcatgcagcaggaaccttaaccttggatactcggagatgacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgttgaaggccctagattatgaaaaaagaaggcagcaaaataacaggcctctgtaatgatttattttcaaggatgaat

SEQ ID NO: 1104 - DNA, 295 bp, Gossypium hirsutum
  Clone ID: uC-gsronu33B040e05b1
gcctgctcaattttggtgacagtattaccaccgatcacatctctcctgcaggtagcatccaaaaggatagccctgctgctaagtttcttcttgagcgtggggtggacaaaaaggacttcaattcctatggtagtcgcctaggcaatgatgaagtgatggcaaggggcacctttgccaatatccgtattgtcaacaagctcctgaagggagaagctggtccgaagactattcatgttccgacaggagaaaagctctattgcttactactcaccctaagcgttccaagtcttctttt

SEQ ID NO: 1105 - DNA, 62 bp, Gossypium hirsutum
  unsure (1)..(62): unsure at all n locations
  Clone ID: uC-gsronu33B040e06b1
agttggaccaaggggnngaacaggacaacacagtttttagtgtagacaccaagacccgaacg

SEQ ID NO: 1106 - DNA, 335 bp, Gossypium hirsutum
  Clone ID: uC-gsronu33B040e08b1
tgtcttccgtctcaccgtcagcgtgaccatacaccttctctagcagaaaatgaaggggtcaagggagaggtccagggacgagcccctgacggacgatcagacggtcgagctgatggaggctttcagggtggctgacagggttggcgacgggggcgtcactacctgggtgcctgcgactgtgctgcgatctgttgttcagacccttactgaggccgctcttcaggatatgctccatgatgtggacgctgatggaaatgggaccagtgatggtaccgtagatcttaacgtaatggctaggctgatgacggggactgtgtccgatgcagatcccaaag

SEQ ID NO: 1107 - DNA, 780 bp, Gossypium hirsutum
  Clone ID: uC-gsronu33B040e10b1
ggaaactccagtctccatttaatcttcttcgatgaactgaagcatggcctcgaatgaaaaaatcaggccagtccaaacgaacccaagccgaatcagtcatttgtttgggaagtatctctcgtctcctctgcaatcaccatgtctctcaccgccatcgagatgtcctccatccaaaagaatccaaatatgctcgatcaaaaccttcatggttgattttctcaattaccgtcctagagtccccttctaccttcactttggtttacccgttctttttagcaaaaagttgcccttgattgctgttctttagcttttgccaagatcgtatcattagattttgttctgttttcattctattttttttttaccctccactctttgttttgtcttatctttccttcttctatctcttttcttttctattccttctctttttttatctttttttttttctctcttttttcatttctttttttttattttttcttttttttactttcatatttttcatattttctttttttattacttctttttcctctcttttttttttctttatttttcttctttcttttttatttattcttcttttttttttttttttttttttatttactttaattttttatatttttttctttttttttctcttttttttattttcttgttttttttctttttttaatcttttatattttttcattatattatttttcttttcttccttgtattctctttcttcttttttctttctttttcccttatttattttcttttattttt

SEQ ID NO: 1108 - DNA, 192 bp, Gossypium hirsutum
  unsure (1)..(192): unsure at all n locations
  Clone ID: uC-gsronu33B040e11b1
aacgcctaacgctcnggaagaaggcggcaccagagggcaaaatttttcctttaaaaacaaaaaccccanggccccaaaaccaacaaaattaaaccacaaaaaaccaaacaaaaaaacaaaacaaaaaccaaccaaaccaaaaaaacaacaaaaaccaaaaaacaaaaaaaaaacaacaaacatacaacaaaa

SEQ ID NO: 1109 - DNA, 467 bp, Gossypium hirsutum
  Clone ID: uC-gsronu33B040e12b1
gaatgatgggtttattgttcaagctggaaagtataatgatattctcaattcaggtactgattttatggaacttgtgggtgcacataagaaagctttgtcggcccttgatactgttgaagcaagttcggtttcggaacgaactaccagtgaaggagaatgtgatataggtactactaatgggaaagtgcagaaagaagaaaaccaaggtaacgaaagcggtaaagtagatgatgtcggaccaaaaggacagcttgttcaagaagaagaacgagagaaaggacaagtcgggtttttcagtctactggaagtacatcacaacagcatatggaggagctcttgtgcctttaatattgcttgctcagattctctttgaagatttttcaaataggcagcaactattggatgcgttggggacccccgatgtcagcagacataaagcctcctgttgggagctttacactaatcat

SEQ ID NO: 1110 - DNA, 412 bp, Gossypium hirsutum
  Clone ID: uC-gsronu33B040f01b1
ctcttgggggtttgattgatgaagaggctcttgtgagggcattggatgctgggactgtagctcaggctgctcttgatgttttcagcgaggagccaccgaaacaggacagcaagttggtgcagcatgagagggttactgtcactccacatcttggtgctagtacaatggaggctcaggaaggagcggctattgaaatagcagaagctgttgttggagccctgaaaggggaacttgctgcgactgcagtcaatgcaccaatggttcctgctgaggctctaacagagttgaaaccatatgttgaactcgctgagaaacttgggaggttgggtgtccaattggtagctggcggaagtggtgttaaaactggaaaagtatcatatgcttcctctagagccccacatgaccttgacac

SEQ ID NO: 1111 - DNA, 228 bp, Gossypium hirsutum
  Clone ID: uC-gsronu33B040f03b1
ctctaaggtaatagacgattgtttcttcgaaaaccataaacggaaccaaatatggccgagaaagcaatcgagtcggttcaatgcttcggccggaagaagacggcggtagccgtaacgcactgcaagaggggccgcggtttgatcaagatcaatggttgtcccattgagcttgtcgagcccgagatcctccgttttaaggccgtcgagccaatccttctcctcggtcgt

SEQ ID NO: 1112 - DNA, 267 bp, Gossypium hirsutum
  Clone ID: uC-gsronu33B040f07b1
cgaccgattcgacccacgctgccgggctgattacaacatccaaaaggagtgaactctccacctcgtcctccgtctgcgcggtgggatgcaaatcttcgtgaaaaccttgactggcaagacaatcactttcgaggtcgagagctaagacacgatcgacaacgttaaagcgatgatccatgacaaggaaggcatccccccagacgagtaacgaattatcttaaccggataacaactcctagacaggggaaccttggtctacttcaacat

SEQ ID NO: 1113 - DNA, 389 bp, Gossypium hirsutum
  Clone ID: uC-gsronu33B040f08b1
tctccggataaggtggagagtgaatttgctgggctgctcaaagttgcagagaagacttgtggtctctttttctcttatgacaccaatttaacgctgagtgctcagcgattaaatgatctgggagatgaatctaaattgcttcctctttggagacaggcagaacccagatttctttggaacaattatatgttggaagtacttatagacaacaagcttgatccatatttgcttccagttgtccaagggagttttcattacttccaagcagccattggaaaagaaattgtatatattacattgattgctaggaggtgtcccctgggatatgtatcccttattgtttattttatgttctttttctttcgattatttttttctttttttttttc

SEQ ID NO: 1114 - DNA, 91 bp, Gossypium hirsutum
  Clone ID: uC-gsronu33B040f10b1
ggatggctctctcaaagccaatattaaaggacagtcacacttcttcggatatgaaggccggcgccgttttccccctaccccactttctttt

SEQ ID NO: 1115 - DNA, 134 bp, Gossypium hirsutum
  unsure (1)..(134): unsure at all n locations
  Clone ID: uC-gsronu33B040g02b1
gcaggacaggtccggaataaccttttaaaacaattttcaagttttgtaacanaagagaaacaacgaaaccctgtttttttttaaacacaaaaaccgaggacgagccttctgacaccatcgacaatgtcaaagcc

SEQ ID NO: 1116 - DNA, 420 bp, Gossypium hirsutum
  unsure (1)..(420): unsure at all n locations
  Clone ID: uC-gsronu33B040g04b1
cggtcgcgtgggcgaagatattagcaaattctatttgttaacaaatcctgatttaattatgtgtttctgggtttttntaaggttgagggggtaaggtggataaggttagggtggaaacatagctacggtgatggacaaggactccctttggatgtcccgaaaggtcattttgtggtttatgttggtttattttaattcttgtgatatttgtgtatattcttatctgttttcatttttttttaattttttttattcatttttattatttaatgtaattctttttattttctttcttgttatggttttttctttatattttatttttttactgttcttttattttttttttttctattttttttgtatactttttttttttcttttcgtctttatttttatatttattgttattttcatttt

SEQ ID NO: 1117 - DNA, 97 bp, Gossypium hirsutum
  unsure (1)..(97): unsure at all n locations
  Clone ID: uC-gsronu33B040g05b1
tcccgaactcaacgcatttattttgttatcgcatgagcgtttaagtgaataaacgaaaaccccctattcccccaaagcccctgnttgggggacaccg

SEQ ID NO: 1118 - DNA, 491 bp, Gossypium hirsutum
  Clone ID: uC-gsronu33B040g06b1
tctctcgtccgctcccatatccctgtcttggcacctcttcccattgggtttgctgtgttcatggttcacttagccactattcccatcaccggaaccggtatcaacccggctcgtagtttgggggctgctgttatcttcaaccaggacaagatatgggatgaccattggatattctgggtaggaccttttattggagctgccattgccgcaatctatcaccagtttatattgagggcatccggtgctaaagctctgggatccttcaggagcagctctgccatgtaaaatctgttgaagcaagaactgtgcagccatgagttcaaagtaaaggctggcatgcttggatgaatgaaatgaagttttcttcagaccattgaatttgtaaagaaatatcaaagtggaatgctttttctctatgcatgtggcacttattttaatgtgcctcaaactttgctttatttaatggagttcagttccttttcctttttctt

SEQ ID NO: 1119 - DNA, 179 bp, Gossypium hirsutum
  Clone ID: uC-gsronu33B040g08b1
tgcccgctctcttattgggacacagggggaaacactaaaggtgaagaaacagagggacaagcaggcacgccggacgacaaaagcagtgccaggggccaaaagacacccaatcacaccaaggggctgaagaacgaccaacacgcaacactgctaaggaaaggccacccccaagagacaaa

SEQ ID NO: 1120 - DNA, 520 bp, Gossypium hirsutum
  Clone ID: uC-gsronu33B040g10b1
ccctctcgtccttccacgcgtccgcttctttgtttcttatcttgttgctggtctggaaatctcttcactctctcttttgcttccaagttttgctgctaacagtatatctttgaaagtcagttgatattacaattattcccttcccaaaccttgcatcatcaatcatggttcctttcatttatgttgatcttttcttagccatgtctggccattcaagtgccaactattgcttatgtaaagatggagtgaatgagcaaacacttcagaaaaccctagattatgcttgtgtagcacgagctgattgtactccaattaatcaaaatggtccttgctataatcccaacactgtgaaagatcactgcaattattgcagtcaatagctatttccaaaagaaaggtcaagctcaagaaagctgtgatttttcaggcactgctactgttagtgttaatcctcttcaaatttccctcacttgcagttttccttccatggtacaagcaccacaccattcacaggacttcg

SEQ ID NO: 1121 - DNA, 444 bp, Gossypium hirsutum
  Clone ID: uC-gsronu33B040g11b1
gaataatgatttgttcgagaatcaaaatctcggctctgggtgttattatgcttctgctgttgattgccccagcttccaacgctgccatttcgtgcagtgttgtgataaaggacctgaggccttgcgtgaactatcttacgaaggggagcggaaaaccaccgtccgcttgttgtgcgggagcctccgctctggcatccgccgcctcgtcgtctgccgacatgaaggctgcttgtgaatgcatcaaatcagcgtctaagaatattaaacccaataaccaatttgctcaggctcttccttctaattgtggaatcactttgcccgtcgccatttcaccaaatgtcgattgttccaaggtttggttgagagcttggaagctgaaactgggagtgcttggatgggcatgaagtaattaaaaaacctcatgatagaagctcaattgttttg

SEQ ID NO: 1122 - DNA, 546 bp, Gossypium hirsutum
  Clone ID: uC-gsronu33B040g12b1
cggtcgcgtggtctgacgcgtggggtttcttagtcttgagcttagcttttaggtgcatctcttttgtttttgcgagccaaaatggttaagttagctcttggtagctttggtgattctttcagtgtcgggtccctcaaggcttatttggctgaattcattgccaccttgctttttgtctttgctggtgttggatcggctattgcttatggtaagctcactgccgatgcagctctagacccagcgggtttagtggctgtagcagtggctcatgcatttgccctcttcgttggggtgtccattgcagccaacatctcaggtggtcatttgaatcccgccgtcacctttgggttagctgttggaggcaacatcaccatcttaactactattttctactggattgctcaatgctttggctccatcgttgcttgccttcttctccagtttgtcaccaatggcttgagcgtcccagcccacggcgttgcttcatgcttgacggctgtggaggcatggtgatggagattgtgattacatttgcactcgtctaca

SEQ ID NO: 1123 - DNA, 110 bp, Gossypium hirsutum
  unsure (1)..(110): unsure at all n locations
  Clone ID: uC-gsronu33B040h05b1
tcccgctctcatcagaagagcaagaaaaagagattagaaataaaaatatgcncgcaaaaaaaaaaaagaccaaaaaacccaaaaaaaaaaaaaaaaaaaacannaacaac

SEQ ID NO: 1124 - DNA, 361 bp, Gossypium hirsutum
  Clone ID: uC-gsronu33B040h08b1
ccctcgcgtccgctttttttaaaaaaattagggctttggtccgattctcaatggagaaaatcagaagagcttcgcatgcaggatcttggtacactgataacccgaacaagttatcggaagagcttgatggatggatcagggcggctggcttgcctaaatcttctgatgtaagaggcgtaattgctccgcatgccggctattcatattcaggtcgtgctgctgcgtatgcttttggaaacattgacccgacaaacatcactcgggtattccttcttggtccttctcaccattattacactccaaaatgcgctctctcgacagctacggtttacatgacacccataggggacctacccattga

SEQ ID NO: 1125 - DNA, 89 bp, Gossypium hirsutum
  unsure (1)..(89): unsure at all n locations
  Clone ID: uC-gsronu33B040h11b1
ggaaggcccggacgaccctcgcgcccgaggtaacgtctctngcgaggctacgaagccacggangacgcttaggagcagccggaagacca

SEQ ID NO: 1126 - DNA, 490 bp, Gossypium hirsutum
  Clone ID: uC-gsronu33B041a01b1
gttttaccttaaaatgaagggtgattatcataggtatcttgctgagttcaagactgctgctgagaggaaggaagctgctgagagcactttgttggcttacaagtctgcacaggatattgctctcggtgacctagcgccaactcatccaattaggctgggacttgctcttaacttctctgttttctactatgaaattcttaactcacctgatcgtgcttgcaatcttgcaaaacaggcatttgatgaggctatttctgagttggatacattgggtgaggaatcctacaaggatagtacattgatcatgcaacttcttcgggacaacctaaccctttggacatctgatatcacggatgaagctggagacgagatcaaggaagcttccaaacccgagtcaggagagggaccagcagtgatgagttaagttcatatgatatgtactctgtatttatgttgcaggttgtacttttacgtacatgcaacgtgggct

SEQ ID NO: 1127 - DNA, 517 bp, Gossypium hirsutum
  Clone ID: uC-gsronu33B041a02b1
aaattacatgaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgttcccctgctaatcttgggattggccttcggtgtccgctcctataccaatacaccagcttcatcttaagcattgagactccccaagagataatttgaacaatcttcacaataagattatgctaggttaaattgttgggaatttcacatactg

SEQ ID NO: 1128 - DNA, 289 bp, Gossypium hirsutum
  Clone ID: uC-gsronu33B041a06b1
gcatggataggttcgggagcccggaccgaagcaaggaagtgtgttcttcggttgtggaaactggactgtcaaccgaggtgcccgctgccactactttgagtgagccttcgtcctgaaactgaatttgcaacatcatattcatctctcatgatggcatcttaaacccttaatgtataaaaaaaaaaaaggttaaaaaaagatgaagaaaacggtagtgggttgtcttctcattgatgcacacactacttgttgaggatttctgcatcttgtataaacatttgtatcatac

SEQ ID NO: 1129 - DNA, 152 bp, Gossypium hirsutum
  Clone ID: uC-gsronu33B041a07b1
ttcctcgcgtccgcagagagggagaaatggtttctctgaagctacagaagcggctctccgcgagcgttctaaagtgtggaaaaggaatggtttgtctcgatccttatttagtcaactagatttttatggccaactttccagcagaacatatg

SEQ ID NO: 1130 - DNA, 77 bp, Gossypium hirsutum
  Clone ID: uC-gsronu33B041a09b1
ttcctcgcgtccgcccacgcgtccgtgaagaagaagatgatgatgaaggcagtggagacgaacacgatgagttggaa

SEQ ID NO: 1131 - DNA, 235 bp, Gossypium hirsutum
  Clone ID: uC-gsronu33B041b02b1
cctttctttgatccaaccttaccataatgaaagcactgagaatatcagcagtgcttgaattcattgttacagtttgcagttcttgagttaaaaatgtcttacctgctttgttttaggccattggagaagacaatcagcgacttccagatgcatataatgatgctgggatttcatcatggctatatttattatatctacaattcatcatatacatcaactgggaaactggtattgt

SEQ ID NO: 1132 - DNA, 415 bp, Gossypium hirsutum
  Clone ID: uC-gsronu33B041b04b1
cgacttttctctgtttgcttccgtcacaactcaaaaaccgtacacaaaatgggcaaggatctgagcgacgagcaagtctcatcaatgaaggaggctttcactctcttcgacaccgacggtgacggcaagatcgctccatcggagctagggatcctaatgaggtctctcggcggtaaccccacccaagctcaactcaaagctattatcgctgaagagaagctcacggcgccctttgacttccctcgcttttttgatctcatgtccaagcatatgaaacctgagcccttcgataggcagctacgcgatgctttcaaggttctggataaggacaatactggctttgtctccgttgcagatctgagacatatactgactagcatcggagagaagctggagccctccgagttcgatgagt

SEQ ID NO: 1133 - DNA, 96 bp, Gossypium hirsutum
  Clone ID: uC-gsronu33B041b06b1
gcattccttcctattactctaccctcaataatcaaaagcttcttctttctttctttatctgagcgagcactctcaaaccacaacaaaccaagatga

SEQ ID NO: 1134 - DNA, 135 bp, Gossypium hirsutum
  Clone ID: uC-gsronu33B041b10b1
cgtaatattataatttttatagtaggtttttttttaatttagtcgggggggcctcctttgtggttccatgcttccgggccctgtccttgcgtttcctttgctttttgtttggggtctccttgtttgtttgccctg

SEQ ID NO: 1135 - DNA, 487 bp, Gossypium hirsutum
  Clone ID: uC-gsronu33B041b12b1
ttccttgttgaacgacacgtgccgctgactcagtggagaactcggatggaaacggccggttttagccctgttcatttgtattccaatgctttattactatgcttgttttttttgtttattctttttttttatgttatattttcttttatttctttatttattctctttatattttaaattttttttttttattcctttatttttcttttttattttattttttctatctttttattatttttttttttttcttcttttattttttattattatttttttttttctatttttcttttttatctcctcatcttttttcctataatttttttctcttatttatttattttaatattcttatgttatctttttgtctttattttatattattttttctttacttatcactttttattttatatttattaattgtttactttttttttttattcttctatttttattttctattatattttttatttttttt

SEQ ID NO: 1136 - DNA, 440 bp, Gossypium hirsutum
  Clone ID: uC-gsronu33B041c01b1
ccctctcttcctcccacgcgtccgcccacgcgtccggtgaaaaggtctttaaattgaagtctaaactggaagctcttccttcatctctttctataattttccataactttcctttcaagattcagtttcccttcttttctgatcctctcgctttctcttttctgattctctcgctttcttccttccttcctttttgtcaagaaaaacaaaagatagtgtttcttttgctaatagtagttcagatagatatgtgtattttctttttctaaaaccctccactttttttaacaaatcccctctatcgaattcccacccatgtcttccacttctttatccgacgccacaactacgtcggcgtctgatcctcacgcgcccctccttcgcatgcgccagtctgatgccttcgcggctcgctcttccgcgctggctcttttgttggg

SEQ ID NO: 1137 - DNA, 102 bp, Gossypium hirsutum
  Clone ID: uC-gsronu33B041c05b1
ccctctcttccgctcaatcaacaccagtttcaaccagggttttctcatgtaacttctgcatgaggaagttttacagttcacaagccttgggtggccaccaaa

SEQ ID NO: 1138 - DNA, 483 bp, Gossypium hirsutum
  Clone ID: uC-gsronu33B041c06b1
gtttctattaacaaagagaaactaggtgtgaaacaatggcgtcctcggatcttattggcaagctcgagactgatgtcgagatcgatatttctcccgaaaagttccaccatatgtggtgccacaggccgcaccatgtccaccacactagctctgaaaaagtacaaggatgcgatttacatgaaggtgaatttggaactcccggcgtcgttatctgctggagatatgtgcatgatggaaaggctaaaactgcaaagcaggcagttgaagttatggaccatgagaaaaagtcaataactctcaaaatgcttgaaggagatctgatggaggaatacaaaagcttcgtgatttacaatccaaacttcccccaatagcgacggtaaaggcagtttcgtgcactggactctggattatgaaaagctgcacgagggttctggacatcccgagccttgctccagttttaatcgaactacagcggacattggc

SEQ ID NO: 1139 - DNA, 75 bp, Gossypium hirsutum
  Clone ID: uC-gsronu33B041c12b1
tttttctcttcgtgaaattcgaaagtaccagaagaggtctgaacttcttatcaggaaattgcctttccagagtct

SEQ ID NO: 1140 - DNA, 89 bp, Gossypium hirsutum
  Clone ID: uC-gsronu33B041d01b1
gtgtgttatcccagactgtggtctcaagactcgaaggtatgccgaggtgaagccagccctgaacaacatggttgcagcggccaatctgc

SEQ ID NO: 1141 - DNA, 53 bp, Gossypium hirsutum
  Clone ID: uC-gsronu33B041d02b1
tggttccttccccgacaataacagccggtataaaggtgggttatttttataat

SEQ ID NO: 1142 - DNA, 310 bp, Gossypium hirsutum
  Clone ID: uC-gsronu33B041d07b1
cggtcgcgtggggccagttctgtcgatgaaattaccaaggaaaaactggctccattctcaactttgaccggtgacgaaagctaccaaagccgggatcttgagaaggcatcccaacaagcttcaaagtccctttatgatgccaaggtgcaaccaactaccttgataccaaagcaagttggcaacatgtatactgcatctctttatgctgcctttgcatcccttattcacaacaaaatcagtgaattggcaggaaagcgggtgattttattctcttacggaagcggtttaactgcctcattatttcattgcg

SEQ ID NO: 1143 - DNA, 56 bp, Gossypium hirsutum
  Clone ID: uC-gsronu33B041d11b1
tttattcaaacccttgtcttggtcggtgaaaccggtagcgattaaactactcatat

SEQ ID NO: 1144 - DNA, 452 bp, Gossypium hirsutum
  unsure (1)..(452): unsure at all n locations
  Clone ID: uC-gsronu33B041e01b1
gccgaggtgaatgaaactgcttacgacaactgcatcactaccaatcccatcgttcgatatactacaggaccggcgaatgttacccttaacaggaccggtgaataccacttcatttgcactttcgccggtcactgtggcatcggccaaaagctcagcatcgatgtcagaactggccccagcactgctcccacacctggttcaacccccaatccttccagctcagcttcatcccttgttgccaccatatctcttgttttcatgtccattgccttagctttgttctgctaattttgcctgttcatttttatgtgagattcatatgtcagttcagtataattcacactttgtagcgtatacccagacacagtcttcattcgntttggtattatcattatagnttatcatatggagtgagatttttgcatgtttgaataaaaaagcttgattcattt

SEQ ID NO: 1145 - DNA, 466 bp, Gossypium hirsutum
  Clone ID: uC-gsronu33B041e02b1
gtcatccctttcttctcttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcaaatc

SEQ ID NO: 1146 - DNA, 573 bp, Gossypium hirsutum
  unsure (1)..(573): unsure at all n locations
  Clone ID: uC-gsronu33B041e04b1
ccctcgcgtccgctttttgaagtcgggttttagtttttggggtgaaaaaaatgttgggagtatttagcagtgcgatagtgtctccgccggacgagctggtggcggccggttgccgaactccatcacctaagataacggcggacgctctggtgaaacggttccttgagacgaactcctccggcgtgtccatgcacatcggtgaccatgtccaattcgcttattctcaccataaagagtctcctttacagcccagatcatttgctgtgaaagacgaaatcttctgcttgtttgagggagcccttgataacttggggagtttaaagcagcaatatggtctggcaaagtcagcaaatgaagtgatattggtcattgaagcttacaaggcccttcgtgaccgagcaccttatcctccaaccatgtggttggccatctaattgggagctttgctttcattgtctttgataaatccaccttcactttgtttgtggcttctgatcattttggtaaggttcctctctttgnggaatcaccgccgacggatatgggcctttgctgatatgctgaatgctgaaa

SEQ ID NO: 1147 - DNA, 562 bp, Gossypium hirsutum
  Clone ID: uC-gsronu33B041e06b1
tgattttttacaacgatatggtgcaagtataagaaatgagggtccccatcctttagctgatgatgacgatgatgacgacttatttgaggaccaatttagcattgcatataatcttgacagagaatttggaccaaggcttaaggagcacatgcaatattgtatgaaccatccagaagaaatgagtaagctctcgaagttaaaagctcaaatcactgaggtgaaggggattatgatggataacattgagaaggttttggatcgcggggagaagattgaacttctagtggacaaaactgagaacttacaattccaggctgatagcttccagaggcaagggcggcaactgcggcggaggatgtggctgcagaatctgcaaatgaaactgatggtggggggagctattcttgtgttgatcatccttttgtgggtttttgcgtgtggaggtttaaatgttaacgttgataaccattgcattgcccaagtcttctttatatatacaaaaaaatataattctacatttgttagatgacaaaatatagtatgctctgactttgacttgatt

SEQ ID NO: 1148 - DNA, 647 bp, Gossypium hirsutum
  Clone ID: uC-gsronu33B041e07b1
tttgtgattagatccaaaattcccctttcatcatatttccgattccccaatttttcctgaaaccctaatcctaatcccggattcttttcgtctacatcgtctagcaaatggcaaccgaggagccggcagtcgtggcagaccccgcaccggagacggaggaggacaagactgctgagaccaaagctacttcaaaatctggcagagcaaagaaaaccaaagaacccaaaaccaagaaagctgcagctcctcggaaaccacgggctgctcctactcatccaccttacgaagagatgatcaaagatgcgatcgttactttgaaagagaggacaggttcaagtcagtacgccattgctaagttcattgaagagaaacagaagaatcttcctgggaatttcaagaagcttcttcttgtccatttgaagaagcttgtggctgctgggaagttggtcaaagttaaggctttcgtataaacttccatcggctagatcttcgagacggctactgctgcttctgctcctgcataaagaaaaacggctactactaagtcgaagtctaagcctgcctcatagcctaaggaagggaagagtacataagctactcctaaagcgaatgccaagacataaactacttcgaaaggcaagagtaag

SEQ ID NO: 1149 - DNA, 379 bp, Gossypium hirsutum
  unsure (1)..(379): unsure at all n locations
  Clone ID: uC-gsronu33B041e10b1
tcggtctcgtgggcagttttgagagcttcgtcgacatcaggtaactatcattgttgcctccttggagaaattagaaactgtcttattagtgagtcctgtttgtatgtgacttgcatgaatattccaatgcatctctttatcagatatttgttaatgcagaaaccaagcctgaaacattcatttagaggatacttgtatacttgtatgacccttttgttccgctctttttgttttctatactattaattgagatgaatatgagtattctaatnaataataaaaaaaaataaaataaaaattaaataaaaaacataaaaacaacataatgataatttgaactttttaaattggtccggcctttcttaaggttccaagtttt

SEQ ID NO: 1150 - DNA, 397 bp, Gossypium hirsutum
  Clone ID: uC-gsronu33B041f02b1
ccctctctttcggcaagacaagattaagttggttcctttgatccttcaaaatagacctgcttggcacaaggaaaaagtttaccctgaatacaaggtgccgtccttggaacataatggcaaagtcattggggagagtcttgatttgattaaatatgtcgatagcaacttcgaagggccgtctcttctacctgatgatgctgacaaaaaggagtactttgagacgacgttatcacacatggacgaatttctagggctggtgtatgctacatttaaaggagactcaacaaaggatgctgatgctgcttttgatcacttggaaactgctcttgcaaaatatgatggtccattcctcctatgcaacgagtttactctggcggacattgcctttattcctttt

SEQ ID NO: 1151 - DNA, 570 bp, Gossypium hirsutum
  Clone ID: uC-gsronu33B041f05b1
ccctctcgtccgtaaaattaggagttttctcacaaagttcccttcatccttttgattttctaagcatccaaatacctttttcttttccattttgttaaaatattcatcctttctccttcaattttcttttattacttagctcgtttttgctcaaattgatttaatttcatggagatcttcaaataaaagcctctaatcacgagggagcatccacgagaaaagaaaatggcaattagaagatggtgtaggttcaacagtatcaatgaatcaacagggcattgtggctcaaatatagcgttggagaataagggaatgtcgagtatagctccattcaccgtagatagtgtggcgtgtctgaagagtgtgagcacttgtgctacacttattggagataacgcaagactctttgggttatttggagtgttttggagatccatttcttcaatgcatacaaattatgaattatgtttcacattcacaaattgccaatatgtcactacgatgtatatgaatattgattttgacgaactattatagcaaggctaatttctagcaaaaataattatcttt

SEQ ID NO: 1152 - DNA, 482 bp, Gossypium hirsutum
  Clone ID: uC-gsronu33B041f08b1
ttatgttaaaagaacagagcttggatatcctaagctaatgtcggacgaggagcaccatttcgagtccaaggccgacgccggcgcctccaaaacctatcctcagcaggccggtactatccgtaaaaacggctacatcgtcatcaaaggccgtccttgcaaggttgtcgaagtttccacttccaagactgggaagcacggacatgctaagtgtcactttgttgggatcgacatcttcactgctaagaagctggaagatatcgttccttcttcccacaattgtgatgtgccgcacgttaaccgtactgattaccaattgatcgacatttctgaggatggatttgtgagcttgctgactgagagcggagacactaaggatgatctgaggctcccaactgatgaaaacttgttgaaacagatcaaggacggtttcgctgaggggaaagaccttgcggtgtctgtatgtccgcaatgggggaggagca

SEQ ID NO: 1153 - DNA, 644 bp, Gossypium hirsutum
  Clone ID: uC-gsronu33B041f10b1
tgagtagctaaacacaatttggagcttctaagaataatgtcatcattttgggatcttgatttcatatttgcatagcaaatccaagcgatttttcaatctagtgcctttgttggtttccatttgacattgttgtctgatttgtagatgtctgaaagctctttatatttctactcaattgtcatttgtcactgtttctccgttttttgttcactattatttttttgtctgtttcttgtatcttttttcatttcattttcttcctttttttttcctattatctctcttttttttttttacttgttatcgggtcattcctctcttattatttttctatttcttttttttacttttctttttccttatttttatgtctttttcaatatgtttgttcctctatttctatttcttttgttctctgctatttaattttgttttttatttgtgttctttttttttttctttttctatttatctttgttctttcatggtttctctactctttttttttttgttccttttttcccattttttgttcattttcactttatcttttttttctttttttttttttttctttatttttttttttctcttctttcttcgttacttttctttttttctttttttccttctttttttttttt

SEQ ID NO: 1154 - DNA, 443 bp, Gossypium hirsutum
  Clone ID: uC-gsronu33B041f12b1
ccctcgcgtccggtgaattccgaacaggaaagattgtcgattccgttattcttcttcccttcccactatgtcaaagtggcgcctctagatgagctagtgaatgagcaaaacccagcgaagtataaagaatatagctggggaaagtattacattaatcgaaccggcagcaactacaagaaactcgaggctgaaaaccttcaaatcgaccatttcaagacgccagaatccgaataattgctgcactctatcatctctgattctaaaccattacctgttttttagtttcagcttcaagttgtcatcatatgatataatgaacatagtttgcatcatatagaaaaatatgcttttagtatgtttcagctacgtgattatatgcttttagtatgttttggctacgtgattatatgtaagattttaagttgaacaaaaagattgttttc

SEQ ID NO: 1155 - DNA, 266 bp, Gossypium hirsutum
  Clone ID: uC-gsronu33B041g02b1
aaactctgtacgacagttcctttgattttgagagaaaagagagagagagagaagagtagatcttggcttctctccttcgttcgattccgcttaattatagcccgcgtttctctcagacgtgaaaaatggggctgcctttcacaaagctatttagccggcttttcgccaagaaggagatgcgtatactcatggttgggcttgatgctgctggtaaaactaccattctttacaagcttaagttgggagagattgtcactaccattccc

SEQ ID NO: 1156 - DNA, 527 bp, Gossypium hirsutum
  Clone ID: uC-gsronu33B041g03b1
ccctcgctttcgcttctcacgaatcctccagacttaagacaatcttcctgagttattagaggtttatcctaacaaatctgtgaaggtttgagaaaaaataaacaactttttttaatggcatctagagtttcattaaagactaaaggcaaaggagggaaggggtctaagggctcggatgataaatcaactacgcagtgcttgaaagagtggagcacatgggctatgaagaaagccaaagtggtaacgcactatggcttcattcctctggtgatcattatcggcatgaactctgaacccaagccccaactttatcaattgctaagccctgtctgattcagttgcttatttcttaaccacccagatcttggtttaactatgtaatttgtttgttgcctatctgtcgaaactacatggtattatgttaggcatatgctttatatgatgttgactgttctattcctatgggcttgagaatacattttatgtaattcgaatcttatttgaggtctctcaatattttcttttac

SEQ ID NO: 1157 - DNA, 129 bp, Gossypium hirsutum
  Clone ID: uC-gsronu33B041g04b1
tgcttgtgtggagctgccatcaaatgttgctgatctaatttgattctggttcgggctggctaggtaaacggctctctgggaatgacagtttaggaggtccggttacaactgggagggattttgttcctg

SEQ ID NO: 1158 - DNA, 389 bp, Gossypium hirsutum
  Clone ID: uC-gsronu33B041g05b1
ccctctctttcgcctttttcaccaactcctctcccgttttcttgctctttttcttcctttgcatttacttctgatttgcaaaaagcaaaccaatccttttccccccagtggatcccaccagcactacaaccatgattgtgaatgtgaaagaatcaacaatggtaaggccggcgggggagactccccggcggagcctctggaacgccaacgtggacttggtggtaccaaggttccacacccctagcgtttacttctacaggccgaacggagcggccaatttcttcgatccgcaggtgatgaaggagggcgttgagcaaggccctggtgccattttaccccatggcggggcggctgaagagggaccaggatggaaggatcgagatcgattg

SEQ ID NO: 1159 - DNA, 443 bp, Gossypium hirsutum
  Clone ID: uC-gsronu33B041g09b1
tgagtagcataagggcagctttgagacaatccatgttcaagatgctgctgggcatgagtttgcaactcgtctcggcaatgtcttcaccatcggaaaaggaacaaagccatgggtgtcccttcctaagggtaagggtatcaagttatccatcattgaggaagctaggaagaggcttgctgcccaaaatgctgcctaaactttagcataagacatccagatatgtattgctgcagtagtttattctaaagattagctggagctgtttatttatgaagttgtgagcaaaattttgagaactatttacttcttgcaatttatcttttttttctgtcgggtgatgttacctactttaccaccaggctttaaattatcgaatactcggctgtttcatgaatattagtgcttttgttggttaaatgagaagtgcctcctttgtggatgaa

SEQ ID NO: 1160 - DNA, 545 bp, Gossypium hirsutum
  unsure (1)..(545): unsure at all n locations
  Clone ID: uC-gsronu33B041g10b1
ttctctagcggcgccgtcacaaaatgtcgtcaacggagtctctcatcctccaactccatgaaatctctgccgttaaattcggtaacttcaagctgaaatctgggatcttctcccctatctacatagacctccgtctcatcgtctcttacccttccctcctccaccaaatctcccactccctcctctcctctctccctccccaaacacactttaacctcatatgcggtgtcccttacactgccctccctatagccacctccatctctctcgacacctccatccccatgctcatgcgccgcatagaagtgaaagactacggaactgccaagtccatcgaaggtgtttacgaaaagggtcaagcttgtttggtggtggaagacctcgtaacgtccggtgcatcggttctcgaaacggcggcaccgcttcggtctttgggtatcaacgtaacggatgccgtcgtggttatagatagggagcaaggcgggagggaaacgctggaggagaatgggattaaactncatgcactnnttactttaactgagatg

SEQ ID NO: 1161 - DNA, 584 bp, Gossypium hirsutum
  Clone ID: uC-gsronu33B041g11b1
ttttgttggctcagttgtagctgctgtaatgattgtttttgtattattggcttatcaccgagcgcaagttaaagaatttcgtggaagaagtggatttagtgaaacgactactgtaggtgatgctaagttgggcgggttttcacgaccttctgttttcaagttccactctaatgttcgaacaccacaaacttcgttgagcttttcaaatgatcacttgcttacttcaaaatctaggccattgccctactcgaagcagcattattcaaagcttgtttgctacataaccaaagagctaatggatacagagaacccacctcaagtcctgcctaacggctatgtctacagcactaaggctctcaaagaaatggccgagaaaaacaatggtaaaattacatgtccgaggactggtctggtctgcaattattctgacctggttaaggcctatatctcatataactacaccatcaacactgcaaaggtaaaaaagaaaaaactctttctggactgtttcctcttaatgttagtggtaaattttatgcatcatctgtagatatatttctcttctgctttcgaatttttggaac

SEQ ID NO: 1162 - DNA, 222 bp, Gossypium hirsutum
  Clone ID: uC-gsronu33B041g12b1
cccatgcgtccgcggacgcgtgggttcagttcccgcagtactaaatttcctttcaaacctcttaaattttactttttattcaaacccctccatggcctccctttccgatcactctaattcggaagttgtttataggtggcagaacactggaccccctttcaagttcctagtgccttttagtctatgcccctgttctttcctttatattcgactctctttgag

SEQ ID NO: 1163 - DNA, 636 bp, Gossypium hirsutum
  Clone ID: uC-gsronu33B041h03b1
gagccatcaaaaaggaatcaagagatatcagaatggggaaatctaggactttgagcacgaagtggcggtggcaacaaacttgctagttattttaggattggatggtggaaccacttctactgtctacatttgtatgtcaattatgtctttctctaacgcccttcccaaccctcttcctgttctcgcccatgccgtcactggctactccaatcataacagtgtcgacgatactatggccagggaaacattagatcaagttatggcagatgcactttcaaaatctggttctaatcgatctgcagcatacatttcatgtcttctttttgcaatggcattttaaggatgcctttttttttcttattcttagaatgcttataagttatgactctgtgagaaatatgtcaagcctgaagatggtgtaggagcaaaagagtgaagtcaagtgacgaaaaattgagtgaatatgaatatgccgccttggatgacgaaatatcacccgaaaacagatctttaggcacatattatgccttgcatgctcgctccaaaattggcttggggtggacatgatgttcagctccaggaaaacagacccagggacatgtggaaaatcctactaccccttttggcattactttc

SEQ ID NO: 1164 - DNA, 451 bp, Gossypium hirsutum
  Clone ID: uC-gsronu33B041h05b1
gtttttgtttgtaatatgattttgggcttcaattaatcttgcaaatttgacaaataaatgtttattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaaaaaaatttaaaccccggggtttggaaaattaaaatttttttaaaagggccccaaaaaaaaaattaaggggccggttttaaaaaacggggaaatgaaaaaacccgggggttcacaaaataaaaaggtttgaaaaaaaaccccttttttaaaggggggaaaaaaaaaaaaaaggccccaacaaatcccctttcaaaaaattggccacccttaaagggaaaaggaaccccc

SEQ ID NO: 1165 - DNA, 237 bp, Gossypium hirsutum
  Clone ID: uC-gsronu33B041h06b1
gctgcctttttccttctctaaaaaaaaaaaaaaaaagagaggaattatttaagctgaaaagaaactagaaaatggaaggaccctggcagattacaacatccagaaggaatccactttgcacctgttccttcgcctccgctcttttttaaagtgttataaattaaatctagggggggcctggtttatagagctcagatttgttctgatccgcgggtcgtatgcctgatgtgatgctgg

SEQ ID NO: 1166 - DNA, 371 bp, Gossypium hirsutum
  Clone ID: uC-gsronu33B041h09b1
ttgctgaacaagtgtggggtgattagccctcgtttcgatgtcggagttaaagagattgaaggttggactgctaggctacttccttccagacagttcggatacattgtgcttaccacttcagctggtatcatggaccatgaagaagcaagaagaaagaatgtcggtggaaaagtacttggtttcttctattgagacaaatctgagttctttttatttggtttatttctcttcatgtaggacatggtagttttcctcaacctaagtttggtgtcaatttaatttttgtttatctgggattatacctatgttttgggtatggtgtttgagattacgagttgctcggtttttgttggtaatagatttcttgccct

SEQ ID NO: 1167 - DNA, 530 bp, Gossypium hirsutum
  Clone ID: uC-gsronu33B041h11b1
tttcttcatctataaacaagactgctggagaagaccatctcaaagcttctagtgttttggccgagaaccgtttcagggccgcaactatggtgggtgtcgaaggtggtcagcattgggcttcagctgccttcccagctaatgattccaaaacacggtcagggtcgaaattgcagtccttggggaagcacaaactgcctgcatcagacacagcctgacctaaatcaaaactgaagaaggcctcaacggagcatagcgatgtacctaacttacatgctgtgcaagtatttcaaccagtatcaacaattgcattaaaagaccccaacttatgatgtgacccaacattggtcactaatgttggcagttggaccaatggtgttggcagcattttctgttcgagcatggacgaagcctttccatcggaagtagagagccttgtatagtcccgcacattattcccctggctttatttatgactcgacgattgttaatgctcccgactttactgacttggataaactgctgagattctt

SEQ ID NO: 1168 - DNA, 377 bp, Gossypium hirsutum
  Clone ID: uC-gsronu33B041h12b1
tttctctcgtccgggaatcccaccagaccagcagaggctgatttttgctgggaagcaacttgaagatgggaggacccttgcagattacaacatccagaaggaatccactttgcacctggtccttcgcctccgcggtggttttaagtgttgtgccgaacacctgtccagttattgttgatgtgttaagtttgttatgtttgtgggtcgtatgctgatgtgagctggccactaggcaggggaagcttacaagtaaaaataattgctttttataaacgcttttagttgttttttaggtttgaataagttcgtttttgcattcaagtttctctcttgttcgaatttacatgaaggggctaataatctattattaagttatt

SEQ ID NO: 1169 - DNA, 106 bp, Gossypium hirsutum
  Clone ID: uC-gsronu33B042a05b1
aattaacctaaaattctctgcaggagaggaagtgaagaacccttcaagctccggcctccggccttcatcgcccacgcgccatacgcaccaccgtccatggtgtgtt

SEQ ID NO: 1170 - DNA, 460 bp, Gossypium hirsutum
  Clone ID: uC-gsronu33B042b01b1
ctacccattgtacaagtttgtgagggaagttcttgggactcatttgttaacaggtgagaaagtgatttcaccaggagaagaatgtgacaaggttttcacagcaatgtgtgcagggaagttgattgatccgttgctggattgcttgaaagactggaatggtgctcctttgcccatatgctaaaaagggtgtttcttttctcaaagtttgagagcgacaacaaagccacactgttctataagttctttaacctgtgctcatatataaagacatatatatagcttgtttaagtttttcattcgaaaaatttgtgaaaaaccagaactgctgctgtttttagtgacttgttcttttcttttcttttcttttttggggaatttaattacttgcattaaatgtttctttgtataagacgttgattacagcaaaatgaaatgaatatataagatactgtttctactc

SEQ ID NO: 1171 - DNA, 526 bp, Gossypium hirsutum
  Clone ID: uC-gsronu33B042b02b1
ccctcgcgtccgctacctcaaccaaactaccaccttctctgttaacaagaagaaatcgaggtctataaagaaacactaaaaatgagaccaattagcagcgttaacacagtagaaacagcagctatgccctcaatgtcaccaccagcaatggtgcatccacgctctccatggcactctcccgtgccttacctctttggtggcctagcagcgatgctgggcctcattgcttttgctctcttgatcttagcttgttcctactggcggctttctggtcgtttggacaacaacagtgaaggaggtgatgtcgaaagggatgtcgaaagtggtgaaaatgagggcgactcaaccaagcaggtgaaggtttatgaggagaagattctggtgataatggccggtgaagagaaacccacgttcttggctacccctgtaattgtttgcactaaagcttcctttttcggtggtaatataaatggcaaggttgatgatgacaaggaaggatcaaagaaagacgaaagtggcgagaaag

SEQ ID NO: 1172 - DNA, 286 bp, Gossypium hirsutum
  Clone ID: uC-gsronu33B042b04b1
ggatcttcactttacaggcattttaatcccttaaatctctctcaaccaaaaaaatgtcgggacgtggaaagggaggcaagggtttgggaaaaggtggagcgaagaggcaccggaaagttctccgggataacattcaaggcattacgaagccggcaatccggaggttggctcgtagaggtggcgtgaagagaatcagcggtttgatctacgaggagacgcgaggtgtgctcaaaatctttctggaaaatgtgattcgtgatgccgtttcctatacggtgcacgctag

SEQ ID NO: 1173 - DNA, 144 bp, Gossypium hirsutum
  Clone ID: uC-gsronu33B042b07b1
cttttattccttatctacagggatcgaaaaattggtgtattttcggtttttctgcatgcaacttgtccctgtgagtccatgaactttgttagtgatcttttgcaggttggtcaattcttcgtttgatccttttctgcactttac

SEQ ID NO: 1174 - DNA, 421 bp, Gossypium hirsutum
  unsure (1)..(421): unsure at all n locations
  Clone ID: uC-gsronu33B042c01b1
gagtcatcaaatttttatatatccaattaattaaataaaaaattattatcaaaatcttaaaaaaataaatcatttcatgtttagtaaagtttttgattcactaataaattttttttctgaggaaattatttgcaatggaacaggcacaagtgcatcggatagccaacattcaagactaaggaagagccatggaatactgaatatgctaagttggggcatattgatgataatcggagccatggctggtcgctacttcaagcaatgggatcccatgntggttttattcccacgccgctattcagtcatgcgccttcctgctgggccttgccggtatcatttctggtttcgtcctagaagatcgtctcgtccccgaagtcgacacccacaaagctctaggcatcctcattctcgtgctcggatg

SEQ ID NO: 1175 - DNA, 674 bp, Gossypium hirsutum
  Clone ID: uC-gsronu33B042c03b1
ctcagagatccaagagcaagttcgtatttgcaagtccagccaaatctgctgagaccctcttcaaatatattgctccggagcaagtaccagttcaatatggtggactgagcagagagggtgaacaggaatttagcgtggccgatgccgtcacagaggttacaatcaagccagcagcgaagcatagtgttgaattccctataactgagaattgtaatctggtttggtaacttcgagtagtgtgatgggcaagctttcttagtatcctctttttcatttttctttttatcttctttttatattttttttatttctatttttctaattttcatttattattttttattttttttttttgtttttttttttttctttgtatcttaacttttctttaatttttattttcttataattaacttttttattttttttttttattccattttaatttcttttgttttattatcttttcccccttctacattttctttaatttcttaattattttttaattttttttcttttttttttttatttttatttttaattatcatattttttatttttcttttttttttttttttcattttcttcattaataatattctattcatcttttattatttatttttttttcttttttttttttttttcctttccttttatttttatatttt

SEQ ID NO: 1176 - DNA, 62 bp, Gossypium hirsutum
  Clone ID: uC-gsronu33B042c04b1
gtctctattggaggggaccttgccaaggttcagagagctgtctttatgatctatcaactcaa

SEQ ID NO: 1177 - DNA, 127 bp, Gossypium hirsutum
  Clone ID: uC-gsronu33B042c05b1
agaggatggatgggagacatttttgtaatatatcgtgtttgatcaatgacactctcatccttcctccttcgcatgtaattgtaatttgaaggaaatggaggcttttaaatactatattatcattttt

SEQ ID NO: 1178 - DNA, 55 bp, Gossypium hirsutum
  Clone ID: uC-gsronu33B042c07b1
actcctttgcgtccgcttgttgttactgtttttgatagacaaggatcttagatag

SEQ ID NO: 1179 - DNA, 512 bp, Gossypium hirsutum
  Clone ID: uC-gsronu33B042d02b1
cccacgcgtccgcccacgcgtccgctttggtctttgaaaatatttccatggattttatcaccgggcctccaccttcaaagggtaaaatcttggttatggtggtcgttgatcgactttcaaaatatgggcattttgtgggtctgccaactcatttttccagtcaaatagttgcttctgcctttgtgcaagaagtagtgcgattacacggcattcctacggagattgtctcggaccgtgatcctcgtttcctcagtagcttctggaaagaagtatataggctccaaggcacgacactgagtatgagcaccgcataccacctacaaactgacggccaaacggaggccctcaaccgatgcttggaaatgtatttgagttgctatgcctcggaccaccctacctcttggatgttatttttaccttgggccgaatattggtataacacctcataccaaacggctgcgcaaatgacaccttttgaagtgttgtatggtcgcccccacctacaatagcac

SEQ ID NO: 1180 - DNA, 400 bp, Gossypium hirsutum
  Clone ID: uC-gsronu33B042d03b1
attaggctcagagtttcttagtcttgagcttagcttttaggtgcatctcttttgtttttgcgagccaaaatggttaagttagcttttggtagctttggtgattctttcagtgtcgggtccctcaaggcttatttggctgaattcattgccaccttgctttttgtctttgctggtgttggatcggctattgcttatggtaagctcactgccgatgcagctctagacccagcgggtttagtggctgtagcagtggctcatgcatttgccctcttcgttggggtgttcattgcatgccaacatcttatgtggctatttgtattcttccgatacctttgggttagctgttttaggtattattatccatttatttactattttttacttcattgcttaattattt

SEQ ID NO: 1181 - DNA, 166 bp, Gossypium hirsutum
  Clone ID: uC-gsronu33B042d04b1
gaatggtatcactgatccgagccatcatgtacatggtggctcagtgcttgggtgccatatgcgggtgtggattggtcaaagctttccaaaagacttactacaacaactatggaggtggtgctaatgagctcctaagtgggttcaacaagggcaccggtttaggtgc

SEQ ID NO: 1182 - DNA, 79 bp, Gossypium hirsutum
  Clone ID: uC-gsronu33B042d10b1
ttccttctcgtccggtcttattctgttgctactgaatggttgaagattaaaatctataacattaatcattcacaataaa

SEQ ID NO: 1183 - DNA, 77 bp, Gossypium hirsutum
  Clone ID: uC-gsronu33B042d12b1
ttcttttcttacgctctctcgctcctccgatcgcttattatcacgacaaaccccaaagcataaaacccataaagctc

SEQ ID NO: 1184 - DNA, 220 bp, Gossypium hirsutum
  Clone ID: uC-gsronu33B042e02b1
cccacgcgtccgccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttga

SEQ ID NO: 1185 - DNA, 460 bp, Gossypium hirsutum
  Clone ID: uC-gsronu33B042e03b1
ccctcgcgtccgggaggattcactgaaaatgaactacacaacgttggtgcggatgatgaaatacctggcccctccaccaggggaatatgagagaggactctttgctcatactgataaaccagttagcacacttatttgtgaggacaaaatttcagggttggaaattgaggtcagtgatggccaatggatcaagttgactaatttatctccttcttcctttgtttttatggttggagatcctctcaaggcatggagtaatgggagattgaaatcagtgaatcacagagtgatgatgagcggagacaaagatcgatattctatagcagcctttgtcattccaaatgagggtactataatcaaggcacccaaagaacttatagatgaccaacatcctcagctttttaaggaattcgattttatggacttttttctttatgccttttctgacccacaaagcaca

SEQ ID NO: 1186 - DNA, 287 bp, Gossypium hirsutum
  Clone ID: uC-gsronu33B042e04b1
cggtatccttggcaaatatcacggagatccacgaaggattggacttttcttctaatgatcgaaggtattcttttggaatattctctgtgaaattttcaactgatggacgagaacttgtggctggaagcagtgatgactcgatatatgtttatgatctggaagcaaacaagctttcccttcgaattatggcacacacggctgatgttaacacggcaacctttgccgatgaaagcggcaatttgatatattctgggagagatgattatctctgcatggtgtgggatagg

SEQ ID NO: 1187 - DNA, 171 bp, Gossypium hirsutum
  Clone ID: uC-gsronu33B042e06b1
caatattaaaattttagggaagttaaataaagtaaaattagcataaattgcttagatattagaaagaaaaagtgaaaaaataattgttaaaattaatcagattaatttagttcataattgttaaatttgcacattacttttaaattaatggatcaaagaacttttggtggt

SEQ ID NO: 1188 - DNA, 174 bp, Gossypium hirsutum
  Clone ID: uC-gsronu33B042e11b1
taattaaaaaaaaaaaaaaaaaaaaaaagaaaaattagcataaattaaaaaaaaaaaaaaaaagaaaaagtgaaaaaataattgttaagcataaagcagaattaagtttaggttaataattgttagaatttgaacattacttttaaattaatggatcaaagaacttttggtggt

SEQ ID NO: 1189 - DNA, 542 bp, Gossypium hirsutum
  unsure (1)..(542): unsure at all n locations
  Clone ID: uC-gsronu33B042f01b1
cccacgcgtccggttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcgaccactggtggttttgaagctggtatctctaaagatggtcagactcgtgagcatgctttgcttgcttttaccctcggtgttaggcagatgatttgctgctgcaacaagatggatgcaacaaccnncaagtactcaaaggcaaggtttgatgaaattgtcaaggaagtc

SEQ ID NO: 1190 - DNA, 416 bp, Gossypium hirsutum
  Clone ID: uC-gsronu33B042f02b1
gctgggccgcctgcccgtgccggtccggtcctcccgggtcgtccctcgcgtccgattcttattttcttaccggagatgcatttctaaaaaaaaaaaaaagccaaaacataaagagaaaggctcgccccctctagcgggcccaggctttccttcccccttctttgcgcccccctctccctttctcttgcggcccctttttttttttcactgcccgcgggtttcccccgctgggcccctcattgtcccgggcttgccgccgcctttttcttccttgccgcgtccttccccctttcccccgcctcgccgtcttaccgcacctggcctcccccccgttcctccttgggtctttgtcttctgcccccttgagttggggtattggtttccccccccttttgggttttcttttcaccccccct

SEQ ID NO: 1191 - DNA, 584 bp, Gossypium hirsutum
  Clone ID: uC-gsronu33B042f03b1
cttcgatgctcaaaatctcagactgatctggggatcgtggagtgcacgtgttctcttcttctttttcaactgtttttcttctttcagattaagacataaaatccaagcaacgacatggaggcagtgcctatacagagtgaaaacttcaagctagggttcattggagcagggaaaatggcagagagcattgccagaggagtggtacaatctggtgttatgcctccccaacgcatttctacagcaatccactcaaatcccagtcgtggtactcccttccagtcactcggcatctctgtttatagtcacaacaccgacgttgtggatgctagtgatgtgataattttttctgtgaaaccccaagtagttaaaactgtggtcttgcagctgaggccgttactttcaaagaaaaagctcttggtttcaattgctgcaggagtaaaactgcaggatctggaagaatgggctggccatggccgatttatccgggtgatgcccacacaccatctgctgttggtatgggagcttcagctatgagcttggaggagctgcaacaacaggatgggaattagtggaaatatttggag

SEQ ID NO: 1192 - DNA, 576 bp, Gossypium hirsutum
  Clone ID: uC-gsronu33B042f04b1
attgaatgtagatagatcaattgaattgccaccacaggatgaaactggtaacatgggggtttcaaaggtgatcagagctgaccagaagagattcttctttgatcttgggagcaacaacagaggacatttcttgaggatatctgaagttgcaggttctgatcggtcttccatcattctcccactgtcaggattaaagcagttccacgaaatagtgggtcattttgtggagataacaaaggatcgcattgaaggaatgatgagtgcaaatgttcgaacggtggatccgccacaaaggtgaatggctggcagtggaagatggtaaaataaataattgtcaagttttggtttaaagcctctaatagtagagatgcaattgtgttgtcattcaaggcttggaaataatccgatttttctgtttgattaacagagaaatattggagataagttgtgaagggaaattatggacaaattggttgtaatttgtgagtttgatggtgtggcctctcaataatgtctacttttgttagtataaacacctgttgaatggcctaaatttaataataattatttattact

SEQ ID NO: 1193 - DNA, 560 bp, Gossypium hirsutum
  Clone ID: uC-gsronu33B042f06b1
ctgtttttacctgctgcaaggagtatgtcgatgctggtggtcgaatcgagcccttggaatgcaaatgattttgggattccatatccaacatacttccatcctgcaaaggatgaggaagtctttgtatggcaagatcggatgcgaaatctggagcggaaatggcttttctcttttgcaggtgcacctcgtcccggtaaccccaagtcgataagagggcagattattgatcaatgcaggcagtccaaggtgtgcaaattgttggaatgtgattttggggagagcaagtgtcattcaccaagcagtataatgcagatgttccagagctccctgttctgcttacaacctcaaggagattcatacacacgaagatctgctttcgactcaatgttggctggttgtattcctgtcttcttccatcctggctcggcgtacacacagtacacttggcaccttccgaagaattatactacatattcagtgttcatccagaggatgatattcgtaacggaatgtagcatagaggagaggcttagtcaaatttctctgagcagtgaagatca

SEQ ID NO: 1194 - DNA, 487 bp, Gossypium hirsutum
  Clone ID: uC-gsronu33B042f07b1
tgactaaagtgccaacataactgcatgcagggataccttccggggaagagtgtgcgaatgcccgttagttaatggtgtgaagttttctggagatggttatacacattgtgaagcttctgcggctttacgctgtgaaatcaacaatggaggatgttggagagaaacacgggaaggaaggacatactctgcttgtattgatgatcattcacatggttgcaagtgcccatacggattcaggggtgatggagtcaagagctgtgaagatgttgatgagtgcaaggagaagctggcctgccaatgtcctggttgcaaatgcaaaaatacctggggcagttatgagtgcagctgtagtggtggttcattgtacatgcgagagcatgacacatgtatcagtaagaatggtaaaacagaagtaagctggggctttgtttgggtaataattcttggattggttgctgctggaactggagggtatgccatttacaaa

SEQ ID NO: 1195 - DNA, 516 bp, Gossypium hirsutum
  Clone ID: uC-gsronu33B042f08b1
ctcttcttaccggagatgcatttctaactctcaccgagggcataggtttagtgggtgagatttcatttacagataattcaagctggactagatgccgtcgtttcagacttggtgctagagttgtggatggctctggtggcactagagtaagagaagcaaagacagaatccttcattgtcagggatcaccgtggagaattatacaagaagcatcatcctccatctctttctgatgaagtatggagattagagaaaattggcaaagatggggctttccataagcgcttgagtcgggaaaatatcaacactgttaaggatttcttgaccatgctctgtataaatcctccaaggcttcaacatatcctcggcaccggtatgtctgctaagatgtgggaaatcaccgtggagcatgctcgaacatgtgtgcttgataagaggaggcacgtgtattgccctcctggttctcaacagacatctggtgtggtcttaacgtcctgggacaattgacaggactact

SEQ ID NO: 1196 - DNA, 187 bp, Gossypium hirsutum
  Clone ID: uC-gsronu33B042f09b1
tcctcgcgtccgcttgaagatgctggtgtgtctcctgaagaggtaaactacataaatgcacatgcaacttctactcttgctggtgatctggctgagataaacgctattaaaaaggtattcaagaatacatctggcatcaaaatcaatgcatcaaagtcgatgatagggcacttgtctgggtgcagca

SEQ ID NO: 1197 - DNA, 599 bp, Gossypium hirsutum
  Clone ID: uC-gsronu33B042f10b1
cccacgcgtccggaaaaaaaacatctttttcccctctatcaccaatcctagtccttaccatcatcatcattatcaccaaccaacctcaacaacaacaacagctgcctctgcctatcattttcatttgattataaaaacaatttgtttccatttgtttttgttttctgtagttgggttcttttgttttctggggcatattattaatttataatattattatgtgaaaaaagaagatgaatatttttgctattgcgagaggatgagagtgagagagaattatgcgaaccatttgcgacgcttgtgaaagtgctgctgctatcgtcttctgtgctgccgatgaggctgctctttgcggtgcttgtgatgaaaaggtccatttgtgcaataagcttgccagccggcatgttcgggtgggtctggcaaaccccagtgacgttccttgctgcgacatatgtgaaaatgcacctggtaatatgcaggtgtctttttgtcttgtgctgtttgatttatcaggtttcttaacaggtttgcggaacttatgttcattccttgaaccgtgcatgtagctttcttttactgtgaaatagaggaacatccct

SEQ ID NO: 1198 - DNA, 404 bp, Gossypium hirsutum
  Clone ID: uC-gsronu33B042g01b1
gtttgctgttagggacatgcgtcagactgtggctgttggtgtcatcaagagcgttgagaagaaggacccaacgggtgctaaggtcaccaaatctgctgccaagaagaaatgagattgcatttgatagtatcagagccttttgattttggttatctttgtagtttggtacttgcagttttttagaccaattttgatgtgtgttcatttggctgagactgtgatctgcataccgattgtgtgtttgctttttccgagttaattctagttgaattccttcaaagaatgctaattttgttaaatatacacgcagcgtgaccttttcaattgttaagtttcctattttcagattcatttttttatttttatttaaattttttgccacgtttgtctgtttttctcggtaa

SEQ ID NO: 1199 - DNA, 490 bp, Gossypium hirsutum
  Clone ID: uC-gsronu33B042g06b1
cctctgtcttttttccccctctatttctctttcaatctttgttacacaaattatctccaaagcttgaatacgaagaaagtggtgctgaaattggattttcacgacaacaaatgcagacagaaagccatgaaaacagcctctggtctttcaggggttgaatcagttgccctggacaaggaccaaaaactcacactcacgggagacgttgatccagtcgtggcagtaaggaaactaaggaaggtatgttacactgaaatagtctcggtcggaccggcgaaagagccggagaagaagaaagatgagcccaagaaagacgaaccgaataaaccggcggatacgagcaaagatccgcccaaagtcgcggtggtacagtacttttatcacccctcaatgccccagtactacccgccggtacccgattattacagttaccgttaaagtgcggatgaagattcctttggttttcctttttgctaatttttttttcttt

SEQ ID NO: 1200 - DNA, 219 bp, Gossypium hirsutum
  Clone ID: uC-gsronu33B042g08b1
ttagatgatgaagccaacttattcgctatgcaacttgccagtgcataagtcctccccatggtcctcaaatcagccattgaacttgacttgctcgagatcatggctaaagctgttccaggtgcttgcttgtcctcaaaagaagtggcttacaagcttctcaccactaaccctgatgcacccgtcatgctggaccgtatcttgcgtcttctgtctagcttc

SEQ ID NO: 1201 - DNA, 360 bp, Gossypium hirsutum
  Clone ID: uC-gsronu33B042g09b1
gctgcacgcctgccgtaccggtccgcccgggccgacccgcccctcgcgtccggcgtccagcacacacgggcagctgtagcagcttccattagctttatcaggaagctctggaagctacaagcaaggaaacatatgagcaactgagagaagaagggtagattacaccggtcaaggaagttaagcctgcacaaatcccagaagatcttaacagtgctattaagagcgggtaagctcgtgctcccactcatattttttataccatctttgaagacagaccggaggaactttttcacgtatcgttatcgcttgattttcgttccattattttacttttatattattatatagtttttttctatt

SEQ ID NO: 1202 - DNA, 183 bp, Gossypium hirsutum
  Clone ID: uC-gsronu33B042g10b1
ttccttggtttttcttcttcattttctcctttcctcgatcaaaaacctcagctctcttaccgccaaaggaggatcatcttttcaggttttgcgatggcatcgaagcggatcttgaaggaattgaaggatttacagaaggatcctcctacatcttgcagtgctggtcctgttgctgtagacatg

SEQ ID NO: 1203 - DNA, 151 bp, Gossypium hirsutum
  Clone ID: uC-gsronu33B042g11b1
ttcctcgcgtccgcccacgcgtccgcacatttgtattattcagtggttctcgtatttcttgctgctttagtatacaatgtttcctagattttatgtgtttttcttttccgacctttttgcaaatgcaggggtgatgggtttgatctttaat

SEQ ID NO: 1204 - DNA, 359 bp, Gossypium hirsutum
  Clone ID: uC-gsronu33B042h01b1
ggataatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccattaaagaatcttgttcaaagtgaatg

SEQ ID NO: 1205 - DNA, 109 bp, Gossypium hirsutum
  Clone ID: uC-gsronu33B042h08b1
tcgtgtctctgttaaaatcttataaaaatatatatcggttgctgctcttgtaatgtatcaaaccattttccgaaaatattattacatatttcattacttttaataaaaa

SEQ ID NO: 1206 - DNA, 294 bp, Gossypium hirsutum
  Clone ID: uC-gsronu33B044a01b1
acaacaacttaaaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtattataagaggggggg

SEQ ID NO: 1207 - DNA, 199 bp, Gossypium hirsutum
  Clone ID: uC-gsronu33B044a02b1
cccattcgtccggaaaaacaaagacagttagtttggcccctacgatacaaaataattaaagggattgctcgagggcttttataccttcactcagattcgcgtctcaaaatcatacaccgtgatcttaaagctggtaatattctattagacaaggacatgaccccaaagatttctgattttggtatggtaaagatagttt

SEQ ID NO: 1208 - DNA, 247 bp, Gossypium hirsutum
  Clone ID: uC-gsronu33B044a06b1
gaaactttggcgacctaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccatttttgaggaagaagcaaaattaagggaaggggttgaaattttgcaaatgcctttgggggttttt

SEQ ID NO: 1209 - DNA, 299 bp, Gossypium hirsutum
  Clone ID: uC-gsronu33B044a09b1
ttcatgcgtccggaaagactgttcgttgcagaaaagaaatttcctatttcattttctggccaggttacaaaggacaaaagggatgccaatgtccaaatggaactggccagttctttaaagcacggggaaggtaaagcaacttcattgggttttgatatgcagactgttggaaaggacttagcctatacactgcgcagcgagaccaggtttagtaatctgaagatgaataaggcaatggctggcatttcagttacactctcaggtgatgcacttttttttggagtgaaattttgtagttc

SEQ ID NO: 1210 - DNA, 51 bp, Gossypium hirsutum
  unsure (1)..(51): unsure at all n locations
  Clone ID: uC-gsronu33B044b06b1
cccacgtgntcgaccacgcgtccgatccgataataaaatttgtgtttacat

SEQ ID NO: 1211 - DNA, 370 bp, Gossypium hirsutum
  Clone ID: uC-gsronu33B044b09b1
ctcattcgtccgcccacgcgtccgcccacgcgtccgtttactcttcacttttaccttttagtctatgtttcttgactcttcaattttttttttaagtgcttatgtgcaacacttacgtcaataaatgggtatgatggatatgatctccaataatcctccaaatacatggaaaaactaagaaagatctgaccatagccatgtcagacacttacccgcatcacacacacacccaagtccgagtaacatagcttttagtaactttaggaagcaagaagcaagaagcaagaagcaagtggctttcattaatccccatagttgctcgactcttgaggagtatatgttttttagcatgtgggaatagttgatgttt

SEQ ID NO: 1212 - DNA, 72 bp, Gossypium hirsutum
  Clone ID: uC-gsronu33B044b12b1
tgctgctccagcaataacaacagcaacgagaacagtgcatacattgctgttgacaaattgatcaagacattg

SEQ ID NO: 1213 - DNA, 208 bp, Gossypium hirsutum
  Clone ID: uC-gsronu33B044c02b1
cccactctttcgcccacgcgtccgatgctggatactctcaggtgtgaaggtcttcaaacatgtttgtagaaaattttggtagtagaaaagggaaatacagttttcttgttgctattaaataaagttgaggaaggaaaacagacttttatgtatatatatacaatatacatgtaatgctattctgtcaattgattctcatatttattgt

SEQ ID NO: 1214 - DNA, 209 bp, Gossypium hirsutum
  Clone ID: uC-gsronu33B044c04b1
cggactcgagggttgagagctccgacactattgacaatgttaaggtcaaaatccaggacaaggaaggtatccctccagaccaacagaggttgattttcgcggttaagcagtttgaggattttatgatactttgtagattactacattctttttgttgtctacccttctttttgttttttagtatttgttattaaattttttattttttt

SEQ ID NO: 1215 - DNA, 158 bp, Gossypium hirsutum
  Clone ID: uC-gsronu33B044c07b1
tctcatgcgtccgaggaaaacaagggaaaaagaaaaccctagctttacctttgtgttctttgagaaacatcaaatcgcagagatggatctttcatagatttcacctcagatctctttctctttgtaaaagaaaattgggtttacttatttatttggcg

SEQ ID NO: 1216 - DNA, 373 bp, Gossypium hirsutum
  unsure (1)..(373): unsure at all n locations
  Clone ID: uC-gsronu33B044c08b1
gtattgnttaatcaaaggccgttgaaggaggacgatttaatggcggcggcgacggcgcaagggatggacccagcggttctagactatataattagactgttgactgatgttcgttcagacagtctagttaattaagttcattctatttttattttttttcatacagtttttttgttttttaaattagatgatatacattttttttactctcacttatattttttttttctattttatttcttttaatttttattttatttattcttttatttttttattatttatattatttattttttcttttttatccattttttatttatcctttttatttttaaattttctattcttttttttattttttcatttcttt

SEQ ID NO: 1217 - DNA, 285 bp, Gossypium hirsutum
  Clone ID: uC-gsronu33B044d03b1
gctgtctatcttcttcaaataaactcagacgagcaaacatgactctcagtttagtaatcgatttacggctaaggacatcagctactacattaaccttactaggatgatactctattgtacaatcataatccttaagcaactcaacacacctacgctgcataagatttaactctttttgagttaacagatacttgaggctcttgtgatcagtgtaaatgatacacctctcaccatacagataatgcctccaaatttttagagcatacaagactatagtcaggttaa

SEQ ID NO: 1218 - DNA, 711 bp, Gossypium hirsutum
  Clone ID: uC-gsronu33B044d08b1
tttcattcaaagcaaagaagaatggaaaggctgttatcgttggttgaggttatattatttcttttttttttttaacatttcttttattttattcttttatttttttttttcttttttcttaattctttatattttttttttaattaaattattttatattttttattttttttatattatttttatttctaatcttaatttaattattttatttttatttattttttctaatatatattatttatctttttcttttctttttatatatatttttttttttttataatcaatattaattattttatatataattcttatatatatttttttttattattatttcatttttattattctatttacttttttattttttttaaaatattatttatttatctctatttttatattttcatattaaatttcttttattcttatttatattatatataatatattttttatttattttttatttttattattttatatttattttttcttttttaattaattttatttattaaatatttatttatttatttttattttactttattttttttaatattaaatattttatattctttttatttttttcaattttttttattaatttattatattatattttcctttattatttttactttttaatacttaaatatatatttttatttattttttatactttataatatttttattttt

SEQ ID NO: 1219 - DNA, 155 bp, Gossypium hirsutum
  Clone ID: uC-gsronu33B044e05b1
ctattaaatatatgttttttttctcatttatttgtaatacaagtgtgtacaaaatatattgttgttactaccaaaaaaaaaaaaaaaaaaaaaaaagaaaagaatgtttgaagagttaatgaaaaaaataaaaatagaatttaaaataatattta

SEQ ID NO: 1220 - DNA, 522 bp, Gossypium hirsutum
  Clone ID: uC-gsronu33B044e07b1
cccattcgtccgcccacgcgtccgaagaaacccaagattataaatttagtatcgatttgagtatttgaatagtttagattacaagaatggcaggggaattagtattgttggatttctggccaagtccatttgggatgagatccaggattgctttggctgagaaagggataccatacgagtacagagaagaagatttgaggaacaagagtgatttgttgctgcagatgaaccctgttcacaagaaaatccctgttcttatccataatggtaaacccgtttgtgagtctgtcattcaggttcagtatattgatgaggtctggcatgataaagctcctttgatcccttctgatccttatcaaagagctgttgccagattctgggttgatttcgttgacaagaagatatatgacctgtggagcaaaatatggaagacaaagggagaagaacaaggaaatgcaagaaggatttattgagtgcctgaagcttgttggaggagagcttgtagacaagacttactttgga

SEQ ID NO: 1221 - DNA, 268 bp, Gossypium hirsutum
  Clone ID: uC-gsronu33B044e08b1
ttaataaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaataaaagaagaaaagaggagaaagaagatgcaaaaaaagggtcttttttgtaaagatacacattatgctttcaaaacttgaggaacataaagccttttagatggtcaacaacattaatgatatgctgggggaactatcttttaagatgactatacatatatgtttgtcac

SEQ ID NO: 1222 - DNA, 131 bp, Gossypium hirsutum
  Clone ID: uC-gsronu33B044e10b1
tcattcgtccggattgtttggtttatgtaatctatttttcagattccataatttcaatttgatattaatttttggacctataatcatttgaaatactttttaagttgagaatattgatatgttgccttctt

SEQ ID NO: 1223 - DNA, 398 bp, Gossypium hirsutum
  Clone ID: uC-gsronu33B044f01b1
aggattatttgaatgggatgctgcgggaagttgagggaaagtgggttgtgcaaggagctattgatgttgacattggtgccaatacttcagccgaagatgctgatgaggatgaaggtgttgatgaccaatctgtgaaggttgttgacattgttgacactttcaggcttcaggagcaaccccctttcgacaagaagcagcttgtcatgctcatgaataagttcatcaagaacttgacacctaatctggatgcggaaaagcaagagtccttcaagaaaaacattgacggagcaaccaagtttttgctttcaaaattgatagacctttaatttttcattgcagagagcatgcacgatgatggatgtatggtatttgcttactacaaggatggtgctgctgac

SEQ ID NO: 1224 - DNA, 482 bp, Gossypium hirsutum
  unsure (1)..(482): unsure at all n locations
  Clone ID: uC-gsronu33B044f03b1
tccggcgcgtcgtgtgtcctccacggcggtctcgaactcgaggctgacaagatccgcgccgtcccaccttcccaacgcctccaaatcgtcgaagcttactcgcccgacgccatcgctcccgcaccctcgtcctacggcacctctaagaaccacttcgccgctactcctgctctctccgtctcgtcgtctcctctcgactcccccgtctcttctgcccgctcgtccccaccacctcaaaccccacccatgcttgcttctccaagcaggccggcggcggttgctggtaagagcacggatgagatcgaagtcttgaagttggatgcttctgagaagctgtaaaaggcaatcgggataacttggttcttgacgtttgtgtgtgttgggtgtagaanagacgctggtgttttatatacagtgcttgttcaaccccttccctttcatttccttgggcccattattggagaacggcacacttaacccct

SEQ ID NO: 1225 - DNA, 256 bp, Gossypium hirsutum
  Clone ID: uC-gsronu33B044f04b1
atagatgattaagagggagatctaaatccttcataatctatgtggtggcccgaatattgttaaacttctggatgtggtctgacatcagcactcacaaacaccaagctagatattcgagtatgataacagctcagatttgatggatctataccgaactgtgactgactatgacattcgctactatatatatgaactgctgaagggcttagattactgccatctacacgggataacgcatagagatgatacgcctgac

SEQ ID NO: 1226 - DNA, 304 bp, Gossypium hirsutum
  Clone ID: uC-gsronu33B044f06b1
gaatttattatcaaatcttcttctccttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccggcggaaacggtaccggaggtgaa

SEQ ID NO: 1227 - DNA, 481 bp, Gossypium hirsutum
  Clone ID: uC-gsronu33B044f08b1
acattgccttttggtgctggtgctcctgcatttgcaccagttggcaatttctcaacattgcctcctacaggtcctctggtagctgcttctggactaacgcatacagtgcctggcagcagtggcagttcccagattggtgttaataatgctgggcaatggcctaatatgcagcaccaacagactcattttttctccacagctggcggtcagactagccaacaacttaacggagcctcgccaagtcagccatggaattttgctccttccccgcatatgcaggggcctcaagctgtctcaaaacctttccaggatgtcacttctgccgttgcatcacagcaaccacctacagaaacaaaagcaagtggaagacaagaactacctgcggatctatttactgcaacctattctacctatcctgcacctacaccaggatggcaaatggccccttcttgtggcatggggttcacatgcaatatatact

SEQ ID NO: 1228 - DNA, 456 bp, Gossypium hirsutum
  Clone ID: uC-gsronu33B044f09b1
ttcattcgtccgcaaaaatgatgatcggagaatcaatccaaccaaatcccaccatcaaaatccccgtaggggacccattcaacgatccgacggctagctttccctccgttaactttaactacaacaatgcagtcagtagtccttgccccgtcgattacctcgggtctctccaccgttacctaccgtcaaacgactacgagtccgattcgtttagtgatgattcggacttgcctgttgatgcattctcatgcgaccatttccggatgtacgagttcaaggtgaggaggtgtgctcgtggaaggtcacatgactggactgagtgtccgtacgctcaccctggtgagaaggcccgaagaagggaccccgaaaagtttcagttcttcacgtggttccacactgcgaaccggtttttgcagcttttctttaacttcaactcgtacgccgacttcgttctag

SEQ ID NO: 1229 - DNA, 278 bp, Gossypium hirsutum
  Clone ID: uC-gsronu33B044g02b1
ctacttattggcttttctccatccgcttgttcaagcgcactaaatcaaataccatagtactcacaggccttagtgggagcggtaaaacagatcttttctatgtgcttcgtgatggttcctcacatcagggtactgtcacatccatggaaccaaatgagggcactgtcgtgctaaactccgaaagtgataagaagggcaaaattaagccgggtcatcttgttgatgttcctggtcattctcgtcttcgggccaaactggacgaattgttgcctcaagca

SEQ ID NO: 1230 - DNA, 465 bp, Gossypium hirsutum
  Clone ID: uC-gsronu33B044g08b1
tggttttctgcctagatcgagttaggaagttagctgataactgcactggtctgcagggctttatggtgttcaatgctgtcggcggtggaaccggttctggtcttggatctttgttgttggagcgcttgtcggtggattatggaaagaaatcaaagctcgggttcaccatctatccttcgcctcaggtctcaactgcagttgtggagccttacaatagtgttctgtccactcattcccttcttgagcacacagatgtggccgtgctcttggacaatgaagcaatttacgacatatgccggagatccctcgatatcgagaggccaacttacaccaatttgaacccggctgatttctcaaaccatatcgtccttgacgacttctttaaggtttgatggagccattaatgtagacattacagagttccaaaccaatcttgtgccatattctcggatccatttcatgctc

SEQ ID NO: 1231 - DNA, 153 bp, Gossypium hirsutum
  Clone ID: uC-gsronu33B044g09b1
gcctcaaccagaaccaacaaatcaccctccgaacatccatccctccaacgtaccagggtcacaaagagatcaacgtttggtcacccttcgtcaatgggaattcagtgcctatcgcaccggaatattccgccagtttaggatccgatcagagtg

SEQ ID NO: 1232 - DNA, 196 bp, Gossypium hirsutum
  Clone ID: uC-gsronu33B044g10b1
gcgtagtgcagaccaaagctgttcttcctttcttacattcattcatccaaaagaaacaccctgttaattcctagactgaagcgatgaagtcgctgaagttcaaactagtagaaatctttctatttctgagtttgaattatgcatgcattgcagcagaagaaaagatccagaaagctttatggacctattttgtttc

SEQ ID NO: 1233 - DNA, 291 bp, Gossypium hirsutum
  Clone ID: uC-gsronu33B044g11b1
gttattatgctagagcaaatgagagaaataggcgcaatgacaggccacgcaattatgatagatcaaggaactatgagaggagaagggagaacatgaatactcgagatagtcagatgcctcctcaaaatcagggcatgcagaatgtcgctccaaagactgctgggatgcctcccaacaacatgggagggatgccaccccgcaacatgggagggatgcctccccagaacatgggagggatgccacccaacaacatgggaaggatgccacccaacaatatgggaggaatgacac

SEQ ID NO: 1234 - DNA, 428 bp, Gossypium hirsutum
  Clone ID: uC-gsronu33B044h01b1
cccactcgttcgaaaaaaactgctctattctctcttttactccacacgtcggcactctcccccttttcaactccgactgaagcgcagcaagggcaccgacggcgcaccaccactaaactggaggagaacatgggctatgcgagggcaacgtgctgcgatgttgaggcgattgttgcagcgcggaggaagggaagccagctgttgtgttgttgatttttttttagtttgggttactggttgggtttggggctggtaattgggccggagttcccccgccccgccaccatgaaactgtttctacggccaaaggacgttgaatagtgggtagacttgttgtataaatattgccatgatgttttggatactttcatagtttaattgttcttaggaattttgggattggacccttaatatgctgattcctcgcc

SEQ ID NO: 1235 - DNA, 263 bp, Gossypium hirsutum
  Clone ID: uC-gsronu33B044h02b1
tgggttaagaatattatatattactttccccccccaacattttttttatttattttctatttttatatattttttttatttctcacccccccctttattttatattttattttgttttttgttattatttattgcttttaattattttttttttaatttttttcttctctatttattattttttttgtgtttatttattatttgttttttattttttatttctcttttttttctttatttttatttttatattttaattttta

SEQ ID NO: 1236 - DNA, 298 bp, Gossypium hirsutum
  Clone ID: uC-gsronu33B044h03b1
acggtgtttctgccctgggaaaagatggcaataatggacctaatatcagagaagtagggaagtctatacttaaccttctttactcggagcctggaaatggtctgtggcaagcgaaagccgactccaattttatgcattgacggacaccgaaaccccttattggaggaaacacttgtggtgatacctgattcaatatgggatgcacctattgctggtggagttccatggtggacgcgaagatctttttgccaatgtacatgatttattgccaccctgattataacgcgcgagatgagga

SEQ ID NO: 1237 - DNA, 114 bp, Gossypium hirsutum
  unsure (1)..(114): unsure at all n locations
  Clone ID: uC-gsronu33B044h08b1
tcgttcgttttataaatnnatgtntttggatcattcatgagaatccaactgttttttgaaagggatgtgaaaatgtatattgtgatatagtcgtaatctaaaccctattttttt

SEQ ID NO: 1238 - DNA, 457 bp, Gossypium hirsutum
  Clone ID: uC-gsronu33B046a03b1
gccttgcttttgcattatttgggccacaagaatctcagttgacattagactggccaacaagaatgaagatctgcattggtatagctagagggttagcttacctccatgaggaatcaaggttgaagattgtgcatagagacataaaggccactaatgtgttgcttgataagaatctaaaccctaaaatatccgacttcggtttggccaagcttgatgaagaagataatacccacattagtacccgagttgcaggaacttatggctatatggctcctgagtatgcattgcatggccatttgacagagaaagcggatgtttatagttttgggatagtggctctcgaaattgttagtgggaggtgcaacactagaagccgcccaaagcaagaacctttcattcttcttgaatgggctcatgttttgaaggagaatgggagcttgttggaaattagtgatac

SEQ ID NO: 1239 - DNA, 125 bp, Gossypium hirsutum
  Clone ID: uC-gsronu33B046a04b1
agcgtaccgccctcgcgtctgtgggaacgccgttcgatcaccttgaagcttcatcatttgatagcaatgattgtctttgcgacaacccactcaagacttgctaacaatatctgcttaataaattt

SEQ ID NO: 1240 - DNA, 106 bp, Gossypium hirsutum
  unsure (1)..(106): unsure at all n locations
  Clone ID: uC-gsronu33B046a08b1
tctnaggaccattcagaccaccattaccaaacaaggctttctttttggcctcaatggttcaagattctttcccaacaagaaagtcagtaatttagaaagagaggtg

SEQ ID NO: 1241 - DNA, 322 bp, Gossypium hirsutum
  Clone ID: uC-gsronu33B046b01b1
ctttaagataaaagcaacggcctgcaggagctgccaatcacagacaatggtagatcaatgaatgttgttgatggagctgacaatactgttaacattccagatttaaagaacaccttcagcactccaggaacataaaacaatatccaatatttcccttaaaattgatatgtttcgagcagagtagttcttcccaaggcggtaaaaactactatatatgtaatccaccccctccctattaagcacttttgtaactcaataatcatcttttgattgtactctttttttttctttaataatctaattaatttactcttgaggcttt

SEQ ID NO: 1242 - DNA, 666 bp, Gossypium hirsutum
  Clone ID: uC-gsronu33B046b02b1
gcttacattgcccttcgtgaccgagcaccttatcctccaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagaggagatatggggtgctaaattcaaggtggaagggccaacagttgttgctgccacagagtagtcctttgctttctccttctaaatctatggatccatgggaatataggagctgccaatgcatagcatatggatcagtctccatgtgaataactgagttccagtacttgtagaatgggaaatgaaaagaagaaaaaaaaaaggaagaaaaagaactgtttggttttgagaaatggcagtaaccttctgttaggtggctttatgtaaaaccagctttttattccgttccgcctttgacaatatatgcagcttaactttagtctaaaaagctggttggggtccc

SEQ ID NO: 1243 - DNA, 488 bp, Gossypium hirsutum
  Clone ID: uC-gsronu33B046b03b1
ttttttttttgttaagccaggctgcctactcttgatgttggttatgttaagcaaattcatgagatcaaggacttccttctcactgccagaaagaaaggtgcatgctctgtaaaaatcaagaagagcagagacgttgtaaagttcaaagttcgctgttcaaagtacttgtatacactttgtgtgtctgatgctgagaaggctgataagttgaagcagtctctccctccaggtttgagtgtccaggacctgtgaaaatagggccgctttgaattcatcatccaattactaggtgatgaaagctagattttgactttggttttatcatatttcatgcctttcaaactcaaaatttactgaaatgggagtcgagttcttttttaatggttaatgaatgtgttttgcttttggtttgtcctatgctctaagtttttctcgccttctggaaaactgaaagatctttacctggtctgcaagtttatgttgttttg

SEQ ID NO: 1244 - DNA, 82 bp, Gossypium hirsutum
  Clone ID: uC-gsronu33B046b06b1
cccatgcgatcggattaagcgaaatcgattagtgcttgatttctttctttgtaatggctgctgataaaacccaaggctggag

SEQ ID NO: 1245 - DNA, 287 bp, Gossypium hirsutum
  Clone ID: uC-gsronu33B046b07b1
taaataaaaaaaaaaaaaaaaaaaaaaaaaaaaaaaaaaaaaaaaaaaaaaaaaagcaaaaaaaaaaaaaaaaaaaaaaaaaaaaaaaaaaaaaaaaaaaaaaaaaaaataaaaggggggccctttttggggattaaaagtttccttacttttaattgaatatctaaagattttttaatggggttcttaaaataaatgaattgggccgtttttttaataattaggtatgtgtaaacctttatttattcatactaaatttatttttaaaaataaattcttatttttaa

SEQ ID NO: 1246 - DNA, 98 bp, Gossypium hirsutum
  Clone ID: uC-gsronu33B046b09b1
ttttccatgcgtccgctcaaacatttagcgaccatgtcgacccctttgcaaacgaacgtgttgtccaacgccaaacacgatcatccagttttgaagtt

SEQ ID NO: 1247 - DNA, 143 bp, Gossypium hirsutum
  unsure (1)..(143): unsure at all n locations
  Clone ID: uC-gsronu33B046b11b1
nacggtccagagaatgttgaagctgcacagaaggctcttttggtgcgtgcaaaggcaaactctctggctcaacttggaaaatactctgccgagggtgaaagtgaagaagccaagaaaggaattgttgttaaggataataccta

SEQ ID NO: 1248 - DNA, 221 bp, Gossypium hirsutum
  Clone ID: uC-gsronu33B046b12b1
tcgatcttccctcccccaatcacacaacttagtgttttctttttgtttgcagcggagccatggaagtgacgccaggcagaaagcagttctatagcaattatatgctattgaaccctaagaaagcctctttctttgatctaactgccctcttgttttctaaaaatttaaagaagagaaaatttatagaaaccagtatcgaaactgaggacagttactggtat

SEQ ID NO: 1249 - DNA, 331 bp, Gossypium hirsutum
  Clone ID: uC-gsronu33B046c04b1
gagtttcattacttggctaatccagtcaccaaccatgttcaaagtgctgagcaacacaaccaagatgtgaattctttgggactaatctcttccagaaaaactgccgaagctgttgatatcttgaagctgatgtcgtctacattcttggtggctctttgctaagctattgattagtggcttgtttaagagtattctaggaatttaatttctatttttttcttttttctttttgtatttattaaattcacttttttaattctttgttttttattttttttttttattttttattttttaactttctttattttattctcttcttcattttctt

SEQ ID NO: 1250 - DNA, 88 bp, Gossypium hirsutum
  unsure (1)..(88): unsure at all n locations
  Clone ID: uC-gsronu33B046c05b1
ggttatnatgagactcggatattactggctgacgatggaatgcgactgtattaatttcgcacgaaaatgccacaaatgttaaatttat

SEQ ID NO: 1251 - DNA, 82 bp, Gossypium hirsutum
  unsure (1)..(82): unsure at all n locations
  Clone ID: uC-gsronu33B046c06b1
gggttacnatccaaagaagctagacaaaaattgcttagttggtgggagttacactacaaatggccgcacccctcggagactg

SEQ ID NO: 1252 - DNA, 429 bp, Gossypium hirsutum
  Clone ID: uC-gsronu33B046c07b1
ttttctcgcaactgtgaccccattgttcctaacaacactggggatgttcgataagaagaagggagaggagatgattgcgacttcagcagtgttgaaaggcaccgttttggagcctgaagattttgcacatgcagcgctgtatttggcaagcgatgaggctaaatttatcagtggtgtcaacttgccagtcgatggagggtatagtctcagcaaccagtcatggaagatgggattcgcagcactttttgggtaaacctttactccttggacaaaatttccttgaataaggaaataaaagttacccaaaactgcgctacttgtaataagattgtattgtcgatcagtctcatgtaatgcttttgatgtgtcctttctttaccaatgccacttatatcgttttgaaagattaaacgatgtcaattttattcc

SEQ ID NO: 1253 - DNA, 97 bp, Gossypium hirsutum
  Clone ID: uC-gsronu33B046c08b1
taaatacagaatagaaaaccaagtatgaatccaactgttgttttgttcatgatcatcctatgcagcactcccatcagcattagcctggcagattatg

SEQ ID NO: 1254 - DNA, 469 bp, Gossypium hirsutum
  Clone ID: uC-gsronu33B046c09b1
gtgtaaactccaattcctcaagctcctcgcagcttcagaactctgggtctgaagaggacctgcaccagcagaatatgatggaccaaagaaaaagaaagagaaaggaatctaacagggaatcggcaagaagatccaggatgaggaaacagcagcacttggatgaattagtggcccaagtggctcagctcagcaaagaaaacaaccaaatcctgaacagcatcaacttcaccacccaccactatctcaacattcaggctgagaactcggttctgagggctcagatgatggaactgagtcaaagactcgactatctgaatcaaatcctcagttatctcaacaccatgagcgccagtgagttggtgtacgaaactgatcagtgctttgaaacaagtacttgtgaccacggtttcaccaagcccttccatttaccttaccttaaccaacccaacatggcctcttcagacatggt

SEQ ID NO: 1255 - DNA, 103 bp, Gossypium hirsutum
  Clone ID: uC-gsronu33B046c11b1
ctgatagtttttagttgcctcgatttcaagtgaatcagattgggtaaggaaaagactcacattaacattgtggtcattggtcacgtcgatttttggcaaatta

SEQ ID NO: 1256 - DNA, 89 bp, Gossypium hirsutum
  Clone ID: uC-gsronu33B046c12b1
tttcccatgcgtccgcccacgcgtccgctccacaaaaacctaaattaagtttgctttgaatctgagcaaatctaagcttattaagagag

SEQ ID NO: 1257 - DNA, 390 bp, Gossypium hirsutum
  Clone ID: uC-gsronu33B046d01b1
atctatattctattattatttttcttaattttagtaatgtaaagttcgttcctttttcttaactggcttggttagacttggcaatccatgtatgagtgtatatatgtgtgtcctgtttcatattttttaacataaacctaaacgattaaatttgtcaaaatcctaaacatgaatactattatactcgtcatgtttatttcattgttttcgtgcttatcaatcacgtctaggtgtcattttgtgctcaaaattgtcagaggtttatggtgacttgaagtaacaatttactcagtgatatgattttctcgtaaaagccggcttgatgtttctcttacataagattttggtctttagtttgtatcttagtgcccgtttttttgctataggttc

SEQ ID NO: 1258 - DNA, 430 bp, Gossypium hirsutum
  Clone ID: uC-gsronu33B046d02b1
ccttcgcttcgcacagaattgttgttccaattggtggtataccagttgatacaagtgaattagagcttaaaccggagggaaagttgacagttactgtagtcaaagcgaatgatttaaagaacatggaaatgattggaaaatctgatccttatgttgtcgtgcatatccgacctctcttcaagattaaaacaaaagtcatcgagaacaacctgaatcccgtttggaatgaaacatttgagttgattgccgaagatcgagagacacaggaacttactgtagaggttttcgaccaggacattgggcaagacaagaggttgggaattgcaaaattccgtttgattgaactggaaccggagacaccaaaggaggttaatctgaaccttctgtcctcacttgatacacttaaaataaaaggatacaaggacagggg

SEQ ID NO: 1259 - DNA, 541 bp, Gossypium hirsutum
  Clone ID: uC-gsronu33B046d05b1
gtttttagttacaaccccgataatgataccaccaggatcaagcttccatctggttctaagaagattgttccaagtggctgtcgtgcaatgattggccaagttgcaggtggtggtaggactgagaaacctctcctcaaggctggtaatgcttatcacaagtttagagtgaagaggaactgctggcctaaggtgcgtggtgtagctatgaaccctgttgagcatccccatggaggtggtaaccatcaacacatcggtcatgctagtactgttaggcgtgatgctcctcctggacagaaagttggtcttattgctgctaggagaactggtaggctcagaggacaagctgctgctactgctgccaaagctgacaaggcttaggcttaggatattacttgctgaaatttaggtctttgggctttatatttacatttcaaagttttaagacccttatgctgaaatgggttggattaccagaaattggactgttttagttggttgagcaatgatttgtttttattcggattttactcatggtttggat

SEQ ID NO: 1260 - DNA, 218 bp, Gossypium hirsutum
  Clone ID: uC-gsronu33B046d11b1
tggtattggatgttccttttgagatgatagagtattttgatccctgtcatcccattttggttggaggaattggtctcggtgaggaaaatattggatacatgcagacaaggttaaatcgacacaaatggtacatgaaagtgctgaagactagagatccaataattgttaaaattggatggaggctttaccagaccatccctgtttaataccattgagga

SEQ ID NO: 1261 - DNA, 129 bp, Gossypium hirsutum
  Clone ID: uC-gsronu33B046d12b1
tgcaacaagctcagggtgttgttgaagttgaagatagttttaattattatatatatttctaatttattaaatataatatttaatttatattatttttataattaatatttattattatattaatttttt

SEQ ID NO: 1262 - DNA, 448 bp, Gossypium hirsutum
  Clone ID: uC-gsronu33B046e01b1
ccctcgcgttcgcccacgcgtccgatcatattggctaagttgtcagtgataccggttagaagaggttactggggaaataagatcggaaaacctcatactgtgccatgcaaggttaccgggaaatgtgggtccgtcaccgttaggatggtgccggctcctagaggtgctggtattgtggctgctagggttcccaaaaaggtgcttcagtttgctgggattgaagatgtcttcacttcttcaaggggttcaaccaaaactcttggaaactttgtcaaggccacctttgaatgtcttctgaaaacatatggtttcttgacaccggatttctggagagagactcgtttcacaaggtctccattccaggagtatactgatctgttgggaaagccattgaagacccttgtactggaagatgtccagagagttgatatctgattgaagatcaaca

SEQ ID NO: 1263 - DNA, 331 bp, Gossypium hirsutum
  Clone ID: uC-gsronu33B046e03b1
ggctcttgctcactacaaggatggtgctgttgacccgacatttttgtactttgcgtatgcattgaaggaggtcaagtgctgaggtttgaagcaaagaaaaaaaaagtggttgctgaagaatttagtcctttttattattgcttttgtctcttattttcagtactctgctaaagacataaattatttatggtttttgatgtttttgatttaattgtttgttgttttatcatggaatggtttctatttttatgggttgactaaacaagaatttaactctttgttctattactacttaattttattggaaggaggtttttggggccgataataa

SEQ ID NO: 1264 - DNA, 456 bp, Gossypium hirsutum
  Clone ID: uC-gsronu33B046e05b1
cttgtgtttagtgtagagatgaggaaaatcatgggtgccaaagttcttttcttctttgctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttggttcttgtgctgatatccttgttctggctgctaaggaaggcatcgtttcgtgggaggcccttata

SEQ ID NO: 1265 - DNA, 326 bp, Gossypium hirsutum
  Clone ID: uC-gsronu33B046e07b1
tcgccttcgcgtccgggaaacacagcccgtgccacgagtaggtgtagtgctgttcgtgttgaaggggaaatcggtcctcctgggtcgccgccgcgcctcaatcggtgaatccacctttgctctccccggcggccacctcgagtttggtgagagcttcgaagagtgcggagccagagagttgatggaggagacgggcttggaaatggggaaagcagacttcttaacagtgaccaataaagtcttcctggacaaattcaaacactgccattacgtcatcgtctttttccgtgcagtgctggcggaccctaatcaaggtccacaaaacc

SEQ ID NO: 1266 - DNA, 82 bp, Gossypium hirsutum
  Clone ID: uC-gsronu33B046e11b1
tgtgattatcagaaatcaaggaggcaggtgggtagctgtttattatcaagtacacttattaaccatacctatatcgaaaagg

SEQ ID NO: 1267 - DNA, 139 bp, Gossypium hirsutum
  unsure (1)..(139): unsure at all n locations
  Clone ID: uC-gsronu33B046f01b1
acgttgcgttcgaaaagggatcgactgaggtcggtgtggaggcttcaggcttactgacacaagcgtgcgacctcatagnggagacatagcggaaccttaatacaactcagcgtccccatggttacaacggaccatccga

SEQ ID NO: 1268 - DNA, 513 bp, Gossypium hirsutum
  Clone ID: uC-gsronu33B046f05b1
ctcttctcatttccaaagggctgagcactgaagaagaaaaagtagcatagatcggcaacgtaacagtgaaactcgggggaaatggcgttggcgttcgacgagtacggtaggccattcattatacttaaagaacaagagcagaaaacgaggctgagcgggctcgaagctcaaaaagccaacatttccgcaggcagagcggtctctcggatcctccgaacctctctaggacccaaaggcatggataagatgctccaaagccccgacggcgatgtcaccatcacaaacgatggggcaacaatattggagcagatggatgttgacaatcaaattgctaagttgatggttgagctgtctcggagtcaggattatgaaattggggatggaacgactggtgttggtgtcatggctggagcacttctagagcaagcagagcggctattggaacgtgggattcattccatccgtattgcagagggttattgaatggcttctagaatagctgttgagcatttg

SEQ ID NO: 1269 - DNA, 119 bp, Gossypium hirsutum
  Clone ID: uC-gsronu33B046f11b1
tgaaataaaaaaaaaaagggaagctctctctcttgttgtaagctaaaaaaagaggctccattttcgattcctttttttcttaattttctttagagaatgagagagattccttccttttt

SEQ ID NO: 1270 - DNA, 276 bp, Gossypium hirsutum
  Clone ID: uC-gsronu33B046g02b1
ccctcgcgttctctgagttttcaacttaaaatttcttggttttcctcaagaaggaagaagatgttgcaaatagctttcagctcgtattcatggctgttgactgctagcaaccagaaagatggaatgttgttcccagtagctttgtcatttttggtagccatattgggaatttcactgtggcacgtttggaccataaggaagcccaagaaagacatcgccccattaccgtcgggtccccgtgggttgcccaattgcgggacattcttccatatcttg

SEQ ID NO: 1271 - DNA, 275 bp, Gossypium hirsutum
  Clone ID: uC-gsronu33B046g03b1
attttctctcataaaagtgaagcaaagaatacttgcatcaaacagatggcaaccatggagaaggggttagagtttgagaacaagaatttaggcctcaagcacctaaacttcgtcagggtggctacaatccacgccttggtttgcgtctcgaacctttacgattactctaaacagaactcggggccgttgagatccaccgttgacgccgtcgagcatgccgttaccactgccgtcggtcccggctacgggaaatttaaggatgttcctgatcattt

SEQ ID NO: 1272 - DNA, 559 bp, Gossypium hirsutum
  Clone ID: uC-gsronu33B046g04b1
ccctttcgttctattcgagcaagcaccgcctggtgatgcgaaagctggggagaagatcttcaagaccaagtgtgctcagtgtcataccgtcgataaaggcgccggtcacaagcaagggccaaatttgaatgggcttttcaggaggcagtccgggacaacaccgggatactcgtactctgctgctaataaaaatatggctgtgatttggggagagaatactttgtatgactacttgcttaatcctaagaagtacattcccgggacaaagatggttttccccggattgaagaagcctcaagatcgtgccgacctgattgcatacctgaaggaatcaaccgcctgattcgtctccggttttattaatatgacctatattttggaactgtgacaaaatgaagaattttgatcaatgatgtattttttttacatggaaaaagaaaccattcttgaaataaaggttaaccatgaaaacgactccaaagataattggagtgaaaatgatttttgttagactaaaaacttttgatgagaggaattggttattcatgatggttatttg

SEQ ID NO: 1273 - DNA, 99 bp, Gossypium hirsutum
  Clone ID: uC-gsronu33B046g06b1
gtcttgcttatgataaacctaccgaaaattatggggtacagatttatttacacgagctactcagccacacactctcaaactatagatacagtagaaaac

SEQ ID NO: 1274 - DNA, 237 bp, Gossypium hirsutum
  unsure (1)..(237): unsure at all n locations
  Clone ID: uC-gsronu33B046g10b1
tttatatgttgggctcggtgcgcgttgttgttggaccgtcnnnnnnaaatgctgctcactcatttcgggtttggctgatctcgatgctgctgtttgcctttgcactgctattaaagctaatgtgttgggggttaatgtgnnngttcctgtttcattgtctatgcttctganttcctgcgaaaagcaaatgcctgctggttacaaatgtgcttaagcactgttcgggcttttctttta

SEQ ID NO: 1275 - DNA, 93 bp, Gossypium hirsutum
  Clone ID: uC-gsronu33B046h05b1
ctattatgattaactgatagaaatcaaatcaaaagagagaaaaatgaatatcccaaatctgaaccctaaaagatggcgaagatatggggaaag

SEQ ID NO: 1276 - DNA, 272 bp, Gossypium hirsutum
  Clone ID: uC-gsronu33B046h09b1
tttccctcgcgtccgccaaaacaaaatacaaagattaagccaattttcagtattatgttaactatggcttcaaatcccaaggcattttttgacatgacagatcggaggtcatccggccgggcgaatcgtgatggagcttttcgcagacgttacttcttgtactgccgagaacttgcggctgctatgtaccggtgagaaaggagatgggcggtccggtaaactacttcactacaatggctttgagttccaccgcgtgatccctgattttatgt

SEQ ID NO: 1277 - DNA, 63 bp, Gossypium hirsutum
  Clone ID: uC-gsronu33B046h10b1
tgaaaataaaaaaactatcaactaaaagaaaggtcaaatgatattaaaaattctggttctcca

SEQ ID NO: 1278 - DNA, 228 bp, Gossypium hirsutum
  Clone ID: uC-gsronu33B046h11b1
tcttgattacaagaactgactgcgttgataaaaactgatattaccaccttgaatatggcactttctgatttacaaacacttcaaaacatggagattgccgatgggaattactccgaggatcgaattgttcattcgaccactgtttgtgatgacttgaagaacaagttaatgggtgctacatagcatttttaagatgcgttgactgcaagaactgttaatcctaaagct

SEQ ID NO: 1279 - DNA, 151 bp, Gossypium hirsutum
  Clone ID: uC-gsronu33B046h12b1
ggaaaaagaaaaccctagcttgacctttttgttctttgtgaaacatcaaatcgcagagatggatctttcatagatttcgcctcagatctctttctctttgtaaaagaaaattgggtttacttatttatttggatcggattgggttggtttg

SEQ ID NO: 1280 - DNA, 546 bp, Gossypium hirsutum
  Clone ID: uC-gsronu33B047a03b1
ggcgtagctctcgatccacatcataaaaaaagtaaaggagaaaatgaagggtctgcaggcacttatattggcaatggtaacggatatggcgatcgctacaactgatgctcaaagcatttgcagcatgccagcttcaggtttgatggcatgcaaaccagcagtgacccctcccaaccctccgtcgcccacgtcaacttgctgctccgacctctcccacgctgacatgcgttgcctttgctcatataagaactccaagctgttgccttcccttgtgaattgacccaaaccttgccatgaaattgcctagcttgtgcaagcttcctcatcctgcaaatggttagttcctggctctccatttttgatctcaaatgtgagggaaaatcatgcttattataagcctctacttcacattattgtactgagcttggggttttctttttcctttatttcttctatgagctgggcttcgattggtatcttatagtcgtgtaatatcacatacgtgtgatttctcaccaataatcatatattagtattggttccacc

SEQ ID NO: 1281 - DNA, 535 bp, Gossypium hirsutum
  Clone ID: uC-gsronu33B047a04b1
ccctcgcgttcgcccacgcgtccgctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaagaccataactttggaagtcgaaagctctgacaccattgacaacgtcaaggccaagatccaagacaaggaaggcatcccaccagaccagcaaaggctcatctttgccgggaaacaactcgaggacggtcgcaccttggccgattacaacatccagaaggagtcgaccctccatttggtattgaggcttcgtggtgggatgcagattttcgtcaagacgttgactgggaaaaccataactttggaggtggagagtttcgatacgatcgacaatg

SEQ ID NO: 1282 - DNA, 144 bp, Gossypium hirsutum
  unsure (1)..(144): unsure at all n locations
  Clone ID: uC-gsronu33B047a09b1
tttttctccttaggtaggtggaagcttcatgaagatgaagctttccgtgttcctgtatgttgagtttagcaaaatcatgtatctgactcaattattggtaatgacaaagactcatgagagactgtaaattccgtagttaannnt

SEQ ID NO: 1283 - DNA, 473 bp, Gossypium hirsutum
  Clone ID: uC-gsronu33B047a12b1
ttctcttaaaccccaatattagaaaatcaaaatgagaagctcactgtggaagctctaaaggacgatggttcaaacaacaattttaagaaagagattgttgaagaagatcgaactgtgaaggatcacgaacaagcgccagttgccgtgaaagaagccataactgttccaggagaagccattgagaagcctgaagcaagatttgcaacctgaaaaagctgaggttgatattggagaagagaaaacagataattcaggtgttgaaataaaattggaacctgcatccacaggtagtggtaatttatcattttccgatctactccaacaatctacagaaaagaaagtggagatggctgaacgtgtgattgaagagagggaacttacagtaagcaaggaagcagcaacggtggaagctgcaggaactattcaagccaaaagaattaaaaactggtgaagtaccctgaggagaggaacag

SEQ ID NO: 1284 - DNA, 447 bp, Gossypium hirsutum
  unsure (1)..(447): unsure at all n locations
  Clone ID: uC-gsronu33B047b03b1
atgttatctcattaactgtcagtctaaccttaaaacctgttattttcctgtttcctttcttctttcgtttgtccgggaatctgagtgacaatttcttttcttttgaacggnggagcgtaatttaatttttgttataagcgtttccttattatggtgtagtggtaagtataataggcgaatataagttgaaataatacaggagatgagcaaagaacacctgcctgagccactcgatttcttcatttggaccgttgaggatgctgtatgtgtgggggaagatataaatcttggcagctaccgccagattttcaaagaacatggcgtaaatggggaatacctggaaggcatgtctatgttcacaactgaacagattcttagatttataaggcaatgccatatgaagggnggagacttcatcactctatgcaaggaactcaggcgaataaa

SEQ ID NO: 1285 - DNA, 195 bp, Gossypium hirsutum
  Clone ID: uC-gsronu33B047b05b1
ccctctctttcgcaagcttcgagggtttacacgttgcacttgaaacatctagcaagccaagcgaaaatggttctccaaaacgatatcgatttgttgaatcctccagcaaaacttgagaagaagaagcacatgcctcaagcgtcttggtcagtctcccaattctttcttcactgatgtcatattcccttgctgtct

SEQ ID NO: 1286 - DNA, 454 bp, Gossypium hirsutum
  Clone ID: uC-gsronu33B047b07b1
tccacgcgtccgatgtttcataatatgatagcatgcttcttatcaagtctaaattcgaaagaatatggatcatttgtcaacccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaagaaccaaatttaccaacccgggcatggcaaggaaaaacttttttaaaggggcccccaaaataaaataaccggcccaggtttaaaaaacctttgacgggaaaaaacccggggttacccaaattaaatcccttggaaaaaaatccccttttgccaatgggggtaaaaaaaaaaaaggcccaaccataatgccctttccaaaaattggccaccccaaatgggaaaagggacccccccc

SEQ ID NO: 1287 - DNA, 387 bp, Gossypium hirsutum
  Clone ID: uC-gsronu33B047b09b1
ttatgatgaaaaagcccctgactctgcctccactaaggctgctgattctgctaagaaggggtatgttggaattcacagttcgggattcagagactttctgctgaaaccggagctgcttcgatctattgtggattctggttttgaacatccttccgaagtgcaacacgagtgcatccctcaagctattctgggaatggatgtgatttgccaagcaaaatctggaatggggaaaacagctgttttcgttctatcaactcttcagcaaattgagcctgttgctgggcaagttgccgcacttgttctatgtcacactagagaattagcgtaccagatttgccatgaagttgagaggttcagtacttatctaccagatattaaagttgctgt

SEQ ID NO: 1288 - DNA, 528 bp, Gossypium hirsutum
  Clone ID: uC-gsronu33B047b10b1
ccctcgcgtccgcccacgcgtccgcagatggcaaatatgattgggttgacactttgaatattatcactaacccactccatatgcgcagccctcatgtcttcccacaactccctcctcctttaagaagtacgatggagtgttacttatcggagctccaaaagcttgccacaaaacttattggtttcatgggaaaagcattgaaaattaaagaaaaggagatgatgcagttgtttgatgatgggttgcaagcggtgaagatggcatattatcctccatgcccacatccagagtcggtgatgggtcttattccacactctgatatgactctcctcactatcctacaccaactaaatggtggtggatggccttgagattaaaaaaaatggcctttggttccctttcaacgtcaacccagatgcttttgtggtcaatgttggagacattttcgagatatttagcacggggtttatacagcgttgacacaggttacttgcaataagagagagaaagataacagttaccttcaac

SEQ ID NO: 1289 - DNA, 289 bp, Gossypium hirsutum
  Clone ID: uC-gsronu33B047c03b1
tccatacatccggccacgcctccgtgtgttatacgcacacgctgactggctctcaccagctatcttttattacattgtgtatggtgttgtcaagtcagtagccaaagatgtacaaatatcttatatgatcactacaattatttccgaaaatacccagccatgtgcatcttctgaaatgtcatggaatctattcgaattaactgccagtacgacactgacgtattggattgagctcagccggatatatgaaataatgctcaacatgtatattttcgttttcacagcggaa

SEQ ID NO: 1290 - DNA, 383 bp, Gossypium hirsutum
  Clone ID: uC-gsronu33B047c04b1
ccctcgcgtccgcatctttgtttcatcggcacactgaaacctttagaatctccaaagctacgtcgtttctgaagtcatgggacaaatcctagaaaaaatccatgggaaggaatggagaaagagacagattaggaaaatcagtgataaggtttttgagcgtgtcaaaaatcaatcaggaagagctactttgacatttgaagatctatatatcgctgtcttgctggtgtataatgatattaataagcgtttgcctgggccgcactttgatccaccctctaaggaccaaatcagatcaatgatgcaggagtgtgacttgaaccttgaccgacaaatcaaccatgatgaatttgtgaaattcattcaaaagcttacaaccgaccatt

SEQ ID NO: 1291 - DNA, 284 bp, Gossypium hirsutum
  unsure (1)..(284): unsure at all n locations
  Clone ID: uC-gsronu33B047c06b1
ctgttttttaggttcccgnnaaaaanaanaaccatagcagatatttttggaggtttatcttctttttctacacgctatataaatagcttctataaaaccagtacacactatggttttctctctgataaaccctaggtagggatactatcatgtgtagtgaacaaaatgatttttctagcacatttaaatggtgctgacgattcggaacttatattcaaaaagatgtgacgtggaaaaaaaaaaaaaagaatctaagaaaacaaatattgaacaaaaaaacataa

SEQ ID NO: 1292 - DNA, 536 bp, Gossypium hirsutum
  Clone ID: uC-gsronu33B047c08b1
cccacgcgtccgctgctagtgacttgcctcaattggatagcttggttcccattcttgttgttcgacactgactggatggggaaagagatttacggtggggaagccaagggagatgcacataaagttaagctttacggtgatggggttcgagctggtgcattagggttgatgattaactccatcgtcttggggttgacttcattggggttagagcctgcagggcggttgatcggtggggtcaagaacttgtgggctatcgtcaacttcatcttgtgtgcgtgcttggcgtctacggtgtttgatcacaaagatggctgaggcttggagacaacaccatgggtccccactctcccatcctccatttaacattacgggctctgccttggctgtattcggtgtcttgggtattccacttgcggtaacatacagtattccattcgctttggcatccatctactgttctagtactggtggtggtcaaggtctttctctaagagtgctaaacttgtctatagttatcccacagatgttcgtat

SEQ ID NO: 1293 - DNA, 539 bp, Gossypium hirsutum
  unsure (1)..(539): unsure at all n locations
  Clone ID: uC-gsronu33B047c09b1
ttatgctcttgtgaagcttcatgtggaagcaggggatgtggaaaaggctgactcaatcttgcagaaggcatgccagcaaaatgaaattaagcccatgtttactactttcatggttgtgatggagcagtatgctaggaagggtgatatccataacgccgaaaaaatgttacatagaatgagacaggccggatatgtagctcgagttagtcagttccaaactctagtcagagcgtatataaatgccaaagctccagcttatgggatcagggagagaatgaaagcagataacatattccctaataagtccttagctgctctgttgcctcaagttgatgcattcaggaggacttcagtgtctgatttgctcgactaaggatttcaatggttacttcaggtctccattttaatggcaacctctatttctatgcacagttcttatctgcttcatgtagtcaaatattggttgtctacttctagacattctgttctgttcaaacttcaaaccgtactaagcttttgagaaatatgntattaaattt

SEQ ID NO: 1294 - DNA, 325 bp, Gossypium hirsutum
  Clone ID: uC-gsronu33B047c10b1
taagtgccggaacgtggagttagaggcacgtgcggtgcaacttggcgcggaggtacaggtttggcaggcgaaagccaaggcacaagaggtgacggcggcttcgttacaagcgcagctccaacaggccataatgaacggaggagctggtttgacgcagcaagatagcaggagaggtggggaagaatggcggaagcgcgccggcggggaatcagaggcgcaggcggaggacgccgagtcagcttacgtggatccgggacgtgtcgtatcaactgcttatgacccatgttgcatagcgtgtaggacacgtgccgtggaaccttttgct

SEQ ID NO: 1295 - DNA, 268 bp, Gossypium hirsutum
  Clone ID: uC-gsronu33B047c12b1
ttcctctcgtccgctttgattgatggacccctggatatgggttggagtagtaaagttttaattacatgctatatttatgcttttaaagaaccagttcacattatggtttgaaattgatatacttaggagggatactattatgtttagtgatcagaatgatttttctagtacatttaaatggtattgacgatttggatcttatcttctaaatgatctgacgtggatcatggataaatgaatactatttatttaggcgttgatacaaaat

SEQ ID NO: 1296 - DNA, 511 bp, Gossypium hirsutum
  Clone ID: uC-gsronu33B047d03b1
gcgttactggcagtctgcatgaggaaactaggattctatccggaaattgtgggtttcattgaggaagagacggacaaggttccaacagttaaagctgaatatgttttcaatgatcctcccaagttgaccatgttggatgacgagggccaatataaggaaaccatatgaattgacaattggaaacgtgaacacacgctgctattcctgcagaagaaagtgcagccctattccgcaagctcatagacagtcattcacattcctgttatcgcttgataaagtaaaaccgaactcagcaagattgaactatttattcgtgttagccttgcgttttaaattatgtgcttgagcttactgattttctgtctctaaagagagaataattatgaataaaggagtatacagttgatcagatggtatcactataagccaagtgacataatttaagagctcgctcatgtatcatgcccattaagagaattctaagtgaattggattggctgtactttgatcg

SEQ ID NO: 1297 - DNA, 398 bp, Gossypium hirsutum
  Clone ID: uC-gsronu33B047d10b1
tgggttgggaagtgaactatggagcagaattcgtacccagcggtgaagatagctacacaataataatccagaagagcaagaaggtgggttgttcagagggagaagtagtgtgtgacaatttcaaggttggtgagcctggaaaggttgttctcaccatccataaccctacatccaagaagaagaaactcctctatcgcttgaagaccatgcccgcatctgcttagacccaaacactaagagattcacttttgctattttgcttgcctcttaaaaaaagagaacgtttctattattattattatttggaatttggaggttgttcattttatttaattatttttagatatagttatctggtttgtgtatattttatttatacctaataccgcttaaagatt

SEQ ID NO: 1298 - DNA, 179 bp, Gossypium hirsutum
  Clone ID: uC-gsronu33B047d11b1
tcaatttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggat

SEQ ID NO: 1299 - DNA, 230 bp, Gossypium hirsutum
  Clone ID: uC-gsronu33B047d12b1
tcctcgcgtccgattagtgggatggaccagtgaggatgtcactgtggatgaaggttctgaccacatgcaagataaagactgttagatagccattgcagactaggatctgaatgtgactaacttcggagaggaccaccctggtggagatgatgccatgattgttcccgcagagacggatgcaactgatgattctggagatgttgcccataaaagctgaggtcgagcatgga

SEQ ID NO: 1300 - DNA, 62 bp, Gossypium hirsutum
  Clone ID: uC-gsronu33B047e05b1
ccctcttttggggtcacgtacttgatgagtgaccatggcgtctcccacgggtataaccgcgc

SEQ ID NO: 1301 - DNA, 83 bp, Gossypium hirsutum
  Clone ID: uC-gsronu33B047e06b1
ccctcttttgggctaacgtaatgaatgagtgaccatcctttctaccacgatattaaccgtgctatattcatgatttttgaaaa

SEQ ID NO: 1302 - DNA, 452 bp, Gossypium hirsutum
  Clone ID: uC-gsronu33B047e10b1
tcctcgcgtccggctactttgaatttgataaaagaagacaaagtggtttttaaaatggctttactcatagcagtactgaccttagttttgctcgtgtctgcgtcgacttcaccagccattgctcttagcttgaatcattatgagaaaacctgtcctgatgttgagtcgatagttgcaaaagctgtcgagcgtgccaccatgaaggataagacggtccctgcagcccttcttcgaatgcattttcatgattgttttatagggggtctgtgatgctctctgtgctgttgtactcaaagggaaacaataaagctgaaaaagatgggcctgcaaatctttctttgcttggattttatgttatagaaaatgcaaagaaaaaagtcgaagcagcgtgtcctggtgtagtctcgtgtgctgatattttggcttttgccgcaagggatgctggtcgtgct

SEQ ID NO: 1303 - DNA, 192 bp, Gossypium hirsutum
  Clone ID: uC-gsronu33B047e11b1
ccctctcgtccgaccactcggacgtaaagaaaggacgactgattgggttttaaaacggcttcactcatagcagtactgatccttatttctgctagtgtatgcacttaaaattaccagactattgttttagtttgaatcattatgagaaaacctgtcctgattttgaatcacatagaaacaaatgttgtctag

SEQ ID NO: 1304 - DNA, 339 bp, Gossypium hirsutum
  Clone ID: uC-gsronu33B047e12b1
ttcctctcgtcccaacatccaaaaggagtccagcgtccatttggtggtccgccttctcggaagactgcaaatctttgttctgaccttgagcgaatagacaataactttggaaggtgagagatcagataccatagccaatggcaaggctaaaatccaggacaaggagggtattccgccagaccagcagaggttgatctttgctgggacgcaattagaagatggccgcaccctggctgactacaacatccaaaaggaatccaccctccatttggtgcttcgtcttcgtggaggtatgcaaatatgtgggatgacttttaccggaaagaccattactttgga

SEQ ID NO: 1305 - DNA, 508 bp, Gossypium hirsutum
  unsure (1)..(508): unsure at all n locations
  Clone ID: uC-gsronu33B047f03b1
gttctagatcgcgagcgcgccctttgttttttttttttttttttgttnggaagtataaacaccattttacttcataacatcaaactggtaaacttgttctctgttgacatcatttactagagttgtttgctgggattttaactgtgtggcctattgctataataacgaattgttgttgtgttgttgtcatggtcctactcttatagacctttcttcttgttataactcgcggagttgttctcgagatggagggatataccgacaaaaccggaatataccagattcgtgtatccgaggatcacttggatcagatctgtgatgcagttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaagttggctgtgctgagatgatgaagatgtatcgggaggatga

SEQ ID NO: 1306 - DNA, 265 bp, Gossypium hirsutum
  Clone ID: uC-gsronu33B047f05b1
cccatttttgggctaacgtactggatgagtgactagagagtctcccacgggtttacgcctgatctatccatcatgcttgcaacattgcctgcctcagatagatcacaaatgcaagatcttctcatatcctttcttccccacattgataacgccttgggaaaactctaccaccctttggttcaatggtttcgagcccaacaattaccatccgttgcgatttttatagatatagtgcatacttttttggactgctatacctctcctt

SEQ ID NO: 1307 - DNA, 501 bp, Gossypium hirsutum
  unsure (1)..(501): unsure at all n locations
  Clone ID: uC-gsronu33B047f08b1
gatgtatcaaggattgatcaggctcacccagtgggggtaacatctgtttcatgggctccatcaacagcacccggtgctcttgttggttcgggtttgctggaccctgttcagaaactttgttctggtgggtgtgataacactgtaaaggtgtggaaactctacaatggaatctggaagatggactgctttccggctctccaaatgcatactgattgggtacgggatgttgcttgggcacccaatttggggctaccaaaatcgaccattgcaagcgcttcccaggatgggaaagtaattatatggacagtggccaaggaaagggatcagtgggaaggtaaagtattgcatgatttcggtacccctgtgtgagggtgcncctggtcattgactggaaacatattggctgtggctgatgggacaacatgtgacgttgtggacagaagctgtagatggggaaggcaacaggtgactgttgttgagccataatcttctaattttttt

SEQ ID NO: 1308 - DNA, 229 bp, Gossypium hirsutum
  Clone ID: uC-gsronu33B047f12b1
ctctctcgtccgataagagggagggaccagagaggacgacactgaggatgaaggttctgaacacatccatgataaagactgttaaatagccattgaagacaaggattcggatgtgactaacttcgtagaggaccaccctggtggagatgacgccatgatagcttccacagataaggatgcaactgatgattctgaagatgtcggtcaaaaaagcagtgttcgagcaatg

SEQ ID NO: 1309 - DNA, 200 bp, Gossypium hirsutum
  unsure (1)..(200): unsure at all n locations
  Clone ID: uC-gsronu33B047g01b1
cggtttcgtgtgtagtngagcgagtaacctgccaggggtgactgttgtcatttcatgagaagggagatgacgcaatgcactgtgtgcaactgaaattaggaatgctgttggaggccagacatattattgttgtgagcacttcaccatcggacgtgctcccgaatgatgcctcaaaccaaatagaaactgctgggaaaacc

SEQ ID NO: 1310 - DNA, 143 bp, Gossypium hirsutum
  Clone ID: uC-gsronu33B047g02b1
cccacgcgttcgcttttgagaggctgtgtagaatgtgtaagcaagcagtttgactgatctttgactcttgaaaatttatgtacagcaaactgtgtttcatgttgttcttagctaattcaaatatggattaatgggtttgattt

SEQ ID NO: 1311 - DNA, 79 bp, Gossypium hirsutum
  Clone ID: uC-gsronu33B047g05b1
cccattcttgcgctgacgcactggatgagtgactatcgattctactacgagtataaccgcgctatagccatgattgttg

SEQ ID NO: 1312 - DNA, 377 bp, Gossypium hirsutum
  Clone ID: uC-gsronu33B047g06b1
gggctcacgtactggatgagtgaccacagattctaccacgagtataaccgtgctatattcatgattgttgaaacattacatgctatagaggtagccctgataggtagagctccttatagaagctgtaccaacagggctcaggcattggaaaagttctacacacggtaagattcagtggatcccacccacagaaggaccatactgacgtgatgtatgtaatatagtgcatacgttttgccctagaaacccgagccttgcatctgagaatcccaaatatctgatgcgatcctttcaatgttgctggaggttacttctggattagtacaccgagcttcctgttacccttttatatggaagcttttacgatgagtatgcaa

SEQ ID NO: 1313 - DNA, 121 bp, Gossypium hirsutum
  Clone ID: uC-gsronu33B047g10b1
tccttctttgctcgcctaagtgctctctgctctgcttttcttttctcacatgcctgacatctccccaagctaacactatctttgactaaatcactaataactccttctaaacttttcccca

SEQ ID NO: 1314 - DNA, 459 bp, Gossypium hirsutum
  Clone ID: uC-gsronu33B047h01b1
gtgaacagcaagagttgaaacgagggccctccaaattggaacgttggacaagccatgagaagagggattacaatatcaacagcaagtcatcaacttcctcgaagttaaaggagattgaaaatattaataatgtgggatcttcaggatcgtacaaaatctcggatgaatccagtaagtctattgaacctgctgagaatcatcattctgtgtcggacgataatggtgtttgtgagctagaaattagggatgctgatacaagaccatctgacactgttgagaagctgaagaaacgaagtgagaggtttaaacttccaatgcccatgaaaaagatacggttgcaataaaaaggatggagagcgaggcgatgccttcggccaagactgaaagaactcccttcgattcagatattaaacaggagaggccagcccgaataacgaaggtgggtcagcaactaatact

SEQ ID NO: 1315 - DNA, 332 bp, Gossypium hirsutum
  Clone ID: uC-gsronu33B047h02b1
cccattcgctcgtccacgcgtccgatttagaccagcgtaattatgtaacaggaggtgggcatcctaggactccattttaccaagcctttctaaaattggctaaatctatttggcttttgcatcggctggcttactcattcaaccctaacgtgaaagtctttcaagttaaaaggggaagtgaatactcagaggtttatatggaaagtgtagtgaagaatttgataatggatgaaaccaatgataagcctttggttgcgctaatggtcatgcctggcttttggattgtggctccgttattcagagccaagtttattttttccggtatgaaggat

SEQ ID NO: 1316 - DNA, 385 bp, Gossypium hirsutum
  Clone ID: uC-gsronu33B047h07b1
ttgatctcggagatgagacgcaggactctctcaaactggaacgttggacaagccatgagaagagggattacaatatcaacagcaagtcatcaactttctcgaagttaaaggagattgaaaatattaataatgtgggatcttcaggatcgtacaaaatcttggatgaatccagtaagtctattgaacctgctgagaatcatcattctgtgtcggacgataatggtgtttgtgagctagaaattaaggatgctgatacaagaccatttgacactgttgagaagctgaagaaacgaagtgagagggttaaactttcaatgcccatgaaaaagataccgttgcaataaaaaagatggagagcgaggcgatgccttttgccaagactgaa

SEQ ID NO: 1317 - DNA, 342 bp, Gossypium hirsutum
  Clone ID: uC-gsronu33B047h09b1
tcccattcgtccggaaaaaaatgcttcccattcctctgctagggtttcgaccttgctttagggagccacataggagggtcatcggtgcttcagcaccttcgcctctgacgcagatccatgaagcgaacacaggtaagccctttctctttcagtttttatttagaatccgtttgtaaaaaaaacgaaaagaaggaataaaggaaacgtgaatttgaaaagaaaatcccagaaaaagaatgaaaaacaaccttttaaaccttggatctgatttttttattgctattgattttttttattcagtatccataaaaactttgcaccgattctctggctttttatagc

SEQ ID NO: 1318 - DNA, 333 bp, Gossypium hirsutum
  Clone ID: uC-gsronu33B048a02b1
cttgaatatggaaatcctgaagctactttctgttcactgcaatgatcatttgaacatgaaggggccacatatttcgttttgacagtatctatacccagtatattcctttaagtgcaatgtcattagctcttgagttgatctcgtacgcatgttgttgatatccaggaaaacaagatgttagctttgtcgaatatcctgatcttatttccagtcattccagcattgattttgtttgctacaagatccttattactgtaatattgtagaacacacattgagggattttttttttctattttttgagaagtaatatttgaaactgttattcgtgtg

SEQ ID NO: 1319 - DNA, 425 bp, Gossypium hirsutum
  unsure (1)..(425): unsure at all n locations
  Clone ID: uC-gsronu33B048a03b1
ttgactgtccccggaggagctagtgtggcatgcagcacagctaaagctgttgagtgggacgctgcctggaaaaacaaccttgacccttcgggccgggctgccttgggggttcatctctctgcttatgacgcagagactcccctcagcaacaagccatccaaggttattgatagtataccacggatggactttcctggagtggccatacagagttaatgccggcctacttnaagacaacagaatgtatgaattatttaataaaatgagtaggagctgtggcatgtccaaatgtatgaagtatttaataaaatgagtaggagctgtggcatgtccatcaaacttccgaatacattgttgtataaataggtgatatttaccagtaccaagagaattctgggtcatcgtatcatttttcgttatcatca

SEQ ID NO: 1320 - DNA, 167 bp, Gossypium hirsutum
  Clone ID: uC-gsronu33B048a04b1
ggccaagagctcctttaagttggaacatcccctcgaaaggaggcaggctgaagctgctcggattagggaaaagtatccggacagaatcccggtgattgttgaaagggcggagaagactgatgtacctgagattgattagaaaaaatatctgattcctgctgatttta

SEQ ID NO: 1321 - DNA, 70 bp, Gossypium hirsutum
  Clone ID: uC-gsronu33B048a05b1
agcccattcgttcttccacgcgttcggagccaaattggctgttacactgttaagacttaaacaattccaa

SEQ ID NO: 1322 - DNA, 177 bp, Gossypium hirsutum
  Clone ID: uC-gsronu33B048a06b1
aatttctatttatataatacgcccacgccttcctcatctgcgccgcccccaattttctcccttactaacaacaaaaaccctgaaatgtcggacgacgattcataattttcgattccaagtgctgatgccggctcctccataacctattctcatcaagtctttactattcgttatatc

SEQ ID NO: 1323 - DNA, 146 bp, Gossypium hirsutum
  Clone ID: uC-gsronu33B048a07b1
tcggagtatgtacaacttgaacggccaattcagatggatatcatctcaaatgaacagaatccgaaatggtgaactttaccgatacatttgcgacacgaaaggtgcctttgtacagtctgcattgtatgaagcctttgcattgtctg

SEQ ID NO: 1324 - DNA, 148 bp, Gossypium hirsutum
  Clone ID: uC-gsronu33B048a08b1
gggtgccaagtatgcagccaaggtcatggttccggccaagaaaggttgcattctcttctcgtcgagtatttcttcaaaaatcagcatcggtctgccccatgcatacaaggcatcgaagcatggcgtcgtagggctgacaaacatcttg

SEQ ID NO: 1325 - DNA, 698 bp, Gossypium hirsutum
  Clone ID: uC-gsronu33B048a09b1
tcgccttctcgtgcgcccacgcgtccggagaaacataggtgtaagttttgtttaaaaagcttcataaatgtatgatttaatatttttttaattaatatttcatattttattatttatatatatctatttttttttttctttttggggcttaaaaggagttgggggagggtttatttctatttacatttctggttttgggggggggttaggaggggggttttgggggggccttttttttttttttttttctattattcatttattcttatttttttattatatttattatttttatttatatagagaggatattttttaaattattcatatttatatatacttttttattattttctttactttaatttttttcattatctaatttttatttctttttttatatttattttattttcaatttttttataattatatatttattatttatctttttaataaatttttattattttatttatattattataattatttttttattatactatttttatttattattttattttattatatattttcttaattattttattataactatttttattttttattatttttaattattatatttatctactttattatttatttctctattatattatttatacttttatataattctttattaattataatatattatattaatatttaattattatttatat

SEQ ID NO: 1326 - DNA, 129 bp, Gossypium hirsutum
  Clone ID: uC-gsronu33B048b02b1
cctatgcgttcttccacgcgtccgtttactacatattcgccagtgtctggggccacaggatctatactatatacagcatcttgtttattgaattcataattcttctgaatgacatagcttttataactt

SEQ ID NO: 1327 - DNA, 96 bp, Gossypium hirsutum
  Clone ID: uC-gsronu33B048b03b1
ggactattacttgcaagagattgagcacttaagaaacacagtaaaactacttcaggagaaggagaagaatctttaggcccatttgttctaatattt

SEQ ID NO: 1328 - DNA, 122 bp, Gossypium hirsutum
  Clone ID: uC-gsronu33B048b05b1
cgtccgatttaaatggaaaggcggcacgaatatgtggggtttttttttcacaaacccataaaatggtctaagttatggcggaggaagtgaagaagcaggctgaagctgaaacgacggcggtt

SEQ ID NO: 1329 - DNA, 407 bp, Gossypium hirsutum
  Clone ID: uC-gsronu33B048b06b1
accacgcgtccgcacatgcgaacggaatggaactccttatcattcaatgtttatgctgctgaccatgtctttcctaagggcattatggatgcgagatgcgggctcttgatcctgttcatgttgggtgctacttgggcatgtaacgcccgacaactagaaggtgttgaggtagtaatctcggatccatcagttgtccaggtaaactggaggcaagatgaaaaagtgatagaaacggtagctcggaatgacaacgtgtgcaccttgtgtgaggaatttactactgaggcagctgattacctttcacagaataaaacgcagactgagataaatgagattcttcacaaaagttgcttccgtttacgagcttttgagccccagtgcattacacttgtggactactatgcacc

SEQ ID NO: 1330 - DNA, 293 bp, Gossypium hirsutum
  Clone ID: uC-gsronu33B048b07b1
tcgccttctcgtccgatgaaccaccagaagatgaaccgccaatgatggagacaccttgcccaagaccatcgattattacacctcccaagaaagagaaacctgaacccaaaccacccgtatatgaaccttcaaagaaggagaagcccgagccaaagccaccggtttatacaccttcaaagaaagagaaaccttgaacccaaaccaccagtgtattgaacctgcaaaaaaaccttcaatgtacgaacctaagccactaaaacctccgttttatacacctccattgaaagagaaac

SEQ ID NO: 1331 - DNA, 477 bp, Gossypium hirsutum
  Clone ID: uC-gsronu33B048c01b1
ggtgccttgcctatctactggaactacaactatggggaaactggagaggctttgaaggtggacttgttgaaccacccagaatacttagaagacaacgcaaccttggctttccagacagcaatgtggaggtggatgacgccggtgaagaaacaccaaccctcagcccatgacgttttcgttggcaactggaaaccaaccaagaacgacaccttggccaagagggttccaggttttggaaccaccatgaatgttctttatggtgaccaagtttgtggtcaaggtgatagtgattccatgaacaatatgatctctcattacctttattaccttgaccttttggagagttggccgagaagaagctggtcctcatgatatgctcacctgtgaagaacaagaacccttcactggttctacttcatccgcaacatcatcatgaataaaggaaacaactctggtatatgcggatttatttcattt

SEQ ID NO: 1332 - DNA, 135 bp, Gossypium hirsutum
  Clone ID: uC-gsronu33B048c04b1
tcatcccttttcttgaacctcaacatgtttgctcttagttctgtattcaatggcttccaattctttgttcaaaacttttaaacacaatagaaagattatggggaagagtggttgacatttgttttcattatattt

SEQ ID NO: 1333 - DNA, 79 bp, Gossypium hirsutum
  Clone ID: uC-gsronu33B048c07b1
ttctcgacttcgcgaccgctaagatggatggaccgttggttatgggttggagtaggaaagtactcattacatgctatat

SEQ ID NO: 1334 - DNA, 86 bp, Gossypium hirsutum
  Clone ID: uC-gsronu33B048c08b1
tcgccctcgcgtccggtttctttagctcacaggttccattgtttttcagtagtaaagagcaaaaaacagaagggaaattaatggat

SEQ ID NO: 1335 - DNA, 607 bp, Gossypium hirsutum
  Clone ID: uC-gsronu33B048c09b1
tcggaatgtgtgcctttggttattcctgaagtgaattcagaagcattgggtggtatttatagcttttattattatatatttattattattataaataatattatatttttttattttataatttctattttattttatattatattttaattaattttttatttttattctttttattttgttaattttttttttatattttttaatattttttatttttttatatttttttattctattaatttattatttttattatttattattaaatatttaattttttataaatttatatttatattatccattttaatattatttttattttttttattaatttatattttaacattattttttttatatatatttatatttatattatattattattttttatttttttttttttcttttatttttatataatttatctattataatttaatattattatatactattattttataataatattttttttattttttacttttttattattatttaattaaatttatatttaattttatttatttattacttatattttatattattcattttattttatatcttatattatatttattattaatcttat

SEQ ID NO: 1336 - DNA, 82 bp, Gossypium hirsutum
  Clone ID: uC-gsronu33B048c12b1
tcgctctgacatacaagtatcagaagttgaaactccaataatgatcgatcaattttattgtgacaaaggccactgctcgaat

SEQ ID NO: 1337 - DNA, 146 bp, Gossypium hirsutum
  Clone ID: uC-gsronu33B048d01b1
ccctcgcgtctgtccacgcgtccgcagcttttggaacatactcagcactctccaagattgttgagaatttgagattttaaaagccctattccattccaatgttcttgtattacttaatttttctatttggctatcttaatttaatt

SEQ ID NO: 1338 - DNA, 470 bp, Gossypium hirsutum
  Clone ID: uC-gsronu33B048d03b1
cttgtacatcccctgttaattttactctcaaaaatggctagctcaagtgtgggaatggtctgtcttttgctagtctcgtgcatggttgtgccgagcttggccaaagattacactgttggtgacacctctggttggacaactggtgtagattatagcacatggactaaagataagaccttcaaagttggcgatagccttgttttcaattacccaacaagccacacagtggatgaagtaagttcaagtgactacagtacatgcacggtgggaaacgcaatcacaacagataacagtggagcgaccaccgttgctctcaagaccgccgggacacattacttcatttgtggtgtgggtgggtcactgtgcgaatggaatgaaactttcagtcaaagtggagtcaggttcatcggcagcaccatctaagtcgccgtctaagtcaccatcgtcttcttcgtcatcctcgcccgctt

SEQ ID NO: 1339 - DNA, 86 bp, Gossypium hirsutum
  Clone ID: uC-gsronu33B048d04b1
gaggtggaagttagcaccgcgccgcttcctgaaaaggttcaggttggagtgtcaaccctctatttctttttatactatttcattct

SEQ ID NO: 1340 - DNA, 192 bp, Gossypium hirsutum
  Clone ID: uC-gsronu33B048d06b1
ccctcgcgccttccacgcgtccgcccacgcgttcgtttttttttgcataaaacaagaaccaccatctttaaataagtcccaatatgatagttcataatattaattccacaagtgccacattaaaaatatatcactgagattattgcctcacattattaactaatcttgcttctttcaaacatcttactttta

SEQ ID NO: 1341 - DNA, 136 bp, Gossypium hirsutum
  Clone ID: uC-gsronu33B048d08b1
tcgcggtcgcgtgggcggacgcgtggggtccttccccttgatctccgagaatggtcggaccatgactagctcgactcgtttaggtgccgagcttgaccaattttttcccttttgactacttctttggttggacaac

SEQ ID NO: 1342 - DNA, 96 bp, Gossypium hirsutum
  Clone ID: uC-gsronu33B048d09b1
tcgccctctcgtccgctatctcccaaggtacatccttttacggaattgacattgttggaataagcttttgataaataattaatttattataatatt

SEQ ID NO: 1343 - DNA, 148 bp, Gossypium hirsutum
  Clone ID: uC-gsronu33B048d10b1
tcgggatgagggcatgggcatgatgaaccatattacctccatgctaagcatatgtacaacttggataggatgaaaaatcataagctgacatcgattcttcggttgtaaacccatattttatctggtcatccatttttattgcaagatg

SEQ ID NO: 1344 - DNA, 513 bp, Gossypium hirsutum
  Clone ID: uC-gsronu33B048e01b1
gctgctgtatatatgtatgtatatatgtgtatatataacacttgccttctattatgtgtatgggaaatttttccttaatcaatcaataagtcatttgtgttttgcatatgaaaagagcaagaggtgttttcggattgattatgatggtactatttttcaattggagtttcatgataatgagtccaataaatgttgattataaagggtcaaattttaccaaaagtctggatgacgcttgattcgttgtcaaatgcgatataatttcagtatcgtgttaacggatcttcgatctgcaagtaaggaaacaaaaaagagttaactggttttggtcctgaaatgatagaagataattagtgcatgagcttgacattatcatcatatgtatactggagatcatggctactaccttgaatgtatggttgattatagtgtgatgatttaaagtgatccgatgtcctatgttcatatctaatgtcttgtagggttagtatatatactttctttgttcaaggt

SEQ ID NO: 1345 - DNA, 94 bp, Gossypium hirsutum
  Clone ID: uC-gsronu33B048e03b1
cccactcgtcctgtttagccactctcaaacagtggtggtatgtgggaataaacagactgctaatataccaaatccattttcgtatttttccaaa

SEQ ID NO: 1346 - DNA, 583 bp, Gossypium hirsutum
  unsure (1)..(583): unsure at all n locations
  Clone ID: uC-gsronu33B048e05b1
gaaaagacggttctccatgattgtttggagactattgacgagaccctcgacgagctccacgaagctgttgaggatcttcatgagtaccccaacaagaaatctttgacccagcacgcggatgacctcaagaccctgatgagtgccgcaatgaccaaccaggaaacttgcttggacgggttttctcacgagggtgccgacaagaaaatccgtgaggtcctgatcgatggcgagaagtacgtcgaaaagatgtgcagtaatgcgcttgccatgatcaagaacatgacggacactgatattgcaaacgagatgatgctcaagtcatcgaacaggaagctgaaggaggacgaaagcggcattgcctggccagagtggttgtccgctggcgacaggcgcctgcttcagtcgtcttcggtgacccnaacgtggttgtggcggccgatggtagcgggaacttaaaacggtgtcggaagcggtcgccaagcaccggagaaagcagcnaaggtatatattagaataaagcaggcgtctactaaaaacgtggagtcccaagaagagagcacatatgtcatcgagacggagacta

SEQ ID NO: 1347 - DNA, 272 bp, Gossypium hirsutum
  Clone ID: uC-gsronu33B048e06b1
gcctcgcacttatcccttactgtgcattacggggaagagatgagctaccgattttacttacactgtgacaaacagcctcacttggagatgcatggttggcctaaacagatcggttcctattaagcccgtagtcttagttcgcattccttaattctttatcttgtttttttgttttccctaccatgcctgcttttagctctaatctggttttatcttctagcttgtcctctatatatacccacccttacaggggctccttgtttgttaatgtg

SEQ ID NO: 1348 - DNA, 174 bp, Gossypium hirsutum
  Clone ID: uC-gsronu33B048e07b1
ccgtattacaattcccacgtactctcattatatcttcttcagcagctccaaggtattaagaagctctcctattactaattcggcaaacaatttcattttgtagcattaagcaatggttcaaattgtttttttttccttttaatccattttctcctcctttctcctttccctctc

SEQ ID NO: 1349 - DNA, 300 bp, Gossypium hirsutum
  Clone ID: uC-gsronu33B048f01b1
cggacgcgtgggtgatgatggccatcgcatcgctcgtcgctgctgtttggaccaaattctaaattcatctccaccaccatgatgatccacccatgtattgatcacatcatctcacactctcttcctatcctcacttcctcctccttccctttctcccctccttttggttatttttttggttcaatttaataattgtttcacctcctaacgatagtatccctctcctccaacctttgcctgcctgtcctcattatcattgtctcgatctcttttggttggtacatcccctcctttcctttc

SEQ ID NO: 1350 - DNA, 450 bp, Gossypium hirsutum
  unsure (1)..(450): unsure at all n locations
  Clone ID: uC-gsronu33B048f03b1
gtttcttttagctcacaggttccattgtttttcagtagtaaagagcaaaaaacagaagggaaatcaatggaagggaaagaagaagatgttagattgggagctaacaagttctcagaaaggcagcctattgggacagcagctcagtcccaagatgataaggattacactgagccaccaccagcacccttgtttgagcctagtgagttgacctcatggtctttttaccgagctggaatcgctgagttcgttgctactttccttttcttgtatatctcggtattgactgtgatgggagtccttaaggacaaaaccaagtgtacaactgttgggattcaagggattgcttgggcttttggtgggatgatctttgctcttgtttactgcactgctgngattcangtggtcatataatccagcggtgacatttggctgttttgggaaggaaattgt

SEQ ID NO: 1351 - DNA, 51 bp, Gossypium hirsutum
  Clone ID: uC-gsronu33B048f08b1
tcggagtaatattctgtatataaaagagcaagatgattgtatagagagaaa

SEQ ID NO: 1352 - DNA, 84 bp, Gossypium hirsutum
  Clone ID: uC-gsronu33B048f11b1
ctatcggtagttttggagatgaacaactacatgaggtggaactttgacctgaagattcgtctactatgtatatatcaaaaagtt

SEQ ID NO: 1353 - DNA, 290 bp, Gossypium hirsutum
  Clone ID: uC-gsronu33B048g01b1
aacccaccttgcctgatccaccattccacctccggtgaccggccttccacgactccacctccgctctaacggtgcttccagcgaatctagccttcaacatcttctacctttgaatttcaaagaaacaagctattgaggcaaaaaaatagcaggcccagtcaggttgctatcacaaggctagcatagttaaataactagttttggtaattaattttatttggtactcaaaataagtaatttttaactacttttgtcttacttattaaattgagtatgaaatataatttgat

SEQ ID NO: 1354 - DNA, 55 bp, Gossypium hirsutum
  Clone ID: uC-gsronu33B048g04b1
aattaaaaattttaaaaaaaaaaaatataaaaaaacaaacacttcttacaatcct

SEQ ID NO: 1355 - DNA, 61 bp, Gossypium hirsutum
  Clone ID: uC-gsronu33B048g09b1
tcgccctcgcgtccgccggcgacggtagtactgtcgtcaaaatctaaacactactctacca

SEQ ID NO: 1356 - DNA, 135 bp, Gossypium hirsutum
  unsure (1)..(135): unsure at all n locations
  Clone ID: uC-gsronu33B048g11b1
cgttattctattctttatgttgngacaaattttcggcactggtgatagttacattgtacgtttacttgatattttttatattattttttttattttttaataatttatatcattattcttattttattctttttt

SEQ ID NO: 1357 - DNA, 57 bp, Gossypium hirsutum
  Clone ID: uC-gsronu33B048g12b1
tcgagatcgcgtgctctctgaatgacaaaccagcgaggatccatgtatctaatgaac

SEQ ID NO: 1358 - DNA, 107 bp, Gossypium hirsutum
  Clone ID: uC-gsronu33B048h01b1
aattttaaaaaaaaaaaaaaaaaaaaaacaaacaaaaaaaaacaataaacaaaaaataaaaaaagggctggccgttttataggagcctggcttcctttctcgggctt

SEQ ID NO: 1359 - DNA, 207 bp, Gossypium hirsutum
  Clone ID: uC-gsronu33B048h02b1
gcgatcagcttctagcttgcggggaaaactggtaggccatatgtctggagaaatgatagaggtgatgctatagcaagcttgagaaaagaatgggagggtgtgaagctgattggggaagtcatccgtggtttcattcttggaggcccacgtttacggcccctaccgttcaaggctatagttttttattaggggcccctaattaaagtg

SEQ ID NO: 1360 - DNA, 132 bp, Gossypium hirsutum
  Clone ID: uC-gsronu33B048h03b1
gcctcgcgtttgttaatactgaaaattgatagttactggatatacatattagatataaaaagagagggtaaaacaatgcttataataagcctatacttcagataatggaacttgacctataaaaaagggggg

SEQ ID NO: 1361 - DNA, 97 bp, Gossypium hirsutum
  Clone ID: uC-gsronu33B048h08b1
gcctttatttgtgacttggagtgaaaactgggatgccatatgtttggagaaaagatcgaggtgctgccatagccagcttgagaaaagattgggaggg

SEQ ID NO: 1362 - DNA, 64 bp, Gossypium hirsutum
  Clone ID: uC-gsronu33B048h12b1
tcgaattcctagcctttcttatgaagaaaccagcaaggtgacatgtgaataatgacccaaaaca

SEQ ID NO: 1363 - DNA, 454 bp, Gossypium hirsutum
  Clone ID: uC-gsronu33B049a03b1
atttttaggattatcaaaatcctcccttctcattttcttccatgaagccccactctcgctcgtaaaggtctaaattcctgggtgttgaagcctccaaattgttgatcaatggctgaatccttgggtccacgattgtacagctgctataattgtggaaatcatgtttctctccacgacgatatcatttccaagtcttttcagggaagaagtgggcgagcatttttgttttcgcatgcaatgaatataagagtaggagcaaaagcagacaggcatctaataacgggtctccacacagttgcggatatttactgtggtgattgcggtgagttgttaggttggaaatacaagcgagcctacgaggcgtcgcataagtacaaggaaggtaaaattatacttgagaaggccaaagattgcttcggagaattggttgtagcattcattcctctacaaatgg

SEQ ID NO: 1364 - DNA, 480 bp, Gossypium hirsutum
  unsure (1)..(480): unsure at all n locations
  Clone ID: uC-gsronu33B049a04b1
cccactcgtctttccacgcgtccgctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttggatgttttgaaggaggtntggtgtcctccctggcatcaaggtcgacaagggtcccgttgagcttaacggaaccaatggcgaaactttcacccagggtctagatggccttgcacagcgatg

SEQ ID NO: 1365 - DNA, 73 bp, Gossypium hirsutum
  unsure (1)..(73): unsure at all n locations
  Clone ID: uC-gsronu33B049a06b1
cgccacgcgtccggagattaaaaatcntttatctggaagccattttagttgcaaagaagtgatgcttattttc

SEQ ID NO: 1366 - DNA, 272 bp, Gossypium hirsutum
  Clone ID: uC-gsronu33B049a07b1
tcgcccatgcgtccgatttaatgcatttgtcctttgtcaaatctttaatgagttcaatgctcggaagccggaagaagtgaacattttccgtggacttagcaaaaactatctgttcatcggaatagtggcgataaccataatacttcaggctattatcgttgagtttcttgggaagtttgctaaaactgagaagcttagctggcagctgtggctggtatcgattggtatcggttttatcagttggccccttgctattcttgggaagttcatac

SEQ ID NO: 1367 - DNA, 62 bp, Gossypium hirsutum
  Clone ID: uC-gsronu33B049a08b1
tcggacttgcgtacagactgacacaccgaatgctaacagttcaattaatgactccatgcccc

SEQ ID NO: 1368 - DNA, 174 bp, Gossypium hirsutum
  Clone ID: uC-gsronu33B049a09b1
tctccctctcgtccgtaaaatattagtgttagtaggaggagaaacaaaaaaaaaagaatgtgtgtggttgtttcccccccattgccgtgagttgtagaaaagaaaactttgatctctttattttatttaatttttctttcttctaacattaatcaaattattattattattttt

SEQ ID NO: 1369 - DNA, 184 bp, Gossypium hirsutum
  Clone ID: uC-gsronu33B049a10b1
ggcattgcagagtagtagtggaggtgacccttcacttatgtattccaaaatccgtgatctgctccatgggtacaatatacatccgcgctgaaacagagtctcagccaaatgagcgccatggctatagagcaaattcctgactgtctgatgtgcgagttagaatatgttcgctttgatggacaat

SEQ ID NO: 1370 - DNA, 225 bp, Gossypium hirsutum
  Clone ID: uC-gsronu33B049b12b1
tcggtcttacctattgaatatggacacgtgctgttgattgctcgaatccttgaatgcttgccccagaggatcgaccgtgagagcttcttgcttgcactttatatgacagctgaagctgggaatccatatttcagattgggttataacagcttgggtgcatttgctacaattaaccaccttaacttccaggcttactacttggctgtgcccttttctctagagaaa

SEQ ID NO: 1371 - DNA, 208 bp, Gossypium hirsutum
  Clone ID: uC-gsronu33B049c02b1
atgttcaggaatatcaaaatcctcccttctcattttcttccatgaagccccactctcgctcgtaaaggtctaaattcctgggtgttgaagcctccaaattgttgatcaatggctgaatccttgggtccacgactgtacagctgctataattgtggaaatcatgtttctctccacgacgatatcaatttcaagtcttttcagggaagaa

SEQ ID NO: 1372 - DNA, 126 bp, Gossypium hirsutum
  Clone ID: uC-gsronu33B049c03b1
ggtttttccgttaactgcaaagaataattaatggtctttttgttttgcctctgttttcttctactcttgacattatatgatggaatgcatccattcacaataaaagaaactttctcggcatttatt

SEQ ID NO: 1373 - DNA, 408 bp, Gossypium hirsutum
  unsure (1)..(408): unsure at all n locations
  Clone ID: uC-gsronu33B049c04b1
ttcattgacctgtccttcatcttcaacaccaatctgaacatgaagaccaccttaccggtggcggaagcggcggtggatcagccgatgacttgatgaacacaggtcataatgaccttgttgctcgtagaccaaggggtcgtccacctggttccaaaaacaagcctaaaccaccagttattatcaccagagaaagtgcaaacgccctaagagctcacattcttgaaattggcaacggctgtgatgtattcgattgtatagccaactatgctcggagacgacanaggggtatctgtatattatcgggcagtggtacggtcaccaacgtcaccattagacaaccatcagcaactggttcttgtgtttacccttcatgggagattcgggattttatcactttccggttcggtt

SEQ ID NO: 1374 - DNA, 484 bp, Gossypium hirsutum
  Clone ID: uC-gsronu33B049d02b1
ggttttaaaaataccaataggaaaaagggagagagagagaaggtggtgactttacatatacctttgttatttatagtccactttcaagggcaagattcttgggctcctaacactataatatatccatttatttcaggctcagctttccattcattttttaaaggcaagaagaatatgatctagttcctataagatctgcaagtgggaaaatataacttaaaagcaagctccaatggatttggttcagttgcaaaggcagtttgttgactacaaaacctcactctatcatgaggttttctggatgaacaatttacccaacttcaagaacttcaagatgaacacaactcagattttgtggttgcaggtgggtgccttttttctttgaaagattctgaaagacttctcaatgaactgccttagagctctagagcaggcagacatttattaccaaaggattgatgcttatgttcaccagttgaaaggt

SEQ ID NO: 1375 - DNA, 89 bp, Gossypium hirsutum
  Clone ID: uC-gsronu33B049d07b1
ccctcgcacacgaacaaaaacacataaggtacattttccaatttaataaccccaaaactccaaactcacaaaaaataaaacatcttata

SEQ ID NO: 1376 - DNA, 141 bp, Gossypium hirsutum
  Clone ID: uC-gsronu33B049d12b1
ggcatacatctctgtctctaaaactacaacccacttcttcaccggcgacgtcatggacattccccagatccaagtccttgtcttccatgggagaatatgccggtagctccatcaggaaatggtgggactggggttggcctt

SEQ ID NO: 1377 - DNA, 449 bp, Gossypium hirsutum
  Clone ID: uC-gsronu33B049e01b1
cccatgcgttcttccacgcgtccgcttttatttgtcaatggcttcatctgtatcattgtacgaggttcttggtgtaccagtgagtgcaaacggtaatgaaatcaaggcagcttatagaagacttgcgaggacgtggcaccctgatgttgtgtctgtaaatcagaaagaaatgtctgctgatcggttcatgagaatccatgcagcgtattccacgttgtcggatcctaatcaacgtgcggattatgataggaatcttagacggtggaaccgtccctttacgactatggaagcaactgcgacggcggtgggttcctatgggttttctagttatggtggtaataggaattgggagaccgatcagtgctggtagttaattatatgtatttttttttaattattaatgtatttttcatgttcgtggtccataaaaatcaatctttttagaattt

SEQ ID NO: 1378 - DNA, 546 bp, Gossypium hirsutum
  Clone ID: uC-gsronu33B049e04b1
cggtttcgtgtgtaaacacaaaggcctatggtgtgaatgttgttgttgctgtgaacaaattctcaaccgacactgaagcagaaatgaatgctgttatgaatgcagctatggctgccggggcatttaatgctgtaatttgtactcaccatgctcatggtggtaaaggagcggtcgaccttggagttgcagttcaaagggcttgtgcgagtgggaatcagcaactcaaatacctgtatcctttggatattagcattaaagagaaaattgaggcaattgctaagtcatacggtgccagtggtgttgaatacaccgaacaggctgagaaacagatcgagatgtacaccaaacaagggttttcaggtttaccaatctgcatggcgaaaactcagtactcattttcgcacaatgctgctgagaagggagcaccaggtggatttatcttaccgataagggatgtgcgagccagcataggagccgggttcatttatcctttagtgggtacaatgagcacaatgccagggctaccaacaaggccatgcttttatg

SEQ ID NO: 1379 - DNA, 80 bp, Gossypium hirsutum
  Clone ID: uC-gsronu33B049e06b1
gcctttccttttaataagaactcgctagcaacctaggtcactgtacaagtgcatgggttatggcattctaaaagacggag

SEQ ID NO: 1380 - DNA, 92 bp, Gossypium hirsutum
  Clone ID: uC-gsronu33B049e07b1
tcggccacgcgttcgaacacgcactcgataacaacctagggcacggtacaaattcatgggttatgaaactctaaaagacggagagagcgaga

SEQ ID NO: 1381 - DNA, 251 bp, Gossypium hirsutum
  Clone ID: uC-gsronu33B049e08b1
tcgcccacgcgttcgaccacgcgtacgcccactcgttcgggcacgcgaccgctctatcggtctgttgagagtgcaaaatcaagggattgccggcggagaccactcgctcgctgagggccaaggaaggatggaagatgagagagagagagatacagaggagaatttgcttgaaagtttcaaactctgaccgtctcataggtagtcgccaatttagcatcttctgctctaggaacagtcctgtgatcttagga

SEQ ID NO: 1382 - DNA, 69 bp, Gossypium hirsutum
  Clone ID: uC-gsronu33B049e10b1
tgttcgattttataaaaaaaaaaaaaaaaaggacgaaacaaatagagagtaacagaaatgaaatacaca

SEQ ID NO: 1383 - DNA, 308 bp, Gossypium hirsutum
  Clone ID: uC-gsronu33B049e11b1
tcgtagttttaaaagcttagagaaaagaggcctaattcccccatcagccaggagtggaaggaaatagagagaatttgtttccaaggatgactgttcaaatttttcggtgaggcaaatgagaaggcttttcaccagatgccattgatgggagaccaagctggatccatcttcaatctttaaatgctttccttttgtttttatgatagttaaattcacatatagttgctttcccctcctttttatgaccaaacctcggtcttatgtgatgtaacaaaaacctggaaaagataatttaatgctgttttttt

SEQ ID NO: 1384 - DNA, 489 bp, Gossypium hirsutum
  Clone ID: uC-gsronu33B049f01b1
ccctcgcgtcctcccacgcgtccgcccacgcgtccgttttattctatctcagagtagatcactcccaaggttttctctctttcatctatctaagttgttgagtatggttttctgggtttttggttatggttcactggtctggaaccctgggtttgagtatgatgagaaagtcataggcttcatcaaggattacaggcgtgtttttgaccttgcatgcattgatcacagaggtacacctgaagatcctgcaaggacttgcaccttggagcacattgaaggagccgtttgttggggtgctgcttattgtgttcggggcagtcctgaaaaggaaagagcagcaatgctgtacttggagagaagggaatgtgaatatgatcagaagaccctcgtggacgtcttcaaggaaacagatcccctgcggcctgctctaagtggagatattgtgttcacatctactcctgacaaagtttcaaacaagtattacctggg

SEQ ID NO: 1385 - DNA, 412 bp, Gossypium hirsutum
  Clone ID: uC-gsronu33B049f04b1
gttttcctcaaggtgttccaccagagtgtaaacgcccaaggttctaaaatcaaacctctcctcctttccatgtaatatattctttttttcactactttcttactatgtattcaagttgcactcaacttgatgcttggggatggatggaataagttgctattattattattcttttttttatgtatttttatttcgttttgttgcttcttaaatcatcttgaaaatagatgtaaattccctgtttctgataataaaattttcctcttttttagtacttactgacaaacaaacaattgataaactgcagactagctagaacttaccatcctggaaaagagaataaagtttgagaggctatctggtactacaaaaggaccttaacaaaaagggggggcccttttaaaggacccaa

SEQ ID NO: 1386 - DNA, 79 bp, Gossypium hirsutum
  Clone ID: uC-gsronu33B049f05b1
cccattcgttcgaacacgaactcgatagctacctaggtcacggtactagttcatgggttagggaactctaaaagatgga

SEQ ID NO: 1387 - DNA, 158 bp, Gossypium hirsutum
  Clone ID: uC-gsronu33B049f07b1
tcggccacgcgttcgaacacgaactcgttagctaactaggtcacggtacttgttcatgggttatggaaatctaaaagacggagcgagcgagatcgaagccccttgcctgactgacgtactaaaacacatgtatgatgaatcttagaccgaagctgacc

SEQ ID NO: 1388 - DNA, 372 bp, Gossypium hirsutum
  Clone ID: uC-gsronu33B049f08b1
tcgccctttcgtccgaattataattctttagcatataatattatatcattataatttttcataagttatatatttctacaatattttagagattttttttttaacctctggccgtcctgtctggcggttttaggtttcccctcttttctttcccgtgctttcgcttttttttcttttttcttgggtcccctgaattgtcttccttttccctggtttttgccttgcttgcctgtgaaatctctggttttcttcgctttgtttccctttccctttttccccttttcctcagttgcgcttttgcctatggggcctcgccttttttgccttttccatcattttgattttttgattgccgtttggtttccccctttt

SEQ ID NO: 1389 - DNA, 589 bp, Gossypium hirsutum
  unsure (1)..(589): unsure at all n locations
  Clone ID: uC-gsronu33B049f10b1
cacctccattccaaccaaaaaagaacaagtcttctcaacctactccgacaaccaacctggagtgttgatccaagtctacgaaggtgaaagaacaaggaccagagacaacaacttgctcggtaaatttgagctctctggcatccctcctgctcctagaggtgtcccacagatcactgtctgctttgatatcgatgctaatggtatcttaaacgtctctgccgaagacaaaaccactggacaaaagaacaaaatcaccatcacaaacgacaagggccgactctccaaagaagaaattgaaaagatggttcaagaagcagagaaatacaaatccgaagatgaagaacataaaaagaaggtcgaggcaaagaatgcattggaaaactatgcatacaatatgaggaacacagttaaggacaaaggcaccaagttttctgctgaggacattatgcagagtgtcgattaaggttggctcttggtttcttatctgtctgatgtgcaactgttagactngatgntgttctttcttatgtaccaatagtcatacgatgagaatgtggatttgagactgatatgcttatgtgcatttttt

SEQ ID NO: 1390 - DNA, 758 bp, Gossypium hirsutum
  unsure (1)..(758): unsure at all n locations
  Clone ID: uC-gsronu33B049f11b1
cccacgcgtccgagttcgcttaccaacagttacatctcaagctccaaaaacctcaatctcaagccagcactagtaaggtacagaagctcattcctacctgctgtactggtactaatttctccccaacctcttttaagttcaatactaagatgatttcaaagataaaagaaatcaccagtagactgaatcgtttcaaacataaaagaaatcaccagtagactgaaatcgtttcaaacataaaagaaatcaccagtagactgaatcgtttcaaacacttgaagaagtagtttggggttgagtgagatcatgtctcaaggtgcaacttccaagggaaagaaactcaggctgcaaccaacttccttgatggatggagctgtggagtatgttggtagagccaatgagaagcaagaaatggttgagttgctcaaaattaacaactcagatggagtttgcgtcctttccatcgttggcatgggagggatggnnggaaaacagctcttgctcagcttgtttacaatgatcccagctatggatttaaattgcggtccgataccggaatggcggccactatatagtgggagcgggcgtcgtcgaaaccgtacagctgaaaatagcgtatgaaacgagcacaccgatgcggtgatcgtggcgcatttatggtacgaccatgcgtaaacaggcactatctgttattccgtatgaaataaaaaaaaatcactcttaacaaatcatgaatcatngacaaggatttcctactg

SEQ ID NO: 1391 - DNA, 92 bp, Gossypium hirsutum
  Clone ID: uC-gsronu33B049f12b1
tttcgagttttctctgagggaaattacgccgtgaacgtaaaccgggtcgttgtatggaaaatacggtgtcctatcagacttcaatgagaacc

SEQ ID NO: 1392 - DNA, 196 bp, Gossypium hirsutum
  Clone ID: uC-gsronu33B049g03b1
tgatgctcttttcgctgcaggcaacaccactgctgctatcggaaagggtttcgccattggttcagcagcactggtttcccttgctctctttggtgcctttgtgagccgagctgctatctcaactgtcgatgtattgacccctaaagtctttatcggtttgcttgttgtggcactgctttcttcttgtttctctgct

SEQ ID NO: 1393 - DNA, 63 bp, Gossypium hirsutum
  Clone ID: uC-gsronu33B049g05b1
gccatgcgttttaacaaaagcacgagagcaaactagggcactgtacggatccaagagttatgg

SEQ ID NO: 1394 - DNA, 64 bp, Gossypium hirsutum
  Clone ID: uC-gsronu33B049g06b1
cccattcgtattaacaaaaacacgctagcaaactagggcacagtacttattcatgagtcatggc

SEQ ID NO: 1395 - DNA, 484 bp, Gossypium hirsutum
  Clone ID: uC-gsronu33B049g10b1
tcgtattttaaaaaaaaaaaaaaaaaaaagggcggacagaataagagagttacaaagataacatacacatacatgcaacaaaatatatagggtctggcgttttcgaggttccaggcttttttcggcgtccttcgtcctttttactttttttttagtgtcccttaatttaatttatctggtctgttgtttttcaacttttcgtcgggttaaaccccttgtcttttcgtcactttattggtcttcgctctctttctccttttttttatccgcttgtcgtctttttctcttttggtcctctctctcgttcctctctttccatctctttttttttctttcttttcctcctcttttcgcctttctccttttttccgtattctttttcttctggttgtctttttttttttctttcattttcccttttctttactcctcttttttcctttttttccttctttctttcttttcttctttcttcctttcttct

SEQ ID NO: 1396 - DNA, 252 bp, Gossypium hirsutum
  Clone ID: uC-gsronu33B049h02b1
aatacaaggggccacagtgcacttgcagctccaaactgttggagggatgcacatatttgcgaagacacttactgggaagaccatcaccctggaagttgagagctctgacacaatcgataatgttaaggccaaaattcaagataaggaaggtatccctccagaccagcagaggctgatatttgctggaaagcagctagaggatgggaggacccttgcagattacaacatccagaatgggtccaccctccactt

SEQ ID NO: 1397 - DNA, 274 bp, Gossypium hirsutum
  Clone ID: uC-gsronu33B049h05b1
ctaatatccagttcatcgacacttaggaactgcctagtcgagttcacgcgattaggcttagatcaatgcaataccagaccaaagttgcataacaccgaagacatcaaacccgaaaatcccgattccccagaacaaccttcggtaagaagcaatgctaaagacagaataacaaacgaacccaaatctctccaaggtttacggatactcctagcggaagatacaccagttctccaaagagtagcaaccatcatgctcgaaaaaatgggagctgtag

SEQ ID NO: 1398 - DNA, 482 bp, Gossypium hirsutum
  Clone ID: uC-gsronu33B049h07b1
tcgaccttggctgactataacatccagaaggagtccaccctccacttggtgctccgtcttcgtggtggtatgcagatttttgtgaagacacttactgggaagaccatcaccctggaagttgagagctctgacacaatcgataatgttaaggccaaaattcaagataaggaaggtatccctccagaccagcagaggctgatatttgctggaaagcagctagaggatgggaggacccttgcagattacaacatccagaaggagtccaccctccacttggttctccgtctccgtggcgggatgcaaattttcgtgaagaccctgactggaaagaccatcaccctggaagttgagagctcagacacgattgataatgttaaggccaagatccaggataaggaaggaattcctccagaccagcagaggctgatttttgctgggaagcaactttgagatgggaagacccttgcagattacaacatcca

SEQ ID NO: 1399 - DNA, 354 bp, Gossypium hirsutum
  Clone ID: uC-gsronu33B049h09b1
tcgcccactcgtccgaaatctttcattattcctaaatattccaaacttctctcgaagagagtacccaagcggataggcaaaccagtttctcgattccagcaactaaattttcccagaaagtgagcaacaattacaacaggcaagtagttagcagcctaaacgatctttgagggggaactggaaaaggtttttaagtacccagaaagggaggagggaagcaattatgccatcaggttctaagaagagaaaagctgctaagaaaaataaggaacaagcagccaaaaatgaaaattcatcaactaataacaatccacatggaaatgatgacagtaaaagccaagatgaaggggacac

SEQ ID NO: 1400 - DNA, 305 bp, Gossypium hirsutum
  Clone ID: uC-gsronu33B049h11b1
attatctcctctttctctctattcgaaatttgaatactctctcattttacgatatttcttagtgtgttttggatcgggaggttagaggtttatcatcaatggcggatactgagacgttagcatttcaagctgagatcaatcagcttcttagcttgattattaacactttcttacagaacatggagatcttccttcgtgagctttatcagtaacgcctttgatgctttggataagatcaggttcgagagcttgacagacaagagctagcttgtagcacagcctgggctcttcattctattgttcca

SEQ ID NO: 1401 - DNA, 116 bp, Gossypium hirsutum
  Clone ID: uC-gsronu33B049h12b1
tcgaaattataatcttcaaagtctctctggtctttagaatcctaactcgcaagttactaagaagaaatggcaactgaacaaccaaagcctcaaaatgaagacataaatatggattt

SEQ ID NO: 1402 - DNA, 492 bp, Gossypium hirsutum
  Clone ID: uC-gsronu33B050a01b1
gttccaagctctgggttatggcttcccaggcgttttatcttcttgtttcaatcattgttctcttatccgccattgttgtctcaggttcgggttcggtcgggattaactacggtcgtgtagcaaacaacttaccgtcaccggaaaaagtcgtggaactattgaaatcacaaggaataaacaaagtgaagctttacgacaccgacgcgacggttttgacggcgttagcggattccggtataaccgtggtcgtcgcacttcctaatgaactactttcatccaccgctgctgatcagtcgtttgcagacaactgggttgaagcaaacataacaaagttttacccaaagacaaaaatcgaagccatagctgtcggtaacgaagtgtttgtcgatccggccaacacgaccaaatacctcgtaccggcgatggagaacatccacgcttcgttagttaaatccaagcttgattccgccattaaaatctcttcttcgatag

SEQ ID NO: 1403 - DNA, 513 bp, Gossypium hirsutum
  Clone ID: uC-gsronu33B050a02b1
ctcacgcgtccgaaaatatgtggatgtgattgtgactgggacaatgtcacagtacattcccacacttgattactacagcaatggcctccctctcgtctgcaccatgtatgcatccagtgaatgctattttggtgtcaaccttaaccctctttgcaagccaagtgaagtttcctacactctcgttcccacaatggcctactttgaattcttgcgggttcaaaggaacaatggcgtcactagttctatttctgtgcccaaaactctcaatgagaaagaacaacaagaattggttgaccttgttgatgttaaacttggccaagagtatgagcttgttgtcaccacttattcaggactttatcgttatagagttggtgatgtgctaagggtagcagggtttaaaaacaacgcaccgcaattcaatttcatatgcaggaaaaatgtagttttgtgcatcgattcagataagactgatgaggttgaacttcaaaatgctgtgaagaatgcagtgaacca

SEQ ID NO: 1404 - DNA, 463 bp, Gossypium hirsutum
  unsure (1)..(463): unsure at all n locations
  Clone ID: uC-gsronu33B050a06b1
ttcaaagttgccactgtgaaacccagaagagggaagttgcttgaggctgcatgccgaatgcttgtggctattggacaagattcacgtttcacctcttgccgactatgaacacaacaattacttcccccatatcataaacaaatcttcaaacaacaaaaaaaggtgaaccagcatagtataaagtcctggaatgatgttttgctctctgcattaggattttagttttctttttttcttctttccccttttttgttctatattctatcgttcataaggcagcaaaaaggtcaccctggttgattgctgatcctcaagtctacaagattttttctttcttttcttttctattctgtcaaattatgtgtgtaataatctggtgatagtggtggtggaggaaagaggtnnnattgctagggctcgtnaatgaatcgagcttgaacgaactgattcctgtttatgttcg

SEQ ID NO: 1405 - DNA, 459 bp, Gossypium hirsutum
  Clone ID: uC-gsronu33B050a09b1
ttcgccatgatcccaaacctaaggcccccgctgccgctgagaaacctcccaagttttacccggctgaggatgtcaagaagccgcttcttaacaagcgcaaacctaaacccaccaaactcagagcaagcattacaccagggactgtgttgattttgttggctggaaggtttatggggaagagagttgttttcttgaagcaacttacttctgggctccttttggtcaccggaccattcaagatcaacggtgttcctttaaggcgtgttaaccaatcctatgtcattgctacttccaccaaggttgacatctcaggggttaacgtagacaagtttgatgacaagtactttgccaaggaagtagagaagaggaagaagaagactgagggagagtttttcgaggctgaaaaagaggataagaaaaaactgcctgaagacaagaaagaagaccagaaagcagtcg

SEQ ID NO: 1406 - DNA, 514 bp, Gossypium hirsutum
  unsure (1)..(514): unsure at all n locations
  Clone ID: uC-gsronu33B050a12b1
tccacgcgtccgcccacgcgtccgcccacgcgtccggccaaagcaagtggagagctctgcttaaaatatatatttgcatttggagcatttaatcgggcacttttaaacagtgcatctgagtggaaagtgccaaccacttttatatatggggctgaagattggatgaactaccaaggagcccaagaagctcgcgagcaaatgaaggtcccatgtgaaattatcagggttcctcaggccgggcattttgtgtttcttgaaaatagagatggattccattcagctgtgttgtatgcctgtaggagatttctttcacctaaccctgataaagaaccctttcctgaagatttagtatcagcatagaagagcaaagtattttttaatttctttccacatgttgtatgacgcattacaccgagtttcattggtcagaagattatttgggtaaaagaaaaacattatttgcctgtagcttgtatcataatatttntatatacgtattatgtggttggcaagt

SEQ ID NO: 1407 - DNA, 491 bp, Gossypium hirsutum
  Clone ID: uC-gsronu33B050b01b1
ttcacgcgtccgcaatgacttcatatttacagccacaaaacttgggatgattgaagtttggttaaaagaaaggataagtagagttggtgccattaaaatgaacagcaaaggacatgcaaaggttacatctctggtttcagacatggatggtggaatgctttttgctgcttcctctgatggcaaaatccaggcttgggctctggactaaactgggtttctttttgtaaagaagaatgattagcaatcgatcaacaaaaaatcttacagcacgtttggttcgctgtattggattagaggtgtattggattagatgtgtaatggaatagaggtgtaatggaaaagctgtgtaatagcaaatcaactgtttggttgaatgtaatggaatagaggcgtaatagtaatcctgtgtttggttgaatgtaatagaggtgtaatagcataatgaaaaaactaaaatgactagaatacccttagcagaaatttgttttggt

SEQ ID NO: 1408 - DNA, 497 bp, Gossypium hirsutum
  unsure (1)..(497): unsure at all n locations
  Clone ID: uC-gsronu33B050b03b1
gtttggactttggagctttgatgtagcatgcaatagcttatgtggatgaagaaaagtactatggagcaaaggcaaccattaacgtttgggaacccaaaatacaacagcctaatgagttcagcttgtcccaaatctggatcttgggtggttcttttggtgaagatctcaatagcattgaagcaggctggcaggttagcccagatttatatggagacaaccacactagactcttcacttattggactagtgatgcatatcaagccactggttgctataatctactttgctcaggcttcattcaaatcaacaatgaaatagcaatgggtgcaagcatctaccctgtttctagctatcatgattcccaatatgatataagcttacttgtgtggaaggatcctaaggaggggaactggtggctacaatttggtaatagctatgtgtngggttactggccagctttcctattttcctacctatcagacagtgcctccatgatt

SEQ ID NO: 1409 - DNA, 451 bp, Gossypium hirsutum
  Clone ID: uC-gsronu33B050b04b1
ttctttttttccattctactttgttttagaagccatagcgactccttccaatacagcccacactgaggcaacaatatgtcttcactactctcacgctgctcatcctgttttccctcagttgttcaacaacactagaccgcacttcggcactggctccagcaccttctggagcgactgacgataccaagatcctcgaaaaagcctggcaatacaccctcttcgtacctcttctaaagtccactcaagaggccaaccagctgctcggtcagctcaacaatttcaacaatggtatgaccgattttgcaccaacggacaatgctttctccagccttaaatcgggcacattgaattcactcaccgatgaacaaaaagtggagctggtgccatttcacatcgttccaacataccctacctggtcttaagttcaaaccattagcaatcctttgagaac

SEQ ID NO: 1410 - DNA, 464 bp, Gossypium hirsutum
  Clone ID: uC-gsronu33B050b06b1
tctcacgcgtccgcccacgcgtccgctagatatgaaaatgttagttaaaccaggcaagctttctttacggcaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaagaaccaaatttaactaccctaagaaaagcaactgaaaagttttttattggggacacaaaaataaaattaagggacgagatttcaaaaccttgtggatggaaaaaacccggggtaacccaaattaaatcctttggaaaaaaacccctttttccaaaggggggaaaaaaaaaaaaggccccaaccaattcccttttaaaaaagtttgccatttttaaggggtaagggccccc

SEQ ID NO: 1411 - DNA, 342 bp, Gossypium hirsutum
  Clone ID: uC-gsronu33B050b07b1
gtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagggtggatcaaactgctcttgggatccatgcaactgttgaaaagcttgaaaaggcatagattatgaaaaaaagaaagcagcaaaaataacaggcctttgtaatgatatatt

SEQ ID NO: 1412 - DNA, 508 bp, Gossypium hirsutum
  Clone ID: uC-gsronu33B050b08b1
tcataatacagatgtcgatgataaagttgcatcatggtgggactatggttaccaaaccaccgccatggctaatcgcactgttattgttgacaataatacctggaacaatactcatatcgcaactgttggtactgccatgtcttctcctgaaagggcagcttgggaaattttccactccttggatgtcaaatatgttctcgtagtctttggaggcctcattggttaccccagtgatgatattaataagttcctgtggatggttcgaatcggaggtggtgtctttcctcatatcaaggaaccagattatcttagagacggacaatatcgaattgactcccaggccactccaaccatgctaaattgtctaatgtataaactctcatattacaggtttgttgaaaccgatgggaaagcctatgatagagttaggcggacagagatcggaaagaaatattttaaactcactcattttgaggaggtattcacaacacatcattggatggttcgg

SEQ ID NO: 1413 - DNA, 504 bp, Gossypium hirsutum
  Clone ID: uC-gsronu33B050b09b1
ctttgctttgcctgttgaaggcactgagactagggttaacgctcaggcggatgcctatgagtatatggtcgattattcccagaccaacaagcaggctgggcgattggaaaatgttgttggatggtaccattcacatcccgggtatggatgctggctgtccggtattgatgtttcaacccaaatgcttaaccagcagttccaggagcccttcctggcggttgtaattgacccaacaaggactgtttccgctggaaaagttgagattggagctttcaggacataccctgaaggatataagcctcctgatgaccctatctctgaatatcagaccattcctctgaataagattgaagactttggtgtgcattgtaaacagtattatgcattggacatcacttatttcaaatcctcacttgattgtcacctcctggatctgttatggaataagtactgggtaaacaccctttcttcttcacctctcttgggtaatggagattatgttgc

SEQ ID NO: 1414 - DNA, 511 bp, Gossypium hirsutum
  Clone ID: uC-gsronu33B050b10b1
ggaaaagatgctgttgaatcttcacaagaagaagtggacagatggactgacacttagacgtttcgatactcattccaaaactaatgagcagactattcaggaaatgctgaatttagctataaaatacaataaggcagtgcaggaggaaggtgaattacctcctgagaagctggcgatcgcaaatgtcggccggcaagatgccaagaagcacttagaggaacatgtctcgaacttgatgtcgtcaaacatagttcagacattgggaactatgctcgacacggtggtgttctaaaactcttttagcacctgtatactcttttttcatattcaggaactatcatagcttgttggtcaaaaaactgccattgtattgtcaaatttgaaagggactgtcatgttgtctcattaatctctctgttatcccctctttgatgtgtaagtgggattgtgaagatggttaacttttggtacttgccttctgtagttttctgagattcttcatattgcgatt

SEQ ID NO: 1415 - DNA, 520 bp, Gossypium hirsutum
  Clone ID: uC-gsronu33B050b11b1
gtatcctggtgctagatactacggaggaaacgaatacattgacatggctgagtccttgtgtcaaacgcgtgcactagaggcttttgggttggatcctgcaaagtggggagtcaatgtgcagtcactttccggatctcctgctaactttcaggtttatactgcattgttgaaacctcatgagcgaattatggcactagatttaccccatggtggacatctttcacatggttatcagactgacactaagaagatatctgctgtgtcaatattctttgagacaatgccatatagattgaacgagagtacaggttatattgattatgatcagctagaaaaaagtgcagtgcttttcagaccaaaacttatagttgctggtgccagtgcttatgctcgcctttatgactatgctcgtatacgcaaggtctgtgataagcagaaagcaattatgttggctgacatggcacatattaagcggttggttgctgcaggtgttattccatcttcttttgaatatgctgat

SEQ ID NO: 1416 - DNA, 332 bp, Gossypium hirsutum
  Clone ID: uC-gsronu33B050b12b1
atttgtaacgccctaaaaataggtctactagttttgagtaagtttatcgggttccgggtgaaagctaggagttaatcgggtgcactagctaattttttaaaaaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagatttataaaaaaaaaaaaaggggggggcccttttaaaggaccaaagtttacttccgggggaatgaaaaaaaaaattttttttaaggggcccccaaaataaaataaacgggccgggtttaaaa

SEQ ID NO: 1417 - DNA, 507 bp, Gossypium hirsutum
  Clone ID: uC-gsronu33B050c01b1
gcttggttcatcagagtcaaccaagtatctgttcttgcagtatgcagatcagataatggggcttttcctaagtgtttttgcttgtaggagtgcgactgtgcacgaggaggccatgcttgcaatcggagcccttgcttatgctactgggccagattttgcaaagtacatgcctgagttctataggtacttggaaatgggtcttcagaatttcgaagagtaccaagtctgtgctgtcacagttggtgtcgtgggtgatatttgcagggcattagaggaaaaagttgttccttactgtgatgggatcatgacacaacttctcaagaatttatcaagcaatcagttgcatcgttctgtgaagcctcccatattttcatgctttggtgacattgcattggcagtaggagagtatttcgaaaagtacttgatgtgggctatgtctgcccttcagagtgctgcagagttgtctacccatacaacaggtgatgatgaattgattgagtacataaa

SEQ ID NO: 1418 - DNA, 526 bp, Gossypium hirsutum
  unsure (1)..(526): unsure at all n locations
  Clone ID: uC-gsronu33B050c04b1
gtcggttttctacaaagaccaatcaggctccgcagctgtgatgaccattaattctggcataaggaagatccttccagagtctgggatatgtgattttgagtttgaaccctgtggttactcgatgaatgcgattgaaggtgctgcaatttctactattcatgttaccccagaagatgggtttagctatgcaagctttgaagctgtgggatatgatctgaaagaaaagaatctgaagcagttggtcgggagggtgttgcaatgcttcaaaccgggtgacttttctgtagcagttcacgttgatgttggtggtgatcagtcacttgagcagagctgcctgctggatgtaaaaggataccgttgcggagagatgggcattgaagggcttggaaatggaggttccatgatgtaccagaaatttagcagcactggtggctgtggatcaccaagatcaactttgaaatgctgctggaaagaggaagaagagggagaagagtagttgaaaatatcntttatggtttatgttttt

SEQ ID NO: 1419 - DNA, 501 bp, Gossypium hirsutum
  unsure (1)..(501): unsure at all n locations
  Clone ID: uC-gsronu33B050c08b1
cttaggcgtagctctcgatccacatcataaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttcttttatgnngtggtttcgattggtatcttatagtcgtgtaatatcaca

SEQ ID NO: 1420 - DNA, 512 bp, Gossypium hirsutum
  Clone ID: uC-gsronu33B050c10b1
cccacgcgtccgagaaaaatagcgatgaaactgagcctgataatgcaaagagtgaaagtgagaatattaagcagtctgaaagtaagaaggatgagccagtttctgatgctgttgctgataaggaaagtgctgagcataagagcagtgttgctgtaaatgaagaaactcaaaaggaggccaatgatgaaaaactggcgggagttgaggccaaggatgaagataagaaaggtgacgagactgcaaatgctgataacaaagataagagtagtgaaaatgccgattcaactgcagaaggtgcatcattgagttcattccaacagctttcaagtagccagaatgccttcacaggactcgctggcactggattttctacttcttcattctcctttggatctgcaacaaaggatggtcctacaggtgcttttggttttggtctttcaacaaatggaaattcatccctcttaacacatcagggacttcaattgtttctaagagtgagggaagtggttttc

SEQ ID NO: 1421 - DNA, 488 bp, Gossypium hirsutum
  Clone ID: uC-gsronu33B050d01b1
gtcctgtttgtctattagggactgaattccggaaaaaggtctgctgggaaattttggtggcgggttctgaacaaggtattgaggctggacaagttggacttagattgattactaagggtgacagacagacaactgttgcaaaggagtggagcatcagtgcgacaagtattgctgatggaaggtggcatactgtgacaatgactattgatgctgatataggggaggcaacttgttatttagatggtggttttgatggctatcaaactagcttacctttgtttgtgggtactagcatttgggaacaagggactgaggtttgggttggtgttaggcctcctattgatatggatgcatttgggaggtctgacagtgaaggagcagagtctaagatgcatataatggatgttttcctctggggaaggtgcttaaatgaagatgaggttgcttctcttatacttctatttgctcaactgagtttacttgattga

SEQ ID NO: 1422 - DNA, 483 bp, Gossypium hirsutum
  unsure (1)..(483): unsure at all n locations
  Clone ID: uC-gsronu33B050d03b1
tntatttttatgccgactcgagtcgtgtcgcgtgggggggtgttaaatgtttgttggtttcgggttctgatttcggttggagaaaatatttagtactcacaaaattaactacatttaccgcaatttcagcatttcgtcgttaatcctattttcttgtccgatcccatcccatccacactcttcgctctctttcctttaatctgttttcattgntctggcatttgcaaattgaatttttggttcttgaattctaggtttagggttttgagagatggggcaacagacgttgatctacagnttttgtggtttggggtacggtgatcctcgctgagtataccgagttcaccggtaacttcacaagcattgccggtcaatgtcttcagaagcttcctacttgcaaaagcaaatttacctacaattgcgatgggcacacctttattacctcggtgagaatggtttcagtatgaatggcttttttttttc

SEQ ID NO: 1423 - DNA, 420 bp, Gossypium hirsutum
  Clone ID: uC-gsronu33B050d04b1
tccactcgtacggcaggaccgccgcacatagggagtaactcgacataactcacttctttagaaactagcaatcgaaaacgacggcgtatgctgcaatgacaccgaccaggcctggattggaggaattcgaacagcagattcacaaaatcaggatcactctctgctccatgagtgtgaatatcctcaagaaagtttgcgcttacttgcttcgggtggccaaggctaagagactgcgggttaaaggaccagagagaatgcccaccatggttcttcacatgaccacacggacagtttatctgaggggaacgaactaacacatgggatccgattgaactccgtgaacacaagacgaggatagacctgttcagttctctcgacgagactgacaaattacttgcatcaccatacgaacccgagttg

SEQ ID NO: 1424 - DNA, 238 bp, Gossypium hirsutum
  Clone ID: uC-gsronu33B050d05b1
tccacttgtacgacatgatttcctcagatacggagggaggcgatataactactttctttgggcaatagccattgatatacgctgaagaaacgacgacgacaccgtctggagctgtgctgccttgggatgaacaggattttggcaacttcaggatgttccactgatagatgctagtgtatatcgttgcaaggagggccgctcttagagactggagatgtactaacctgataagaatcgg

SEQ ID NO: 1425 - DNA, 94 bp, Gossypium hirsutum
  Clone ID: uC-gsronu33B050d06b1
ttcacttgtacgacatgatttccgcggacacggagggggtcgatataactcctttcttagggcagtagccattgcaatatgctgaagaaaggac

SEQ ID NO: 1426 - DNA, 496 bp, Gossypium hirsutum
  unsure (1)..(496): unsure at all n locations
  Clone ID: uC-gsronu33B050d08b1
tccagatgtcccagattaaccctaaatccacccatctctgttagctagttcctttcttcggccggtggcccaaatcctctgcgtttcgaatcacagttatactcaaaggacaagccaagcccccgaaacaatgccattcaaaacaatgatagaggttgaaccaccgagtccgttaagatatatcatcggagcagcggtcatgatgatcggagttgtattgcccgtcggatacatgatgttccgtaacaaacgcgtcccttcctcttcttcttattccaaacagacgaacaaagttttaatatagagattttggtggaagagagacttgtctttccgcgaaattggtgatttaaatttgaagaaagatgagggaagcattgaaagaaggccttgaatggcctgcagatacaaaaaatgtaaatgaattataaaacccctcgttctagtttgtgatagntgtgtgggtattaattgaattctataaaagatgaaatct

SEQ ID NO: 1427 - DNA, 519 bp, Gossypium hirsutum
  Clone ID: uC-gsronu33B050d10b1
ttcatcatgaaccacccagggcagattggaaatggatatgcgcctgtccttgattgccacacgtcccacattgcggtcaagtttgcagagttggtgaccaagattgacaggcgttctggtaaggagcttgagaaggaacccaagttcttgaagaatggtgatgcaggatttgttaagatgattcccaccaaacccatggttgtggaaaccttctctgagtatcccccactgggtcgttttgctgtgagggacatgaggcagactgttgctgtcggcgttatcaagagcgtggagaagaaagatccaactggagccaaggtgaccaagtctgctgccaagaagggtgggaagtgaaccgtgcgggtttcagttgatccaaccgaactatatcatggctactacaataaaacattgcttcttattagtaggtcagccatcattggaggattagttgtgtgttttgatggtcatagttttaagtcatcaccgtcttgtagaggatgttgttcacagaactgg

SEQ ID NO: 1428 - DNA, 495 bp, Gossypium hirsutum
  Clone ID: uC-gsronu33B050d11b1
gtcgatgctgttactcaacttggtggccctgacaaagcaaccccaaagactattatgagaacaatgggagtaaaaggccttaccctctatcacttaaaatcacaccttcagaaataccggctggggaaacaatcttgcaaggaatcaactgataattctaaggatgcttcttgtgttgcagagagtctggacactggttcgtctacaacatcatcatcgaaactggtagcgcaagatttgaatgatggttaccaggttactgaagctcttagagtacagatggaagtgcaacgaagactacatgaacaattagaggtacagcgtcatcttcaacttcggattgaagcacaaagcaaatacctacagacgatactcgagaaagcctgtaaagctttgagcgatcatgtggctgcttctgctggtctcgaagctgccagagaagagctttccaaactgggaatcaaaatttctaacgattgtcaagggatggtccct

SEQ ID NO: 1429 - DNA, 489 bp, Gossypium hirsutum
  Clone ID: uC-gsronu33B050e01b1
gtcatgagcaacaagtatgctgccatgagagaacaaagtcgacaaatatcaaatccaaaaccggtggagaataacataacctctgctaaggtctcattgcttgaagtaggcaattcgcatcttgataacctcaagggtgggccatctgctggactggcctcaacatggcgatcaatgaaatctggttttcaaaattttaaagcaaatattgaggccagaaagtttcttcctgtgcaccagaatcaggaagccacactcatttcctatgtcaactcatccgattctgagtcccttgatgagatattccagagattgaaacgagcgtcagtagaccacagtgacgagaatgaaaatgagaacgacacagaaaccaagtctacaagatgatatcaaattcattcggaaaaaaatgtgcctgttgctgtcgtggaaacttggatacgaaatgtacagagctcattgaatttttacagtcctgtatgaaagatg

SEQ ID NO: 1430 - DNA, 501 bp, Gossypium hirsutum
  Clone ID: uC-gsronu33B050e03b1
tccacgcgtccgcccacgcgtccgcccacgcgtccgctgaagagctaaatgcgttgctttactcggatgatgatagttattatactgatgatgaagttacaagcgcagttcattctccttgtacaatgacagctcaccccgagcaattggagggaggaggaactgaaagtgttgctagctctattggaccaactaaaaagcgaaaactgctcgatgacggtaatgattacctgccgttgcttacagacgctgctagttcagtaaatcctagcagatgttctgagtatgtggatgatgcagattctagctgtgccaatatggaatcctcttcaagtaataagagactgagaatcgaaaaaattcatgagaccgtgagtgttctacgaagcttaattccaagtggggaaggcaaagatgcaatcatggttcttgatgaagctattgattacttgaaatcccttaaactcaaagccaaaaccttgggacttaatgctctatgat

SEQ ID NO: 1431 - DNA, 105 bp, Gossypium hirsutum
  Clone ID: uC-gsronu33B050e12b1
ttgacgcgtgggcggacgcgtgggcggacgcgtgggtaaaattgccaccacatttggtgacagatcaaatatcctccacacttaagtttttgcttgtccttaagc

SEQ ID NO: 1432 - DNA, 493 bp, Gossypium hirsutum
  Clone ID: uC-gsronu33B050f02b1
acgtccacgcgtccgcccacgcgtccggctggtttggcttaaatcagtccaagtatcagtgggcactggacgattattacgagagcaagggattggaaaaggaaggtgtaaaagtgaaagaaatatcaagcaaaatgcaaagtgtgtagcatgctttttgtgctggtaatgagatatttgaagtccctcttctcttcctctgtttctgtttcccccttctaatgttattattatgtatctaatgagaatgttttaatcacggtgcatattgttattctgctgaacttgcaccgagaattggtggttgtgtatcatttttgtattatatctatatatactttacgtatggaaaggccaaaagacatttggattcctgaagcgatctttgttggcatctttggactgctgatcagagcagctaactgagcttgtttgtataccaatgtaggagtcatgttgtgtccttacaatttcaatttctagcgttgagatc

SEQ ID NO: 1433 - DNA, 265 bp, Gossypium hirsutum
  Clone ID: uC-gsronu33B050f03b1
tttttatcaaggtcaaattgcagttttagtccctaaattttggttaaatttgaaatttaatttttatactttaatttggcataatttgatggttatctcacgattttggcttctaaattatacatgttttctgatttcggtacttcaatttttttttgtctgactttattactttgaagtattgttttcgctaagtactaaaataggaaaacaaatacagttcagaggtgaaatcatgaataaaaccttcgctcatcccaacaac

SEQ ID NO: 1434 - DNA, 520 bp, Gossypium hirsutum
  Clone ID: uC-gsronu33B050f04b1
gtcaagcaacatcacgtttctgatattgctactgttctgagtcgagcttggaacgctggcgtcgatcgaattatcgttacgggtggttcccttgaggagtcaaaggaagctcttgctattgcagaaactgatgggaggcttttctgcacagttggagtgcacccaactagatgcaaggagtttgaagagagtggggatcctgaaaaacattttcaaggacttttggcattggctaaggagggaattcaaaaagggaaggtggttgcaattggtgaatgtggattggattatgacaggcttcacttttgcccaccagaagttcaaaagaagtattttgagaagcagtttgaattagcatatgccacaaagctgcctatgtttctgcatatgcgtgcagctgcagaagatttctgtgaaattatggaacgaaatattaacaagttcactggtggggttactcattcatttactggtagtgctgaagaccgtgataagcttctctcatttcataacatgtata

SEQ ID NO: 1435 - DNA, 505 bp, Gossypium hirsutum
  unsure (1)..(505): unsure at all n locations
  Clone ID: uC-gsronu33B050f06b1
agttggtgaaagaattctctctttcttcaactgatctgttccattcacctgctggttttgtccagttgtctcttgcatatgctggattatctcctgaagtaatggctattcctgctatgcctagagatgtggctgctgatgaaactgtgaaggattcggaaacaagtgagtgtgagttggaaaagattgagttcccggatcccataatcgcgaatgagaaccagatgatggtttccgagtatatcgggatccaatgttctaatttggactctgaaagttccgaaagtttgggcacctctgatgctgagagtcaaattagttcagacatgggcgctcgtttaatggagagcttctctactgctacagtcaatttcatccaagcccccaagctcgattctcctccgagcagcgtgtcaaccaacggngtttcatctccttcagctggtccaagctctgagtccttcgatggtctggctgcttcgaaaacttctactcaggaacacat

SEQ ID NO: 1436 - DNA, 381 bp, Gossypium hirsutum
  Clone ID: uC-gsronu33B050f07b1
ttcaagtgtacgacttactatccgcggacatgaaggaaggcaaaataaatacaaaggacgtgcagtatcctttcataaatgccgaatacatgacttcttcaagctatcgagcgctcatgctgtacgatgatcaatcatgtgctcactaaatgcgagaccatggggagacgatgtcttctacgatctatggggcacgagacttggatacaagagttgatgagccatgttttggaacggtttataatgattcatgcgtcgcttgaattactgctgcgttcaacaggagaacgggagactcgaaatggatttcactgattggtgaacagatcatcaatgtgttgccatagtgaacgtgagcaggaaactgttgctacggttgag

SEQ ID NO: 1437 - DNA, 502 bp, Gossypium hirsutum
  unsure (1)..(502): unsure at all n locations
  Clone ID: uC-gsronu33B050f08b1
cttttctttttctctcccacaagttgcagttgcagagcttcgccattgttgtcttccttcaagctttttcagtttcttattcactcttcttcaacacccttttgatttttgctcttcaaccatggctgctttagtgcttccgctgctcatcctggctgccattactggccgctcaagtggcaactggtgtatatgcaaagatggtgtaagtgatacagtattgcagaagacactggactatgcatgtggtgcaggcgccgactgtaaccctatccacttgaagggatcctgttttaaccccgacactgttaaggctcattgcagttacgccgttaacagttacttccaaagaaaaggccaagctcaaggctcttgtgattnttccggcactgccaccgttactaccgctgaccccagctatactggttgtgctttcccatctagtgccagtaccgnaggcaccaccacaacaccaacaactacaccgtcatncaccacaccc

SEQ ID NO: 1438 - DNA, 506 bp, Gossypium hirsutum
  Clone ID: uC-gsronu33B050f10b1
tccacgcgtccgatttcttctcttctttgaactcaaagtcccaactaatattagaatcatgggtgttgtcacttatgactatgagaatacctccccagtcgcccctgccaggcttttcaaggcctttactgttgaagctccgaaagtttggcccacggctgcacctaatgcagtcaagagtattgaggttgaagctaatcctagctctggaagtatcgtaaaaatcaactttgttgaaggccttccattccaatatatgaagcaccagataggaggacatgatgaaaataatttttcatacagttacgatttaatcgaaggtgggcctttgggggacaaacttgaaaaaataagctatgagaacaagtttgaggcagctgcaggtggaggaagtatttgcaagagctcaatgaaattctacactgttggcgacaatgtaatcactgaagatgaaatcaaggctctcattagggaagtgagggagtttacaaagcctgtgaagctta

SEQ ID NO: 1439 - DNA, 507 bp, Gossypium hirsutum
  Clone ID: uC-gsronu33B050f11b1
aaagcttgcagttgcagaagatttcttcttttcaggcctaaacaggccggggaacacatcaaatccagttggatcaaatgtcactatgatcaatgtagatataataccaggacttaacactctaggtatatctctggttcgaatcgactatgcaccttatggtgtcaaccctcctcacactcaccctcggggatccgagatcctgcttgttgtcgaaggcacactttatgtcggcttcgttacggcgaacccagacaaccgtctcttcactaaaatcctaaaccctggagatgtttttgttttcccctttggtatggttcatttccagttcaacataggaaaaactgcggcggttgcctttgctggtctcagcagccaaaatgctggggttatcaccatagctaacgcagtgtttggctcaaacccaccgatcaacccagattttttggccaaggcgttccagttgaacaagaatgtggttaagtatcttcagtctcggttctaatg

SEQ ID NO: 1440 - DNA, 513 bp, Gossypium hirsutum
  Clone ID: uC-gsronu33B050g02b1
ttcctatcttcgtcgctctacaagcttcacatctgcacccttgattctcaatcagacggctgtgacagctccaccccatcacggcggtcgtgatgtccgagaaaaacaaaaggtagtaatgcaaatggaacaagctccaccgaagccaaagccgacggaaattcacgacgtggtctttggaatcgcggcttcttccaagctatggcagcagagaaaagagtacatcaagatttggtacaagccaaaccaaatgcgtggtgtggtttggctggacgatcgcgtcaaatactctgcccaagacaaccgaacccttccaccgtttcgagtctccagcgacacttccaagttcccttacaccaatcggaagggtcaccgttccgcgattcggatctcgaggatcgtgacggagactttgaggatgaagatggataacgtccggtgggtcgtgatgggcgacgatgacaccgttttcattaccgcttatctggtcaggattttgaggaaatatgatca

SEQ ID NO: 1441 - DNA, 519 bp, Gossypium hirsutum
  unsure (1)..(519): unsure at all n locations
  Clone ID: uC-gsronu33B050g04b1
tccacgcgtccgtgtaaatgttatttataataagatagtatattagtaggaattattttttattattaaaaatttaaatcccaaattggaatctttggattaatttcttcatcttcttttttgatgaaatctttgaattgttttcttaatttattttattgttaaattttatgaaaattttcaattatttatattttattatttacatatatttttactgttaaatactaatttaaaataaactaatttaagttgattgagtattaattcgattggcatcgatattattgttagtgcaagaggatgtgagtttgagtgtgttgaagcacattatcctcctatttaagggttagggagggattatgagtagttctaggtgtaagaaaaatttgattcgattaaaaaaaccgaaaaaatatttaatttttgagttaattgaattgagctattcgaattattcaagtcaacttgaataaataattcgagttttgagttcgaatcgagttaaatnttacaatc

SEQ ID NO: 1442 - DNA, 490 bp, Gossypium hirsutum
  Clone ID: uC-gsronu33B050g06b1
gacggaaaaaaaaaactatgaccatgggttctgcatacaagagggaggaagttattcaggcatggtacatggatgatagtgatgaagatcagaggcttgctcatcaccgtgaacctaaggaatatgtatccttggataaacttgctgagcttggagtactcagctggcgattggatgctgataactatgaaaatgatgaagagttgaagaaaattcgtgaagaacgaggttactgctacatggacttctgcgaggtttgccctgagaagcttccaaattatgaggagaagataaaaaatttcttcgaagaacatattcatactgatgaggagatccgttactgtgtggcaggaagtggttattttgatgtacgggatcataatgataaatggattcgtgtgtgggtgaagaaaggacgcacgatagtattacctgctggaatttatcatcgctgtactctggatacagacaactatattaaggcaatgcg

SEQ ID NO: 1443 - DNA, 441 bp, Gossypium hirsutum
  Clone ID: uC-gsronu33B050g07b1
tccacgcgtccgttcgctgtatggcgtgctcgtttgggttgggcgtcgtctaagagtgctcggagtgtggattaactccagtctcctatcaggtggtggttatcgtaggcgattgattttggaaacgtttcaacttcaacccgtaacaggaattaatatttagatctattttctacgcacgtttaagttggattcacaacggatatggggtaggaaggtatttggaacgttcttcaatgagtagatctcttgtgaggattaaaggctaccgatcgaggagtgtgtgaaaagcttggatcatcggagtgaataaatctagtcatcaacttcggcaaaggtgtgaacccaagggccattgtggatggtggccgaatgtgagaaatcgcataggagatctcgtcaaggaatatcgcaaatcaggtgagccttgatgtggggact

SEQ ID NO: 1444 - DNA, 491 bp, Gossypium hirsutum
  Clone ID: uC-gsronu33B050g08b1
tccacgcgtccgaaaaaaaaaaaaagaaaaaagataaaaaataaaaaaaaaaaaaaaaaaaaaaaaaaaaaaaaagggggggcgtttttggggttctcgggtttccgtcctcggggttcggcctttttaggggttcctttttttcccccggatccattttcctggcccgtttttttctggggccgcctttgtatatcccttggggtgccctttttaaatggccttggggggaaaccccttttcctctgcaggctttttggcgtttggggcccttcccctttggccttcctggccttttttccaagtggtttggcaagggggccgtcccttttgggggccctttccccccggtggtgggggcgttttcttgttggggggctctttttctttgggccgtttttttaccccccccttctttgacctttttccttgcctttttttgtacttttcgcctttttttttttttccctttttttttttggccctttttt

SEQ ID NO: 1445 - DNA, 371 bp, Gossypium hirsutum
  Clone ID: uC-gsronu33B050g09b1
ttggtgcgggtgttggtgaagtcgaaatgccgttctcttagccttgtgttctgggaattaagtaatatagtctgctttagtttcgttgatgatttctttgaatggggtttgattttctgcctcttaaacagctctggtttttttacttgtttcttgatgttgaatactattctttcctcgtctttttattctgtattgtgtgtcagtgtcatctgtatatgaatatctttttttcaagtactaatgtcgtaggcaaaaaacaagtactgctcttacagtccaaaattggaggagcatttctttgtaatagaatttgtaagattttcaaacaatatgaatggttgcttgcttggaacccctgttttgcttgg

SEQ ID NO: 1446 - DNA, 448 bp, Gossypium hirsutum
  Clone ID: uC-gsronu33B050g11b1
tccacgcgtccgcccacgcgtccgaaggctgcatcgaatggaactgcagagaaaggggcacccgtttcatctgcaaaagatggcgccgcccccactggcactgctgctaataattcctccgctgaacaagatgccgccgccacgaccgctcccaccaaggaccaaactgttgcggaaccagaggcaacagcagcctaattgcttacaacacatttaccatggttgtttccttgccctattcttttttgtttttgctcaaggtttcgatttcaaattgcattgcctattaccatggtattttcctgggaaggatttagtaccattagttacatacacaagtactattcctaattagttttttgtttttttttttttaaacatttcaagagattggacgtcaactgtgatcgttttattttgcttgttgaattgactttgtggacttatt

SEQ ID NO: 1447 - DNA, 485 bp, Gossypium hirsutum
  Clone ID: uC-gsronu33B050g12b1
ttcacgcgtacggttggtctattggatggtttccctcactctgtcgaagaaaaaaatgtgttcagggtgcagttgcggatctaactgcagctgctgtgacaactgctcatgcagcacgaaccttaaccttgcatcttcagggaagacaaccagcactcagaccatcatctgcggagttgcgccagtgcagatgaccttggagggaccagagatgagcactactgaatcatgacatggatgcaagtgtggatcaaactgctcttgtgatccatgcaactggtgaaaagcttgatgaacgccatagattatgaaatactgaaagcagcaaaaataacaggcctctgtcatgatatattgtcaaggatggatgcctgcaccgactataagtatgtctctgactgtgtctagagtaatagaagctccgaccgtggtgaaaataatgtataagccatttgggtgtgagcaaattgatcttttctccaaag

SEQ ID NO: 1448 - DNA, 201 bp, Gossypium hirsutum
  Clone ID: uC-gsronu33B050h02b1
gcgtgttgctacggacctgaccggaccttgaagcctttggtgtacgggagtatctatgactatcgacaactgcggcccctgtaggggcggaagcattgggctaaaaaaagtgtccctgttacggacatatggaagctaagataaaggtgcgccttaccctggattctccccaagctccagagtgagcactagaagattttg

SEQ ID NO: 1449 - DNA, 519 bp, Gossypium hirsutum
  Clone ID: uC-gsronu33B050h04b1
gtgcctttcccaattttttcttcactttgaggtttgagcagatcggatggcaccaaagaaagataaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatggatcccttgctaggaaggctataagggaattgatggcaagaggatcgattcgtttggtgtctgcccattcaagccagcagatttacactagggcaaccaacacctagatgttttgttatagttttgcttaaattagttctatgtagtatttgcctttcttgactttctgtgaacgatttttccttttgctaaagacctccatctataatgtgtgagctacagtttcttgttgttctggtttaatggataattt

SEQ ID NO: 1450 - DNA, 519 bp, Gossypium hirsutum
  unsure (1)..(519): unsure at all n locations
  Clone ID: uC-gsronu33B050h06b1
ttctactagaggggatcctttagggaatgctggaaaaaccttaaaggaagaaattcataagaaaattgaaaaatggcaagaaccacctcctgcaaagcagcctaaaccacttcctgttcctgattctgaacctaagaaaaagaggggtggtcgtcgcttaaggaagatgaaagaaaggtatgctataacagatatgaggaagctagcgaacaggatgcaatttggagtacctgaggaaagctctttaggtgatggactaggtgaaggttatggaatgcttggtcaggctgggagtggcaaactgcgtgtttcaattggtcagagcaaacttgcagccaaagttgctaagaagttcaaggaaaagaattacggaagcagtggtgccacctctgggctgacttcaagtttggcattcacacctgtgcaggggattgagctcacaaatcctcaagctcatgcacatcagcttggcagtggaactcanagtacttacttctcagagacaggaacattttcaaa

SEQ ID NO: 1451 - DNA, 455 bp, Gossypium hirsutum
  Clone ID: uC-gsronu33B050h09b1
atttcttttcaaaagatcccacagccatctcataatctgagccgagtgtcggaggcctgaaaacgaaccctaaacgatgggtcagggaacaccgggcggtatgaataggcaaggtttcccaggggaccggaaacccgatggctctgataagaaggataagaaatttgagccagcggcgcccccagccagggtggggcgcaagcaacgaaaacagaaaggatctgaggccgcggctcggcttccgactgtaacgccgttgacgaagtgtaagctgcggttgctaaagctggagcggatcaaggattatttactgatggaagaagagtttgtggctaaccaggaaaggctcaagcctcaggaagagaaagccgaggaggatcgatctaaagtagatgatttgagagggtcgccgatgagtgtcggtaacttggaggagcttatcgatgagaaccatg

SEQ ID NO: 1452 - DNA, 514 bp, Gossypium hirsutum
  unsure (1)..(514): unsure at all n locations
  Clone ID: uC-gsronu33B050h12b1
tttgcacacaaaattgatttcaaagagggccctgctttgccagttcttgatcaattagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtcggtggtagcaccacctgatgcgcctctcaggaagtacgttaggtattacagagacttcgtcatggaactcaacaaggctcttgctgttgatcccaggattgagatctgcatgctcccggttggtgatggcatcaccctttgccgtcgcgttaaatgaacaaccctcaccaccaccaaagcttgacccacctcttacattcggcacaaaaaagttgacacccaccttctttttctttcctcatctttatattgggtatgtntatttttatcataatgtcacggtggttggatgattgaagaatgccatattt

SEQ ID NO: 1453 - DNA, 287 bp, Gossypium hirsutum
  Clone ID: uC-gsronu33B051a10b1
gtgtttatctgttatcctggagccggaaaaacgaggattcgctgtaggttcaccagaaacgagttttgttcggaatctaaatccactatcggcggcgagttcgcttctagaaccctccaggtagagggaaagactgtcaaggcacagatttgggatacggccggtcaggagagatattgagccatcaccagtgcgtactacacaggggctgttggtgcacttatggcctatgacataacgaagaggcaaacctttgataatgttcaaaggcggtttcctgaattgag

SEQ ID NO: 1454 - DNA, 429 bp, Gossypium hirsutum
  Clone ID: uC-gsronu33B051b01b1
ccctcgcgtccgccattttcctctgccaacccaaacaaaacctctctaattccctttccttttcgacgatgagagaaatccttcacgttcaaggaggccaatgtgggaaccaaattggatccaagttttgggaagtgatctgcggggaacacggcgttgatcctactggaaggtacaatgctgatggtgaatcatccgataaccacctggagcggatcaatgtgtattataacgagtcttccggtggaaggtacgttcctcgtgcggttctcatggatcttgaacccgggactatggatagcatcagatctggtccctacggccagatctttaggcctgataatttcgtctttggacaatctggcgctggaaacaattgggccaagggtcattacactgaaagtgccgagttgattgatgctgatcttg

SEQ ID NO: 1455 - DNA, 470 bp, Gossypium hirsutum
  Clone ID: uC-gsronu33B051b02b1
cccacgcgttcgtcgtttctcatttcatcttccgtagagagcttcaaagcatgttctttgcattaggcctagtaatatcacagttcatcaatgaattcatcaaaaaatccgatcaacaagcccgccctgaaacctgtgctcttttagaaatgtgtgattctcacggctggccttcaagtcactctcaatacatgttctttttcgctgtttatttcacccttttgacatgcaaagggatcggtgggatttggaatgttagaaccaagtgggctgctttgtttttaccttggtctttggctgtcttgactatgtattctagggtttatttgggttaccatacggtggcccaggttcttgctggagcttctttggggattttgcttggtgggctctggatttgggtggggaaatctatgctcttctgttattgccctttgaatgaagagagttcctttgggaggtttttttat

SEQ ID NO: 1456 - DNA, 203 bp, Gossypium hirsutum
  Clone ID: uC-gsronu33B051b07b1
cccttgcgatcttcaacccccactgcaaccccagaggagagcttacaagtatgctctccttcttaaccctcagagaaacacatcacattcaaggaggccaatgtgggaaccaacatcaagcccaccctgaaacctggactctttgagaacagggcgatgatcacggttggccgtacagtgactctcaatgacatgttcttttt

SEQ ID NO: 1457 - DNA, 492 bp, Gossypium hirsutum
  Clone ID: uC-gsronu33B051c02b1
actcctcctcctacatcatcaccacctgcagtgacagcttctccaccaccagtttccactcctcctccagcgactcccccgcccgttagctccccaccaccagcttctgctccaccggctactcctcccccagctaccccacctaccgcaactcccccaccggcttctccaccgcaggctaccccaccacctgcttgtccccctcctgctactccatctccagctaccccaccaccagctcctttggcttctcctcctgccacggttccagctccggcccctagcaagaccaaagctaagtctccagcgctatcaccttcggcctccagcccaccgtgtacatcaactgaggcccctactcccagcctcggcgcttctacaccaggccccgctggaaccgataccagtggagttgagaaaacatggtccataagaaagaaggggtggagcttggggattggatggggtatcctcactttaatgctttaaacc

SEQ ID NO: 1458 - DNA, 352 bp, Gossypium hirsutum
  Clone ID: uC-gsronu33B051c03b1
gttggtggtaaactcgataccgaaagtggtgcatgaggtacagcttgctaatgctaaaaaaccagaatgggagctaaagaaggaaaatgcattaaagcgtgaaggtgaaatactagctaaatttgctcctttaaaagggttttccctttgaaagaaattatgtgttatcatatcattgtctgttggtaatatcttgaacaccataggtatgggactagttttatatttatttagtgataataaaataacagtggtagctttgctgagactgcaatttggtagtgtattgcttttgaggattgttgtaacttggtaactttggctagtgccccctttgtacttttgaaccgtc

SEQ ID NO: 1459 - DNA, 256 bp, Gossypium hirsutum
  Clone ID: uC-gsronu33B051d05b1
tttctctttcgtccgcggacgcgagaagttcaacaagggatgccttattggtgaccgtgattccagcccgacagacgcccgcactgacaacttcaagagagtgttcgatatcaatgccttgggtggtcccttgggagccaagtatgcagccaaggtcatggttccggccaagaaaggttgcattctcttctcatcgaggatttcttcaaaaatcaagattcggtctgccccatgcatacaaggcatcgaaccatgg

SEQ ID NO: 1460 - DNA, 346 bp, Gossypium hirsutum
  Clone ID: uC-gsronu33B051d06b1
atgtcttttcgtccgcggacgcgtggggttcaacaatgcatgccttattggtgacggtgatttcagagtgacagacgccagcactgacaacttcaagagagtgttcgatattaatgtcttgggtggtttcttgggagccaagtatgcagccaaggtcatggttccggccaagaaaggttgcattctcttctcatcgagtatttcttcaaaaatcagcattggtctgccccatgcatacaaggcatcgaagcatggcgtcgtagggttgacgaagagcttggctgtggagttaggtgagcatggaattagagttaattggatttcacctcacgcaactgtgacccca

SEQ ID NO: 1461 - DNA, 488 bp, Gossypium hirsutum
  unsure (1)..(488): unsure at all n locations
  Clone ID: uC-gsronu33B051d11b1
ttgcccacgcgtccgcggacgcgtggggttcaacaatgcaggcctcattggtgacggtgaagtcagagtgacagacgccagcactgacaacttcaagagagtgttcgatatcaatgtcttgggtggtttcttgggagccaagtatgcagccaaggtcatggttccggccaagaaaggttgcattctcttctcatcgagtatttcttcaaaaatcagcatcggtctgccccatgcatacaaggcatcgaagcatggcgtcgtagggttgacgaagagcttggctgtggagttaggtgagcatggaattagagttaattgcatttcacctcacgcaactgtgaccccattgttcctaacaacactgnggatgttcgataagaagaagggagaggagatgattgcgacttcagcagtgttgaaaggcaccgttttggagcctgaagattttgcacatgcagcgctgtatttggcaagcgatgaggctaaat

SEQ ID NO: 1462 - DNA, 100 bp, Gossypium hirsutum
  Clone ID: uC-gsronu33B051d12b1
atgccttctcgtccgcggacgcgtggggaccaacaaggcatgcctcattggtgacggcgaattcagaccgacagacgccagcactgacacctccaagaga

SEQ ID NO: 1463 - DNA, 470 bp, Gossypium hirsutum
  Clone ID: uC-gsronu33B051e01b1
ttttgatgtgtctgacatttttggttcaaaacaaaaccccatgaatgatggaaaccttaataaaatgagtacaaagtcatcacaagactctaaagctcctcaaaagaaggatgcttttcaggtgaagtctggaatttgggctgattcactgaaccgtggaataattgatcttaacatatctgctcccaagaaggtttcactggcagatgttggaatagtctgcggattaagtgatgtggatgaaagagtgaaagggcctccaacttcattttatatggggagagcaatgggaactggctctggtcttggtaaaactgggttcgcatctacaccatcaactgatgaagatggtctattctcaagccttggcaaccaccaacagtatcaattcggtagctttaaaaagtaattttgttcattccccctttgcattcatttcctattttggtgctaaaaacaaagttatcgac

SEQ ID NO: 1464 - DNA, 418 bp, Gossypium hirsutum
  unsure (1)..(418): unsure at all n locations
  Clone ID: uC-gsronu33B051f01b1
ctctaacattcctacttgcccacagacatcaataccacattgaaaacaaaatggctggagcttgggtgcttaacaatggcgtatatcggctggaaaactagtctccggaagaccgggtttttggtgcacttaccgtcgggtgaagttgtatcgtcctactcatccttggagcacattttgagaggtttagggtgggaaaggtactacgggggtgaccctgatctctaccaattccacaagcactcttccattgatctcatttcactccctaaggatttctccaagttctgctccgttcacatgtatgatattgtcgttaagaaccccaacgtcttccacgtaagagatatgtgacggtcacaccacccgccacaggtacctctcttttactgcttgnggtatccttttttttttcttt

SEQ ID NO: 1465 - DNA, 438 bp, Gossypium hirsutum
  Clone ID: uC-gsronu33B051f03b1
cggtcgcgtgggcaaggatctatgaatgctagaggaccaaatgccattgcatcaaataacttcgtaactatgaagagatcacgcaacagtcaaattcaaaactttccagaatcaaggactttaaagagccccaaaagggtgatcatgaaagcttcttgtgaaaacaaagaactcatagataatgatggttcttgctttagtccaagaagcctatttgctttgccttctgatcgtagctctctcatgctggattctcttcattttgtcgatgaaagttccgaccaagatttgctgctggatgtgccgtccaatggctcattcccgcaggcagaactgcttcatcctgctttaagttttgggcaacaggcaagcaccagtagtagctcggcacacccaaatcctttccatccttagcattggctttttataattacaact

SEQ ID NO: 1466 - DNA, 76 bp, Gossypium hirsutum
  Clone ID: uC-gsronu33B051f05b1
accgaatcgcaggcccgggccgagcccacccgttttaattacaaacaccaaccccgaaacaccaggggggggggcg

SEQ ID NO: 1467 - DNA, 357 bp, Gossypium hirsutum
  unsure (1)..(357): unsure at all n locations
  Clone ID: uC-gsronu33B051f06b1
gttgtagtttcgtcttcaagccatggagcaacaagcacaactccgtgatgctctaaatgaagcattaactgcggaggtccaacgattaaaacgtgctactcaacagctaggtggtgattccgacccttcaaaaggcatggtttccgagccgctttctgttaatcagcagatgttccagcttaacatatctcatcagatgcagcagcagtcacctccacagccccaacaacagaatgggaacacaactgcaaaaactgagttgaatcagtagcttggtctctgggaagctttggaaacccatgatatccccgtctctcttcacctcgggtattcattagttntcaatttcccgacttc

SEQ ID NO: 1468 - DNA, 325 bp, Gossypium hirsutum
  Clone ID: uC-gsronu33B051f08b1
cggtttcgttgtcaaggatctatgaatgctagaggaccaaatgccattgcatcaaataactccgtcactatcaagagatcacgcaacagtcaaattcaaaactttccagaatcaaggactttaaagagccccaaaagggtgatcatgaaagcttcttgtgaaaacaaagaactcatagataatgatggttcttgctttagtccaagaagcctatttgctttgccttctgatcgtagctctctcatgctggattctcttcattttgtcgatgaaaggtccaaccaagatttgcttgctggatgtgccgtccaatggcttattcccg

SEQ ID NO: 1469 - DNA, 450 bp, Gossypium hirsutum
  Clone ID: uC-gsronu33B051f12b1
gtttttgttttttcttcaagccatggagcaacaagcacaacttcgtgatgctctaaatgaagcattaactgcggaggtccaacgattaaaacgtgctactcaacagctaggtggtgattccgacccttcaaaaggcatggtttccgagccgctttctgttaatcagcagatgttccagcttaacatatctcatcagatgcagcagcagtcaccttcacagccccaacaacagaatgggaacacaactgcaaaaactgagttgaatcagtagcttggtctctgggaagctttggaaacccatgatattcccgtctctttttacctcgggtattcattagttttcaatttcccgacttcggaggatttcaacctgcatcagatattctccatctttagatgatgggacgaagtaaaaacatacattagcttggataatcataatatcggtta

SEQ ID NO: 1470 - DNA, 277 bp, Gossypium hirsutum
  Clone ID: uC-gsronu33B051g01b1
tttccttgtgtccgccaagcgtttgcgatgaaactcggatagcctgagacaatggtgtaatctctgataccctttttataatacaacccaacctttagctgtgcagagcaacttattcactctgtagaataattatctctttctcacttccaccgacctaaagagcgcccattcggatcacgtattagattgatattgcaaagatgtctccaactgcttcatttctcagcggaaaatgttgacatggccaagctggctgagcaggctgaacgctatg

SEQ ID NO: 1471 - DNA, 223 bp, Gossypium hirsutum
  Clone ID: uC-gsronu33B051g04b1
ccttctctttctaaacgctcggttatcgagagatctggttcattcctttttatcacacatcaattttgtttccccagatatggcgtaaggttaacactgctgcagcagccttctaatacccctcatttatctcctctggcggaactcagctatttgacctcaacaccttcgacccacttcttgactctgtgagtatggattaagctcgaaaccgctggcaacc

SEQ ID NO: 1472 - DNA, 418 bp, Gossypium hirsutum
  Clone ID: uC-gsronu33B051g07b1
ttttaactctttgtcagcgtttccgataaaactccaatatcccaaaacaatgggttcaaccggtgaaacccaaatgactcccacccaagtctcggatgaggaagccaacttattcgccatgcaactcaccagtgcctcagtccttccgatggtcctcaagtcggccatagaacttgacttgctggagatcatggccaaagctggcccaggtgctttcctctccccaaaagaattggcttcccagctgcccaccaacaaccccgatgcacctgtcatgctagaccgcatcttgcgcctcctggctacctactccatcctcacttgctccttacgcactcttcctgatggcaaagtggagagactctatggtcttggccctgtctgcaaattcttgaccaagaatgaagatgggcgtcac

SEQ ID NO: 1473 - DNA, 157 bp, Gossypium hirsutum
  Clone ID: uC-gsronu33B051h01b1
gggccctagaagttggataaagctaacaatttcctcccttttttttgccaaaaagggctacaaatcctaattagcatagtttttctttggccatattgagtatgctttgcccacgaattcgcctagcttcaaaatttttttatatggtttatattat

SEQ ID NO: 1474 - DNA, 361 bp, Gossypium hirsutum
  Clone ID: uC-gsronu33B051h03b1
cgatttaccttaaattaggggcaaaaccgttctcggtggtgtatgtacatacagatgttcaaaagagtgaaaattttcctggaatatcagttcttcgatcagtctacgatgctattccgatgaacctcaagaacaatctcgagtttgtttatttcttgcatcctggattacaggccagacttttccttgccacctttggccgtttgtttttcgacggagggttgtattctaaacttaaatacgtgagtcggcttgactttctatgggaccatgtgaggaggttggagatgaaaataccagactttgtgcatgatcatgatgaagagctggagtaccatcccatgatggactatgggttaga

SEQ ID NO: 1475 - DNA, 533 bp, Gossypium hirsutum
  Clone ID: uC-gsronu33B051h04b1
gtggtgcgagtcttttaaggaatcgagcccacagacaatttaaagccgtaaggaatcttataattgaccttcaagaagctaatggcttgccccagcaactcatacatctaaagtcatgggaacctaaattcaaaagaataaagcaagtcatcgcaaatatcccgtctttaccacaatcacaggcgaggctgaaactgctcgaagtagaatggtccttggagcaatgcctaaaactaagatcagaggtacgcagagaactagcaaaagcacgccgagtacaatcacaggtccataaacttggtgaagtcctccttaataatggggaattgagcacggaggctctagaaaaccagcttctttctgtgatgccaactatggaagaaattgctgcaagtttgccatctcttgaagcattaccacctccttctagtgattgtgacaacgacaaaggtctccatggcatgccattggggaacactattaaacatggaatgcttcagagggtggaagtgaggtgtttggagcacaaaaca

SEQ ID NO: 1476 - DNA, 54 bp, Gossypium hirsutum
  Clone ID: uC-gsronu33B051h05b1
cggaatcccggccgacccacgcagcccgcttgcgttcgacggaggaaccacgcc

SEQ ID NO: 1477 - DNA, 315 bp, Gossypium hirsutum
  unsure (1)..(315): unsure at all n locations
  Clone ID: uC-gsronu33B051h07b1
gatttctagaccaaggaggctccttcaagaatcgtatacctacattcttgtattttggtcctagaagttggataaagtttacaatttcctcccttttttttgccaaaaagggctacanattctaattagcatagtttttctttggtcatattgagtatgctttgcccacgaattcgcctagcttcaaaattttttatatggnttatattattctggaatagatgtttattaaattttaaaacaaaaaaacacaaaaaaaccaacancacaaaaaaacaaaaaaaacacaacnncacccccaaaaaaaaaaacaaa

SEQ ID NO: 1478 - DNA, 386 bp, Gossypium hirsutum
  Clone ID: uC-gsronu33B051h08b1
tgtatttattacaggtgggtgaaatggttcggacgttgaagctcgaatacagcggtataaatggaaagtgaagatcgactacaagtcccctgattgttttaaggaactggtaatcaccatctatggcggaacaccaggttctaaatatcgagcagataatgatactatcattgttgagctcaccaacggtttgctaactgagaatgtgcatgtactgcttggaattaacagatcggaacaccctggtttgatggaactgaaagagagactcaatgtccgattataccaggaaccactctcaagaatcaggtttgtgacgacagagctggaacatacttgtatcatgcacattatgggatgcaaagagaagctgggttatatggatc

SEQ ID NO: 1479 - DNA, 394 bp, Gossypium hirsutum
  Clone ID: uC-gsronu33B051h09b1
cccacgcgtccgccacgcgtccgctttgatactttttttgtttgtgtttttggtgtaatctttgataccctttttataaaaaaaccagccctctagctgttcagagtttagtcttcactccctagaataattttctctttctcacttccaccaacgaaaaagtcgtcgatcggatcacgtattagattgatattgtaaagatgtctccaactgaatcatcacgagaggaaaatgtttacatggccaagctggctgagcaggctgaacgctatgaggaaatggtggagttcatggaggaagttgcaaaaactgttgatgttgaggagctgactgttgaggaacggaaccttctctcagtggcttacaaaaatgtgattggggcaaggagggcgtc

SEQ ID NO: 1480 - DNA, 524 bp, Gossypium hirsutum
  Clone ID: uC-gsronu33B055a01b1
ggaatatgaatctcaagagaggttgaagcggcagatgactattgaaaagatatctcttccaccaaatattagttatggacttgttcgctcttacttgctacattatggctatgaagatacactcaattcatttgatttggctagtaaaagcactatcccccctgtctatatagctcaagaaaatggctttgacgagcaggatatcggatatgcactaaatcagagaaagattctacgacagctcatcaggaatggtgagattgatgcagcaattagcaaacttcgtgattggtatccccagattgttcaggatgacaaatctgctacttgctttctgctgcactgccaaaaatttatcgaatttgttcgggtaggagcacttgaagaggctgttaagtattgaaagaattgaattggcaaaaatttttcgggtggctggatttgatgatttagtgcaggactgtgttgctttgcttgcatatgaacatccacaggagtcctggtggggataccttttagaagag

SEQ ID NO: 1481 - DNA, 60 bp, Gossypium hirsutum
  Clone ID: uC-gsronu33B055a02b1
gtcgttccggtgctttatctgcagaaagaaggttggattgactgggtttaagtgccgatg

SEQ ID NO: 1482 - DNA, 292 bp, Gossypium hirsutum
  Clone ID: uC-gsronu33B055a03b1
gaagaaatgaaacaactgtggctgagcatgggagacaatatcgtgttgaatatgcgaaaaatgcgatgatacgacttgctcagtcttaccttgtggaagccagatggactcttcaaaactacaaaccatcattcgaggagtttaaggcaaatgcattgccaacttgtggttatgccatgcttgctattacatctttcgtcggcatgggagatattgtaacactagaaacctttaaatgggcagccaatgatcctaagatcattcaagcttccacaattatttgtaggtttat

SEQ ID NO: 1483 - DNA, 509 bp, Gossypium hirsutum
  unsure (1)..(509): unsure at all n locations
  Clone ID: uC-gsronu33B055a04b1
ggaaggttggccgctcgcgcggtcacgcggcccgaaattccggtctagaccacacgcgtccgttgaatccctccccctgattattggaccactctataaaaccccagccaaacgagtctttccaaacccaatggattctgtgttggcctccattgttcaagctcctgaagatcccattcttggggtgacagttgcttataacatggatccaagcccaaacaagttgaatttaggtgttggtgcttacagaactgaggaaggaaaacctctagttctaaatgttgttcgaaaagcagaacagctttttgttaatgacctgtcgagagtcaaggagtatcttcctattcttggtctcgcagagttcaataaattgagtgctaagctcattcttggtgatgacagtcctgcttttaagagaacaaagtggctactgcttaatgcttgnctggaactgatacttgaggggttgagctgagttttagcaagcattaccaccaccgtctttttca

SEQ ID NO: 1484 - DNA, 301 bp, Gossypium hirsutum
  Clone ID: uC-gsronu33B055a05b1
acgcgactcggtcattcgaccggtgcggttctgttagaggcaaggatatggtggggctgatgatcgtggtgatcgcttcagagatcgtgatcgatacatagatgaccgttatgatggtggacgctatggagatagagaccgttttgacagtagagatgatagatatggaagccgtgatcgttatattagtgacaggtatccacctactggagatcgatttggtgatcgatatgctggatatgatcgtttttcataaaatggttttggcaaagagagagggtatagtgatgctgctccaaga

SEQ ID NO: 1485 - DNA, 122 bp, Gossypium hirsutum
  Clone ID: uC-gsronu33B055a07b1
ttccatatgtgatccacgccacggaaagtacatggcttgctgtctcatgtaccgaggtgatgttgtgcccaaagatgagaatgcatcttgtgattcctttaagaccaagctcacattttatt

SEQ ID NO: 1486 - DNA, 283 bp, Gossypium hirsutum
  Clone ID: uC-gsronu33B055a09b1
tcgcccactcgtccgcccacgcgtccgcttaattgccgtttcaagaaataactattaagtttgattttcggaccatgtctttgccaaagagttggaacctcataagccacttgcgaagttcttgtgcatcaagggaattgttttcttctgcttttggcagggagtggcgcttgacatacttgttgctgtgggcatcattcgagcaaatcatttctggttggatgtggagcaccttgaggatgttaattgagacttttacgcgtcttttgagattttatttttc

SEQ ID NO: 1487 - DNA, 302 bp, Gossypium hirsutum
  Clone ID: uC-gsronu33B055a11b1
tcccactcgtccggggatatctggcaagtcccaagcttctatttgagcctgggatcagagctcattcatcatattagaccgttgctctatatcataaaggaccttcttcttagacgtcactttatatattgagaccgttttgacagtagagatgatagatatggaagccgtgatcgttatattagtgacaggtatccacctactggagatcgatttggtgatcgctatgctggatctgatccgtttcctcacaatggttttggcaaagagagagggtatcgtgatgctgctccaagaggtaa

SEQ ID NO: 1488 - DNA, 200 bp, Gossypium hirsutum
  Clone ID: uC-gsronu33B055a12b1
cccacttgtcctcccacgcgtccgattacggcaacttcaataatatatagattcccattctttcatgtccctaaatgagaaagagccttgcgagtttccgtcacaaacgcccgcccaaccccagcccaacccaccccgtgtcgtcaagaaacgcacccgccaagacaaccactccccgtttcgcggggtactgtagagga

SEQ ID NO: 1489 - DNA, 199 bp, Gossypium hirsutum
  Clone ID: uC-gsronu33B055b01b1
acgcttaatttgtcttcattatttggtaattacggattcaaatagcgccgaaatagtggtatagtggccactatttagtggtagtgctgccggccgctacagctatcggaagaaaaactgttgagtttaaatcacaacaattgcggtgaatagtggccgcaataatcggtgtagcggtattaacgaccccttattccag

SEQ ID NO: 1490 - DNA, 420 bp, Gossypium hirsutum
  Clone ID: uC-gsronu33B055b03b1
aaaacatcatgcctcagggaaagcttcaagttgtccttgttagtgccaatggtctcgagaacacagattttctctgtaacatggatccttacgtgcttcttacttgccgaacacaggagcagaaaagcagtgttgcatcaggaaaaggatcagaaccagaatggaacgaggatttcatattcaacatctccgaaggtgcttcggaactcgcactgaaaataatggacagtgatactggttctcaggatgatttcgtgggagaagtagctataccactggagcctgtatttatcgaaagaaacattccccttactgcatatactgttgtcaaggatggagaatatcgtggggagattaaacttggtctcacttttcaccctcgaggaacgtgaagcagggattttgaagttgagaattttt

SEQ ID NO: 1491 - DNA, 152 bp, Gossypium hirsutum
  Clone ID: uC-gsronu33B055b05b1
cccactcgtccgtccatccatgtctgttgtagaatattaccttgtgaagcgttttccagtaccttacgctctgtacttcactggggtagctacagttgctgcctttatcggacagcatgttgtcccaaacgcttgttaattttatttggaag

SEQ ID NO: 1492 - DNA, 320 bp, Gossypium hirsutum
  Clone ID: uC-gsronu33B055b07b1
cccactcgtccgctcttcactcttctctcaccatgtcattgctgtctttctccttcttggtgctgtttacttttagtgccaaagctgttgttcctccatctgaaacttttaggtttgtcaacgacggagaatttgggccgtttgttgttgaatatgatgcaaattaccgtgtcataagcatagctaatgcccccttccagcttgcgttttataacaccacccctaatgccttcacccttgcgttacgcatggctacaacgcgttccgagtcgctcttccgatgggtttgggaggccaacagggggaaccctgttcgcgag

SEQ ID NO: 1493 - DNA, 370 bp, Gossypium hirsutum
  Clone ID: uC-gsronu33B055b09b1
taaaaggctcattattctctgtttcgtatttctcttaaaactctacaatggctaaaacctttgcttgctttgtcctattagctctcatagttagttgcgcacttggtcaggctcctagctcggccccaaccaagtcaccgccgtcttctaaccctactccggctcccaaggtttctccaaccatgtctccaaccactacaccaaccgcatctccgccgtcaacatccactcccccgtcttcagcccctgaatcttcaccaacttcctctcccaccacttctcccccagctactcccgctggttctcccgctggatctcccgatggctctcccgctggctctgccgctagcgctgtttcttccacaaactc

SEQ ID NO: 1494 - DNA, 74 bp, Gossypium hirsutum
  Clone ID: uC-gsronu33B055b10b1
aatataaatacggagacaagaaccataaaagagacaagctgacgtacgcaagaatgaaaacaaatagaatatag

SEQ ID NO: 1495 - DNA, 151 bp, Gossypium hirsutum
  Clone ID: uC-gsronu33B055b12b1
tctgactcgtgggtttcaattgtaactttatttgtaatagtgactatataaagagaattaatattattatgctgcagtgcagtgttccacttatgcttatgattttatgtttatgtttgatttcctcttcttcctgatcttgaactggttg

SEQ ID NO: 1496 - DNA, 484 bp, Gossypium hirsutum
  Clone ID: uC-gsronu33B055c01b1
gtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctttgtctgtgtcttgtggaatagaagctattgtttgtggagaaaataaatgtataagccaatttgtttgggagcaaattgtccttttactccaaagagatttt

SEQ ID NO: 1497 - DNA, 367 bp, Gossypium hirsutum
  Clone ID: uC-gsronu33B055c04b1
ttgtgtcaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcctttttagggatccaagttttacattcccgttgtttgcaaagtaatagtttttttttggggccaccaaaataaaattaattggccgggttttaaaaacgttggaattggaaaaaccttgggtttcccaaattaaatgcctttgaaaaaaatccccttttcgccggttggggaaataaaaaaaaggcccccccctttcgcctttccaaaaatttgcccaccttaattgtgaaatggaacccc

SEQ ID NO: 1498 - DNA, 52 bp, Gossypium hirsutum
  Clone ID: uC-gsronu33B055c06b1
cccactcttatttagactcagcaggccactcctgggaggaccaggtataaga

SEQ ID NO: 1499 - DNA, 197 bp, Gossypium hirsutum
  Clone ID: uC-gsronu33B055c07b1
acgcctttgcatcctaaaacgggtaagtcaccggaggcctcgttccacgtgagtgaccccaggaaacattaagctgttttttttcttgattctagtattttcagtatgaagtgttccaagtcattttaaactcgaagcataattatgcggatttccgagctttactttgataatgtaaatgcagcatccacgtattt

SEQ ID NO: 1500 - DNA, 201 bp, Gossypium hirsutum
  Clone ID: uC-gsronu33B055c08b1
cccactcgtccggttgacccacccaatagttagatctcagtttcctttgctaccaaactttggcaatggcggatccagcactttaccaccaaatccaacccatcaaagaaatagccatagactacaccttagaggtctgcacccactgccctgtcttcaactctattacactcacctttgttcatcgtggaggcgcttgtt

SEQ ID NO: 1501 - DNA, 134 bp, Gossypium hirsutum
  Clone ID: uC-gsronu33B055c09b1
gctcataatttgaaactagaaggctctttgtcaacatgtcagtcagattgtgttttatgccaattttaagaatccaaacatccccttaaatatccacctctcaaacaaaatgataacgaatgtttatatgcttt

SEQ ID NO: 1502 - DNA, 160 bp, Gossypium hirsutum
  Clone ID: uC-gsronu33B055c10b1
gctttacagtcgggtacaagaactggaaccgtaaggcatggatcttaagctaatcaattccaggagaatactcacctgataactgtggagaagagatatggaggggacattattaagggatggaggttcgtgatgagtatagatattcatgggtgaggat

SEQ ID NO: 1503 - DNA, 424 bp, Gossypium hirsutum
  Clone ID: uC-gsronu33B055d03b1
gggagacccctgccatcgatgtatgcaaaggactcttgggagacaaagctcggttgagcatatatgacccgcaggtgaccgaagaccaggtccaacgggatctttccatgaacaagtttgactgggaccatcctcttcacttgcaacccatgagtcccacgactgttaagcaagtcagctgggtgtgggatgcttatgaggcaaccaaagatgcccatggaatttgcattctgaccgagtgggacgaattcaagaaactcgacttcaagaggatatacgacaacatgcaaaagccggcttttgttttcgatggaaggaacattgtgaacgcggatgagctgagggagattgtgttcatggggacctaaattggtaagccactggatccatggtttaaggacattgccgtagtttcttaaatgtc

SEQ ID NO: 1504 - DNA, 451 bp, Gossypium hirsutum
  unsure (1)..(451): unsure at all n locations
  Clone ID: uC-gsronu33B055d08b1
agctatacttgctctgttttctctcatcatctttctttctcccccttaattctcacttcatatatactttatatcaacgatgtcggtaaaagagtgcggcaatcacgggaagtaccgccggaaaatcttccgtcgagtcatcgccggcatcctaattttcattctaatcgtgctgataacaattcttctcatatgggccatcctccgtcccagcaaacccaggttcatcctccaagacaccaccgtctacgctttcaacgcctccacccctaacctcctcacctccaatttccaagtcactctatcttctcgaaaccccaacgacagaatcggcatttactacgaccggctcgacgtttacgccacctaccagaaccaacanattacccctccgaacagtcatcccttcaacgtaccagggtcacaaagtgatcaacgtttgggcatccct

SEQ ID NO: 1505 - DNA, 229 bp, Gossypium hirsutum
  unsure (1)..(229): unsure at all n locations
  Clone ID: uC-gsronu33B055d09b1
gaatttgaagatgaggttggatccgagtgtgcaaaatatggaactgttacccgagttctgatatttgagataacagagccaaatttcccagccgatgaagctgtcagaatctttattcaattcgagagatcagaggaaacaactaaagcattaattgacctcgatggacggttttttggggggagggtcgataaagnctnattttatgatgaagagaggttaagagaga

SEQ ID NO: 1506 - DNA, 274 bp, Gossypium hirsutum
  Clone ID: uC-gsronu33B055e02b1
gtttgtatccagtgaaaaatgctaacggttcaaattatgacactccagacagtgcaaggttgcttgttctgcggctacacacacgatgggtagtagctgctggtggcttcttaacacattcagtgccattatatgcaactggtgtggaggtatcactcttttgtacaatctttgtagtaaatttgttttcaatattctttgtaatatacactaatgttttcttttttttttctatttttctttcttctctttcttatttatctttttctttttt

SEQ ID NO: 1507 - DNA, 52 bp, Gossypium hirsutum
  Clone ID: uC-gsronu33B055e04b1
aaataaaaaattaaaaaaaaaaaaaaaaaaaaaaaaggggggcggtataatt

SEQ ID NO: 1508 - DNA, 300 bp, Gossypium hirsutum
  Clone ID: uC-gsronu33B055e12b1
tctctagctctccaccgttgacttgacgttgggatcgccgctctcaaagcccataaccaccttagactttgttgaactagtggtattcgcttttattactatatataccttattatttatattcattgcatctctagtcttggtttatgtcaaataagtagtttgttttgcaatatagttggtgccgatgtaaattacataatatgaccaaaatatttgggatgttctaattctagctaaaatttctttttaaaataaacaaaactcatacttcttacataaatttataatatatcaatt

SEQ ID NO: 1509 - DNA, 190 bp, Gossypium hirsutum
  Clone ID: uC-gsronu33B055f03b1
catgatccacctgggccaaatcggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgtttcccaccaattcc

SEQ ID NO: 1510 - DNA, 210 bp, Gossypium hirsutum
  Clone ID: uC-gsronu33B055f04b1
tttgttgcatttcaactccaaggatgaccctgctaaggaggctgccaacttcacttctcaggtcatcattatgaaccaccctggacaaattggaaatggatatgctccagtccttgactgccacacatcacacattgctgttaagtttgctgagcttttgaccaagattgacaggcgatctggtaaggagcttgtgaaggaacccatgtt

SEQ ID NO: 1511 - DNA, 316 bp, Gossypium hirsutum
  Clone ID: uC-gsronu33B055f08b1
tccgtctggtgccgctgcaagcctatttcgcaaacagcaaacggagcagacagtcagataagcagagaaaatggaggcagccagaactgttaaggacgtttcccctcatgacttcgtcaaggcttacgccgcccatctcaagcgttccggcaagatcgagcttccttcatggactgatattgtgaagactggtaaactcaaggaacttcctccctacgatccagattggtactatatcagagctgcttccatggcaaggaagatatacttgaggggaggtctagggtgttggtgcctttaggaggatttatggagg

SEQ ID NO: 1512 - DNA, 151 bp, Gossypium hirsutum
  Clone ID: uC-gsronu33B055f10b1
tgggacgcgcccttgtagcggtgcatttagcgcgtctgttgtggtttatactattctacttttttttcttatctttttcatttttaatttataatttttattttttattcttccatttattttcttttttatttatatttttatttaattt

SEQ ID NO: 1513 - DNA, 189 bp, Gossypium hirsutum
  Clone ID: uC-gsronu33B055f12b1
tgaatttgtgatgtaattgtcttttgctactctctcctctctgcttatagatattgttatcttcagtaaggctgcattctatctgtgtaagcagtatattccgaaagaactttaatgaaggattgaatggaagtcggtgacagtgtttgcttgttatcatgcattaaagaatacacaatctttcaggtt

SEQ ID NO: 1514 - DNA, 535 bp, Gossypium hirsutum
  unsure (1)..(535): unsure at all n locations
  Clone ID: uC-gsronu33B055g02b1
cattgttgctttaaatgatagaatttggttcgttcatctaggcaatttcccaacaaagtcggggtttttctctaggcaaattgtaactaatatttcgaaccaagtagaaatatccaaatcatcaatgaaacttgatctgtttgtcttatatttacaaaccgcggatttcatttggtgcaggtgctgaggttgccgttctttgcattacaaaatctggggaagtagtgaactatcaggcttttacaaactccaaggggatatacaccgtggccgaaacaatgcccgagagcgagcggcgggatgcatgcttggcacgacctatcagaagtttccatgagcactcgaaccatcttgaggacggaagcacaggaatcaagttcacctataatcatccctcggatcaattccacgttatccgaccgtttgtataatcgacccttaacagtcccaacctactgcatttgaactgttgggngatgtcttgggcagaagcaaatggacataattaataattttaaggttgcaaattatcttt

SEQ ID NO: 1515 - DNA, 56 bp, Gossypium hirsutum
  Clone ID: uC-gsronu33B055g05b1
ccacctacctccactgaggactgggtagactttaatatctgaacacggcggctttt

SEQ ID NO: 1516 - DNA, 184 bp, Gossypium hirsutum
  Clone ID: uC-gsronu33B055g06b1
ctcacaccaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggag

SEQ ID NO: 1517 - DNA, 106 bp, Gossypium hirsutum
  Clone ID: uC-gsronu33B055g07b1
tctaacatatgagctgccacagagagccgggctttttctataaatgtgggatccatgggaatataggagctgaaatgcatagcatatggatcagtattatgtgaat

SEQ ID NO: 1518 - DNA, 127 bp, Gossypium hirsutum
  Clone ID: uC-gsronu33B055g08b1
tcccactcgttcgcaaaatcagaccacgaccaaggtaagcttccttttcctatcatttcagggatcttccccagctatttttcacgctgttacagaattatataatatgttatgaagtatttataga

SEQ ID NO: 1519 - DNA, 105 bp, Gossypium hirsutum
  Clone ID: uC-gsronu33B055g09b1
ttccgtttttccggcaacgcggacggaccaacagctgtaaaggcattacgtcagggactaccgatttagacacgaccggacgattggtatggcctgacgcattgc

SEQ ID NO: 1520 - DNA, 286 bp, Gossypium hirsutum
  Clone ID: uC-gsronu33B055g10b1
gcagttctcacctgttagagaaacacctgtgaaaatcgagcagccaacgcagattatgacgccaattaataatcaaacagggcttatgcagcagcctaattattcctctgcttcccagaatttttatcaaagccaacctccacagtatttgctaaatcagcaaccatcagcttcagctgtggattacaccactccaaatccaacggggatgaagatgggtggaagcaacatttccaaccttattagacacagtagctcacctgcagggttattctccaatattaac

SEQ ID NO: 1521 - DNA, 69 bp, Gossypium hirsutum
  Clone ID: uC-gsronu33B055h03b1
gaaggaaaaaagtaaaaggaaaataaactaaaaatgccggtttttcataagctgtactgctatttcccc

SEQ ID NO: 1522 - DNA, 322 bp, Gossypium hirsutum
  Clone ID: uC-gsronu33B055h04b1
cttgttatatcttctacacatttctccctaacatggcttacttcgaattccttccagtaaagaatgaaggtgatggatctattgaaatgaagagcaacaatgaagatactgaacttgttgatcttgtaaatgtgaaggctggtcagtgttatgaactagttgtcacaacttgtgcaggattatatcgatataaagttggagatgttcttatggtgagtggtttttacattaatgtacctcaatttcaatttgtggagaggaaaaatgatattctcagtgtagctcatcgaaaacacatgtctaacataccttttcaaggttg

SEQ ID NO: 1523 - DNA, 134 bp, Gossypium hirsutum
  Clone ID: uC-gsronu33B055h08b1
tgggagtcctcgggcgaaattgaaataccactgcttttaacgttattttacttattccgtgaatcggaggcggggcacggcccctctttttggacccaaggccggcttcggccgggcgacccgggcggacgaca

SEQ ID NO: 1524 - DNA, 309 bp, Gossypium hirsutum
  Clone ID: uC-gsronu33B055h09b1
gcccttttcttctcttcaactccacctgctaaaatgcaccaatttccggtgcttctcagcctcatcgcagtgtctgtactgctgatggtaactccagtcattggataccgtccatggcctcacttaaaacccaacagctccgatttaacgtttggaagctccaagaaattcgagggctcatcagagttcgtccaaatgagataccatatgggaccagttctcaccgccaacatcaccgtacacatagtttggtacggccgatggcaaaaatctcagaagaagatcatccgtgagttcatcaactcaatc

SEQ ID NO: 1525 - DNA, 210 bp, Gossypium hirsutum
  Clone ID: uC-gsronu33B055h12b1
tgcccactcgtccgaaaaaagggagctggatgctcttctgtcagatgaagctttggctaatgtcccattcctcatcttgggcaacaagattgatataccatatgctgcttcagaagatgagttgcgttatcactttgggctcaccaatttcaccacaggcaagggtaaggccaatttgggagactcaatactttcgacttcttcatggtt

SEQ ID NO: 1526 - DNA, 533 bp, Gossypium hirsutum
  Clone ID: uC-gsronu33B057a03b1
cctttgcgttcgtgcataaccgatcttgtatcgaggctcgttttggaatgtgaaatcattattgatgaagtgttccctgtagaacaagaagacgaagattaaatcgtaaaggaacagagagaagctataacagttgcagggaaagggattttcaggaacacaggggcagctctattgagcatgcaagaaattagaagagggagttctacttacgggcatttttctctgactcctatggatttgccagactctgatctcatacactgctttcaactcaactgccggatccccattgtttgatcacacaacttaaatgaaatttacgtgtagtttgaagattcgttgcgtttattacggatgggaaccgccccaaaaatcgcaacattctgttctgattgctattgaaatcctaaagttagcatggggtttttagaacattaaaaccttatacttttattggtttaaatttttttttttagggaccaattttcatttttatgcatcggttactaagacattttttttggggtgga

SEQ ID NO: 1527 - DNA, 274 bp, Gossypium hirsutum
  Clone ID: uC-gsronu33B057a10b1
ctctctattcgaaatttgaatgctgggtcattttacaatatttcttagtgtgttcaggatcgggaggatagaggtttatcatcaatggcggatactgagaccgttgcatttcaagctgagatcaatcagcttcttagtttgattatcaacactttctacagcaccaaggagatcgttcttcgtgagcttatcagtaacgcctctgatgctttggataagatcaggttcgagagcttgacagacaagagcatgctcgatgcacagcctgagctct

SEQ ID NO: 1528 - DNA, 556 bp, Gossypium hirsutum
  Clone ID: uC-gsronu33B057b01b1
gttttagagacggcgccaatcagctgtccgccttgactgaccgtccggcatcgtcttggccctcgattttgcccttttgaaaccttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtctgttaggatgcatgctgagaagactgggaacgaagctttccttaaccttatccctttgcttcagggaaatgtgggtttgatctttacaaagggtgatttgaaggaagtcagtgaggaagttgctaaatacaaggttggagctcctgctcgtgttggtctggttgcgcctattgatgtggtcgttccacctggaaacactggtcttgacccatcacagacctctttctttcaggtgctcaatattcccaccaagata

SEQ ID NO: 1529 - DNA, 278 bp, Gossypium hirsutum
  Clone ID: uC-gsronu33B057b02b1
ctctcttgtccgataagtttcacgaacaactcaacaaagataacactaacataactcgtgaatttttaatatagtaatgatattcttttttataatttttttattttatagttaattaatttatcttaagtttattttttattttttttcttttttatatattgatttgtttttaatataagtgcattgttattattttgtttatttgttcttctttttatgctatgagtcttttttaatagtttctgtttgtgtttttatgtatttttattttttta

SEQ ID NO: 1530 - DNA, 465 bp, Gossypium hirsutum
  Clone ID: uC-gsronu33B057b05b1
cttgctgtccaaatgttattagggatgtaaaatattaagcaaaggaaaaaaaaaaaaaaaaaaaaaaaaaaaaaaaaaaaaaaaaaaaaaaaaaaaaaaaaaaaaaaaaaaaaataaaaaataaaaaaaaataataaaaaaaaaatataaaaaaaaaaagggggggggggttaaaagggaacaaagttaattaccgggggatttggaaagaaaaaattttttaaaggggcaacaaaaataaaatcaagggggggggttttaaaaaggtgtgggatgggaaaaacctgggggaacccaaaataaatgggtggggaaaaaaaccctttttcgcaggggggggtaaaagaaaaagggctcgaaaaaagggcccctttcaaaaattgtgcaatcctaaatggggaaaggggacccccctttgtagggggaaataaaaggggggggggggggggggtacacccaaggggg

SEQ ID NO: 1531 - DNA, 128 bp, Gossypium hirsutum
  Clone ID: uC-gsronu33B057b06b1
gcttttgtttggttgaagaaattctggaactgaggggttgtggctgtgtttcagtgctgagaaaaatgaagcaacgttctttggactgctttttaattcaaaaaaaaaaaaaaaaaacaaattactat

SEQ ID NO: 1532 - DNA, 192 bp, Gossypium hirsutum
  Clone ID: uC-gsronu33B057b07b1
atgtgtgatgacattaaagggactgggcggaatggttagacaccgtcgggggtcaatagcccagggtccaagtgtaaggtcgatcttcagatcaagatccggaaacggactctttgagaccacaaaatttctaatttatacctttaatccatttgtttttaggtcaaaaatcagttttggtctttctattat

SEQ ID NO: 1533 - DNA, 460 bp, Gossypium hirsutum
  Clone ID: uC-gsronu33B057b08b1
tttcttcgcgtccgcaaagggtgaagtcccgaggggggattcaatcgaggatgatgcatcaaatgatgaccgatcctcccttcgtactggtttgctgggttctgaagctgttcttgtcctagaacttaagagcattgctgatgtaggccttgtgggggatgcccaatgctggcaaaagtacacttttaggggcaatatctcgagctaagcctgcaataggccactatgcgttcacgactgtaaggcctaatttagggaatttgaactttgacgacttgtcaattacggtggctgatattccaggattaataaagggtgcttaccagaatcgtggactcggacatgctttcctccgccacatagaacgtacaaaggttttggcatacgttgtagacttggccgttcgattagatgggagggaaggaattccaccttgggaacaactgaaagatttagtctt

SEQ ID NO: 1534 - DNA, 488 bp, Gossypium hirsutum
  Clone ID: uC-gsronu33B057b10b1
gagatcgaactgaaagaaaagaaaggggggggttcaagagaaacttggggttgatgaaccggccggtcctcaaccggaacgtgcccttggccggctgaggatgatcaccaccaccccacccttgtccaccaaagatgaggcttcatcaatggcgatgccgaccaggcctacgacacccgggacaccatcgacgccggtgtcggctcgtaaggacaacgtgcggaggagcgtggttaatccaggtagcaaccttgcaaccaaaggtattggcgctgaagttttcgacaagcctgaacctaactctcctactgtttatgactggctttacagcggggagacccggagcaagcatttccgatgattaggcggtggttgacggcggcggatggtagcaaaaccactagcagaaggtcgcagcctcctgcaggaacaggatttgcatgtaaatatatcataacgtcctttttaaaagttctacaaggggtcaa

SEQ ID NO: 1535 - DNA, 140 bp, Gossypium hirsutum
  Clone ID: uC-gsronu33B057c03b1
gtgaaaataaagagttttgtaagagaaaattcaacgcttgaaatttactaaattctatttatattacatataaatttgtatgccaatgtatcatgtacgtgctttacaaagtcatgaatgaagtagaaaaataagtgatg

SEQ ID NO: 1536 - DNA, 260 bp, Gossypium hirsutum
  Clone ID: uC-gsronu33B057c04b1
ccttcgcgttcgcttcatttccctatcttctctgcaaatggtctatccttatcttttcttttctttttttccttcttctttgagtagacagatacaatgatgtcaattaacaaagggaaagaaatagctgaaggttcttcaggaccggctgctgttgctgttggtgctgctgttggtggtgttggtgggggtgatcagcggtatccaccgtcgcttagcaggttctagatccattagagaccgtatttgtacactttttg

SEQ ID NO: 1537 - DNA, 449 bp, Gossypium hirsutum
  Clone ID: uC-gsronu33B057c09b1
tttttgcgtccggttttgataaggggcattggggggtaagagttgatcttttgtgggtccgactaatggcgactgctattgggatgattggtgggaagggttgtccctcgtggatgcaagttaaggaaatgggaaagaagatgatggccaacagagtttgagtttatttgtcttctgctccgtcggtgatggatccttataaaactctcaggatccaacccggcgcctctgaatctgaggtcaaaaaggccttcaggcaacttgcccttcagtatcatccggacgtttgcagaggaagcaattggggggttcagtttcaaacgatcaatgaagcttatgatatattgatgagtagattgagaggagaaccgatggcagcataagtgtatgaggaagagatagttgagccaattgagaggaattggatctagattgggattttggggaag

SEQ ID NO: 1538 - DNA, 566 bp, Gossypium hirsutum
  Clone ID: uC-gsronu33B057c12b1
tcttttaccatttccattgatttttttaacggtggggtcaacttccttaaccctctcatgattcctctcaccggccgccgccatttcattatccagcaccaccaagctttcctctaaatcccttcctttaaagttctcctccgtttcttccctttccttcaacctccaccgccgccgcgttttaaaacccatttccttttccaccaaaacaacccaaatctccgccgctatctccggcggagataagcttcctgacgcaacactttcctacttcgattccgatggtgaactccaaaccacgacgatctcttcccttaccgccggcaaaaaagccgtcatcttcgctgtccccggtgcttttacccccacttgttcccagaaacaccttcctgggtttcgtgagaaatctggggaactcaaagccaaaggggttaacaccatcgcctgtgttcggagaacgatgcgttttgatgcgagttggaaggaaaatctaggtatcaaagatgaagacttttggtatcggatgggaatggggaatcactaagaaattgggtgtgaattggatt

SEQ ID NO: 1539 - DNA, 337 bp, Gossypium hirsutum
  Clone ID: uC-gsronu33B057d03b1
gtttatttcttctaggagttcaacatgcctagaaatcagtgagatgttaatgcaaggggaaggtcaataagaccgttttaagggtttgaattctacgatcgaggcttgccacaataacaacagcttccagttgatgcttggttctccgatcgaactggcttcttttgattacaaggaagatctaacaagctgttggggttgatacacatgccaaaacatgatgtttcaatctggttttgagtaacaaaagttaggacacaagtggtaatccctactaaggcctgccgacacatgcattatctaaaaaccttatgtttttatttttatttcaacttgg

SEQ ID NO: 1540 - DNA, 498 bp, Gossypium hirsutum
  Clone ID: uC-gsronu33B057d04b1
attttgtttaattgcattagctttttttgatcgtcatagggaaaaagcgccggggcgtgacctgagatcatcaaaacctaaacacgatcctttgatttccgaaatatgtggagaaggctactgacttcacaggtcacatatctggcaacacttacatgccgatccgcctctaaaacggcgccgcttccattcaaatctcacatttctccttgcccttatgcttccctcctaggtcggcatttctccgccgagtcagcggatactgctgtgaagaagagagttgaggatgtaatgcctatcgctacaggtcatgaacgagaggagcttgagtctgagcttcagggaaagaaaatccttgaagatgtaaacaaccctgttggtccttttggcacaaaggaagctcctgctgttgtcaagtcctactatgacaagagaatagttggatgcccaggaggtgaatgcgaggatgagcatgatgtcgcctggttttggcttgag

SEQ ID NO: 1541 - DNA, 407 bp, Gossypium hirsutum
  Clone ID: uC-gsronu33B057d05b1
ggttgtgttcgattcaaccatgaagaacataacagcgaggggctacttcaacaacaacggtcagaatctgaaccatcacttcgaaactgatagtgttgctcatgttggaactaatggctgctcttcttcttcctcttgatgctgctgtagatgatgatgatgatcagcttcattgttctttttttttttaatacctcatggggggtgggggagataataacctgtttagatatagagtaagggactttggttattagtttaaatttttgtttcctaattagtctaattaaggatcatcacggtggtgctaatatattaccctgggaattaagagctggtttgcaaatcaaaggggaatttgggttagaatcttaattcttttttgggatcataaacttccatgtttt

SEQ ID NO: 1542 - DNA, 535 bp, Gossypium hirsutum
  Clone ID: uC-gsronu33B057d08b1
ttcttcgcgtccgaccacgcgtccgaaagagtagcggggtttttagataaacccttgctaattctcttacactctctctcttctcttctccatctttactctcttctattatactttcgtttcgcttctcttcgatctctcgccattggattcgatcaatcggcttaagttgatcctggtgattgcttgtttcgattttctggttcaaaaaatgattgctgcagaaagtgtagtgccaaagcataagttgaagattaagttccccattctaaggattgaatcggtttctgcgccacaatcacttgagtttgggcagcaactgagcagctcttttgatgggaaaaggaagtcatatcctggcaattcaaaagaaacttatggtgcttctaagccgtcaccagaaggggtgataatgggtggtccacaagagaagaggcgaaagatggaccgcagcatgactcagcagtgtactacccctactgaatgcttttgatgaagcatcccaactggttggggttttcaatcaaccagggga

SEQ ID NO: 1543 - DNA, 529 bp, Gossypium hirsutum
  Clone ID: uC-gsronu33B057d09b1
ttttcgcgtccggaagatgctgattgtaaggagccggcatcatcaaaagatgaaaaggatggggatgcaagtgattgtaagaagcctcccccatcagaaaatggaaaaaatgctgatgctgatgatgccagtaccattcatgataaactaaatggtatggatggtaatgatgaaatcaacaataatgatgatgacgaggaaggcaaaatagaggcggaagatggcaaggagcagaactctaaaagtacggaactcatggaagcagcaacctagaatgcttctggcgcaacagattcttttgtaatggggatgttggtactaatgttaactaacatgatttcggttgaagttcagacctgtaaatagtgatgcagtcatagcgcaaaagttgttgccgtttgtgcttgacgaggtaaccttgggtcggtgtacagaaacaagggtagtattctgtccgttttgtgtagtaattgttttgtatcagagataggatttgcattttgaagaacttgggtataagcgcctctaa

SEQ ID NO: 1544 - DNA, 373 bp, Gossypium hirsutum
  Clone ID: uC-gsronu33B057d11b1
tctccttcgcgtccgctcggaggggatggcttgataggggtactgtgcaatgggttcaacctgttgatggatagagaaaaaggggtcattactttcgacagcttgaagaagaattcggccccgttggggttacaggacttgacagatgacgatttgaagtgtatgatggaagaaggtgattttgatggcgatggggctcttaatcagatggagttttgtgtgttgatgttcaggttgagccctgagttgatggaagcatctcggtttttgtttgaagaagcttttcaacatgaattcaaggattttcattgattgttcttgtttcatccataattgtcgttttaatgaaattgtttgatagacagagaattag

SEQ ID NO: 1545 - DNA, 536 bp, Gossypium hirsutum
  Clone ID: uC-gsronu33B057d12b1
tcgtcttcgcgtccgctccacgcaaatggccctgtttgtttgcgttttattccttctcctttcctctgcttctgcttgtgatcgctgcctgcaccagtccaaggctgcttatttctccaaagcctctgctctttcagcgggagcttgtggatacggttccttggctttaggtttaagtggtggacaccttgctgctggtgtttcttctctttacaaagatggagccggttgcggtgcctgcttccaggtttgtataattcagtttttattctttttttcttatgatggaagtttgagttttgatttttcttcatattttggtagataaggtgcaagaattcaactctgtgcagcagtgaagggactaggatcacactaactgatctcaatcataataatgaaacggaatttgttcttagcagcagagcattcatggcgatggctaacaaaggcatcggccgagacattttgaaacttgggattgtcgacgtggaatataaacagtaaacatgaattaaaaacatttcttcatctaa

SEQ ID NO: 1546 - DNA, 316 bp, Gossypium hirsutum
  Clone ID: uC-gsronu33B057e02b1
gatctttcgtgccctctgtaccggcgagaaagggggcggtcttagtggcaagccccttcactacaaaggctcctgtttccatcgtgagagccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgacggaaagcacgttgtgtttggacaagtt

SEQ ID NO: 1547 - DNA, 374 bp, Gossypium hirsutum
  Clone ID: uC-gsronu33B057e05b1
tcttaccttgcttcgctgtcggaaaaccacataaaacctggcttggtgaaaggcaaaagacacaaggcagaagaatgttcggagtggtattccccaaccgaagcttcccaatggacatctctagcttcacccaaattgataccttccattgggtgctcgatatgaacactttcgttggcgaatcctaccatcaaattggtgatatgtgcatcttcctcttgaacaacttcactttgcccccagataaggctttggctgtctacgtccagtcccctggttctcccttcgtttattgcggcgccggcactctttaacgtccctccgccgtgctttccctgatttggcctgagcctggagggcagatgcaggtgact

SEQ ID NO: 1548 - DNA, 542 bp, Gossypium hirsutum
  Clone ID: uC-gsronu33B057e08b1
gattgattttcagaaaacatggccttagagcataggagagagttatgaacatggctattgatgttgaaactgagttcccaaccattgagttacgttcatcggatttgaagcgaggaaccgaatggtggaaccgtttgagcaagatggttcaagaggcttgtgagactttcggttgtttcgatgtggcgcacaaaacgatatcatcaaaaatccgagaggatgcattcgaattgcagaaagaactagttgaggtcccactggagaggaaacacaacaacaccacacccttggcttggcatggcaggtgctgaccatgcaagcaggtcaacaatggtgtatgaaagctttggagaccaactaggcctccaactaagggttctgttaacaacgttaggtaaactgatggggcactaatggccagccacgcttgactgacactatacataccctagcgacgcaaatggaggagctgaacatgttaaattggttaatgctaactgatagttacggtttacaggaggattcactggagatgaactaca

SEQ ID NO: 1549 - DNA, 271 bp, Gossypium hirsutum
  Clone ID: uC-gsronu33B057e09b1
ttgaataaagaaagcagcaaaataacaggcctctgtgatgatttattttcaaggatggatgcttgcaaggtctataattatgtctctgtctgtcttgtgtaatagaagctttgtttgtggtaaaaataatgtataagccatttggttgggagcaaattttccttttgtccaaaggatttttgctgctcattcatggtgacttggtttatggttttaaaaaaaaaaaaataaatatatctaataataattattttatttaataaaaatttag

SEQ ID NO: 1550 - DNA, 550 bp, Gossypium hirsutum
  Clone ID: uC-gsronu33B057e10b1
tcccacgcgtccgcccacgcgtccgatttggagaaaaacatatcttgcgaggtgtgagcttcaagattaggcatggtgaagctgttggaattattggtccttccggcactgggaaatctacgattctgaagattattgctggacttcttgcaccagacaagggagaggtatatattcgaggcaaaaagagaatgggtttgattggtgatgatgagatatctggtcttcgaattggattggtttttcagagtgcagcactttttgattctttgaccgttggtgaaaatgttggtttccttttatacgaaaattcatgcatgtctgatgaacaaatttcacagctcgtgacggagaccttggctgctgttggtttaaagggagttgaagaaagattaccttctgagttgtccggaggaatgaagaaaagagttgctttagctcgttctataatttgtgacatctccaaagaatcaattgagccggaggtgcctttatatgacaaaccaacagctgggctcgatccaattgcatcgactgttgttgaagatct

SEQ ID NO: 1551 - DNA, 349 bp, Gossypium hirsutum
  Clone ID: uC-gsronu33B057e12b1
tcggctttgcgtccgtttaaacgtatgtgccgaagacagaaccactggacaaaagaacacattcaccatcacaaacgacaagggccgactctgcaaagaagaaattgaaaagatggctcaagaagcagagagatacaaatccgaagatgaagaacataaaaagacggtcgaggcaaagaatgcattggaaaactatgcatacaatatgaggaacacagtgaaggacgagaagattggtgctaaactcccagcagctgataaacagaagattggagatgctattgaacaagccattcaatggctagacagcaaccaactcgccgaagccgatgaatttgaagacaagatg

SEQ ID NO: 1552 - DNA, 542 bp, Gossypium hirsutum
  Clone ID: uC-gsronu33B057f03b1
attttctttcatgaaattcagaagcttttgtttttgcatcccaggatcaaagcaagaagattcagacagttcttctaacaaagcaaaatcccataaaaagtctgacaaatgtgggaaaaaggaagggaatgtggatgatgctgattatcagggtgccactactactactactacagccagtagtgatgctggaatggctgctgctgtagcaagtgggtgccactacagcacatgccctcgctgtggaatgaagtgtgtgcgaaggttgtcatgcaggtggtggtgttggcggctgatagccggacactatttcaaaaaatgctggtttaagttttgggcctttggcattcttcattatattgattttcaaatctttttttcattttcatgaaaagtgcttgtttttttattcttaaatttttggagctctttttttttccccgagtctaaatgtgcattgcgaaaactggtttttatttcagttgaaacggtaacaattctgtttctcgatatatttgaagatcatttgaaaaaaaaaaata

SEQ ID NO: 1553 - DNA, 117 bp, Gossypium hirsutum
  Clone ID: uC-gsronu33B057f07b1
tttgcctatgcgtccgtacgatttggtgtaagggttgggtgggtctactttatcctcacatggtgtgttgggttggtacgggtggtgtgatggctggtttgggataggttatataac

SEQ ID NO: 1554 - DNA, 296 bp, Gossypium hirsutum
  Clone ID: uC-gsronu33B057f08b1
tctctttaaaaaaattttcgtatttaaatagcaagtagggaggagtgacagaggatgagtttgtagtgtaggaattttcgaatataattgtcgttatggtggatctttggtggtgttcccgactttcgcttattgctgtctatggactttgcttgcctttagtaaaatccttgtgcgatagttaattcctatatgtctttgactatgaaattcttgactagaatatcggattcctcacacctttcatctcctttcctaccttccttcctctccttcatctctattggccgtccgct

SEQ ID NO: 1555 - DNA, 491 bp, Gossypium hirsutum
  Clone ID: uC-gsronu33B057f10b1
tttcccacgcgtccgcccacgcgtccgtagatgggcaattttgatggatagcagcccaaacaaatcgagcacgcaatggtgagctctatcgctatatagctgactcaaagggtatatttgttcagcctgcattctacgaagcctttggacttacggtggtggaagccatgacatgtggccttcctacgtttgccacattgcatggtggtcctgcagagattatcgaacatggtatatcagggttccatattgatccataccaccctgaccagaccgctgaactcctggcaactttctttgaacgttgcaaggaggacccaagccactggactaaaatatctgatggagggcttaagaggatttatgaaaggtatacatggaaaatttattctgaaaggctgatgacattggctggagtatatggttttctggaagtacgtttcaaaacttcggagacgtgagaccccaagatatcttgaaatgttctacat

SEQ ID NO: 1556 - DNA, 287 bp, Gossypium hirsutum
  Clone ID: uC-gsronu33B057f11b1
tcttttatgcgagggtgatgaggaaggtgaagatgagtgctaaataagtaatgtttgagtgtagggctcgcattttgctacccaatgatttgtttccttttatcgtgtgtttttgcttattctattgtgtgaacttcgactcttctaagctttgttcaagactatatggactgcaatagatttgacgagtagttcggctctctaaaatataaaaaaaaatctttattaaaaattatttttcaataacctactataaataatcaatatttggctctctttttaatttg

SEQ ID NO: 1557 - DNA, 462 bp, Gossypium hirsutum
  Clone ID: uC-gsronu33B057f12b1
ttttccacgcgtccgcccacgcgtccgcccacgcgtgcggcgagtggcgcgtcagttcggttactacaacataagggagtactctaaacgttggaccatggatgcgtttcgagacaacaagaacttacgcgacccttctcagctgtccgccgctttctccaacggtaaagctcagttggaagttgccaaaagacaatctctcctctattccctctatgctccaaaggtcaaaagcatcatggatttttaaaccctcttcttaaccatatacatacttatatcactatttctagctccttcagaaaagaataaactttgatttattgagagaataaattgagttcttttagcgcatgattttatttatttatttttgtagttatgtaataaacagtctgggatggcatgtgggaatttgctaatggggttcttttttattttatgcttttccttcttcttgtt

SEQ ID NO: 1558 - DNA, 316 bp, Gossypium hirsutum
  Clone ID: uC-gsronu33B057g02b1
cctttgtttttcaaggcctttactgttgcagctacggggggttggaccacggctgcacctaatgtagccaagaggattgaggtcgaagccattcctagctctggaacgatcgtcatgataaactttgttgaagggctgccattttaatatatgaagcacgagataggaggacatgttgtaaattatattttcatacagctacccagtaattgaaggaggtcctttggggaactaactcgaaaaaataagctttgagaacaagtttgaggttgctgcatgtggaggaagtattcgcaagagttcaatgaaattctta

SEQ ID NO: 1559 - DNA, 343 bp, Gossypium hirsutum
  Clone ID: uC-gsronu33B057g03b1
ggttgagataccagatgtgacatataatgatgttggtggatgtaaggaacagattgaaaagatgcgagaagttgttgaattacccatgcttcatccagagaaatttgtgaagcttggaatcgatcctcctaagggtgttctttgctatggtcctcctggaactggcaagacacttcttgctagagctgttgcaaacagaactgatgcttgcttcattcgtgttattggaagtgagctggttcagaagtatgttggtgaaggagctagaatggttcgagagttgtttcagatggcacgttcaaaaaaagcgcgcattgtgttctttgatgaagatgattgcatt

SEQ ID NO: 1560 - DNA, 259 bp, Gossypium hirsutum
  Clone ID: uC-gsronu33B057g07b1
gagaaacagaagcacggcctgaaccagggaggtttttttagggaggctgcgacctttactctggacgacgtttggaatcataacggctatgctaaacagtattctggttcgctatggaacaccgttgcgacctgtcaggctaatgactctgccattgttggccccgactacgagaaatatgagcgacgtctccgatcatcatctatgcttttcttgatatcaaggttacgacgaggctcctcagatatatgacccagct

SEQ ID NO: 1561 - DNA, 572 bp, Gossypium hirsutum
  Clone ID: uC-gsronu33B057g08b1
ttttcttgttagaggggagggaaaaaaagaaatgggtggagtgagatggtttgtcggggttttatttctaagcactttgctcctttgcagtgctgatgtacatcactatgaattctttgtgcgagagtcaaaatttaagaagatgtgcaacacatcgactttgctggtcgtaaataatagttatccagggcctgagattcgggttcacagaggtgacactgtcttcgttaatgtccccaaccagatgcttatgctatcaatggacatttaggagacacatatggatgcccaactgatacaatattccgcatggaagttgattataagaagacataccttctccgcataatcaatgctgctgcttcattttcactcccatttggatctgtgctatcatctttaaaaaaattttcgtatttaaatagcaagtacggaggagggacagaggatgagttcgttgtgtacgaattctcgaatataattgttgttatggtgattatgggatgttttattggtcatattctgactccagcttcaagattatgcttaaattggacctttaaacgttgctt

SEQ ID NO: 1562 - DNA, 101 bp, Gossypium hirsutum
  Clone ID: uC-gsronu33B057g09b1
ttgtatataaacttaagtaacaacttggaatggtgtgggtagtgttgcatttgcacccagaattattaacatgcgatgatgggtgttaaattgctgggtct

SEQ ID NO: 1563 - DNA, 528 bp, Gossypium hirsutum
  Clone ID: uC-gsronu33B057g10b1
ttccacgcgtccgcaaaagaatagtccccccttaaaaatttaccaaaacagaaaacccagatcataaaaagctccctaaaatgttgagtgagacattgaagaacaagtaccaattatgtgaagagatcggaagagggcggtttggggttatctctcgagtgttttgccctttaaccgaatcctccttcgcctgtaaatccattgacaaacgccttctttccgaccccaccgatcgagaatgtctggagaacgaacccaaagtcatgacccttttgtctcctcactccaacatcgttcaaatctacgacatgtttgaatccgatgatacccttcaactcatcattgatctctgccagccttttaccctctacgacaagattctggaacccgatatgtttgaacctaaagccgcggcttacatgcaacagcttatgttgggtttggctcattgtcacaggtttgggatcgttcatagagatattaaacctgataacactttgttcgactttagaggtaaatttgagattg

SEQ ID NO: 1564 - DNA, 391 bp, Gossypium hirsutum
  Clone ID: uC-gsronu33B057h01b1
atttctatttctctttccctctctctaatgacgctgagctctggaggatcgagtgtcgtggtgcctcggaatttccgattgctggaggagcttgaacgtggagaaaaaggtatcggagatggtactgtcagctatggaatggatgactgagatgatatttacatgcgctcttggaccggcaccattatcggtcctctcaataccgtacatgaaggtcgaatctatcagctgaagctattctgcgataaagattatccggagaagccaccgagtgtccgttttcattcaaggatcaacatggcttgtgttaaccatgacacagggctggtcgattaaagaagttcggacttcttgcaaattggcgaagggagtatactatggaggatatatt

SEQ ID NO: 1565 - DNA, 492 bp, Gossypium hirsutum
  Clone ID: uC-gsronu33B057h03b1
attatgggtatattggagatgctatttcccaaatacgcaggcattaatttatgttggtgatgcaagtgacacaagaaattattcgctctgctattgactttaagagggacccatggcctaaggtttctgacaatgcaaaggaccttgtaaagaaaatgcttaatcctgatccaaagcagcatcttacagtacaggaagtgcttgaacatccatggctacaaaatgccaagaaagcacccaacgttctgttgggcgagactgtgaaagctagggtcaaacaattttctataatgtacaagctgaagaagagagctctaagggtgaagagaccagaccttctggttggtcttcagcagatcctacacacaggaggcattctggcctgattgcaaattctagaagtttagctaaacaaaaaggtccagtagataatgatctttttgctgctaaagatcctatggtgataaatagaattaatttgattttggattt

SEQ ID NO: 1566 - DNA, 379 bp, Gossypium hirsutum
  Clone ID: uC-gsronu33B057h07b1
ttgatttgccatacaaaaccgtgactttgcatgggttgcataatttgactgtgctgatagtttccaattccatgcagtctgcttggatacgttgccacccatattctacatgaatgatacatgttacaggataatcagctatgttgagaagtgcaatcgttctgaaggaacccctcaggtggcatatacatttgacgctgggccgaatgcagttttaattgcacgagatagaaaggcagctgctcaattaattcagcggctgctattctacttccctacaaagtctgatactgaactggacagctaccttctcggtgaatagacgatacttaaagatgctgtactcgaaggattgaaggatgtggaagctttgtcccca

SEQ ID NO: 1567 - DNA, 504 bp, Gossypium hirsutum
  Clone ID: uC-gsronu33B057h09b1
tttgttttgagagagtaacagagggaaagcttaggcgggggttgttcgaagaggacagtggtgagttctaccttcgctactacgtggtccacaaagggaaattcgggcacgagtttttggagttcgagttcaggccagatgggaagcgttcgatacgctaacatctccaactacaaaaacgacaccatgatcctgaaagaggtcttcctcactcctttcgttcttaaggaatgccgacgcatcatcgccgacagcgagataatgaaggaagatgataacaattggtcagaaccagaccgtgttgggcggcaagagcttgagatagtgatggggaatgagcacatttctttcacagcttcaaagattgggtccattgttgatgttcagagcagtatggatcctgaaggtcttcgcatatttcattatctggctcaggattcgaagcgccttgtattgtctcttatctcactccactttaagaacaagcctatttgaagaatgaat

SEQ ID NO: 1568 - DNA, 268 bp, Gossypium hirsutum
  Clone ID: uC-gsronu33B057h11b1
atccaaaatataaagatccctcattcgggaggctttaaatgcatagcgcggctttttataacgactactgtaccctacttgctcatagtgcagatcatggagcaatggttgggtatacaggcttaactgtttggacctgaaatggcatacaaggctacattccattcaattgtattcccgagaatgcataacaaggttttgacttcagacaggattgggggcaaggttgctcttttttacttaatcagacaacttttttgaaccccaa

SEQ ID NO: 1569 - DNA, 398 bp, Gossypium hirsutum
  Clone ID: uC-gsronu33B058a02b1
ttcattcgtccgattatcgtgagggatcaaagccgggtttactataatagagatggcttttgctcttgcagggattactggtaaattgtaccctgaacacctgataagagcagattcaaaatgccgttaggaggatgatcgaacaattgcatgcctggtacctagtcacggctgctgcaaaattagcttcacgggtgatctggactttccatggagattgcatcatagctgaaaactattatccttaagagagctttatgaaattaccttgcctacaatttttctcaatttttaattttctttaccaccattattttattttattttcattaatccattcccaaaccatacaagagtaagaaggcagattaaatcaagaattatttatcatcttaaaa

SEQ ID NO: 1570 - DNA, 440 bp, Gossypium hirsutum
  Clone ID: uC-gsronu33B058a03b1
ttattttgtgaagaagagggtcaagaagttgaagggactctcttagcgaccgcatttttttcgtcaagacaaactggcgtagaccaaagggtattgattctcgtgtcagaagaaagttcaagggatgtactttgatgcccaatattggctatggttcagacaagaagacccgacactatcttccaaatggctttaagaaatttgtcgtgcacaatgtcggagagcttgaactgttaatgatgcacaacaggacatattgtgccgagattgcccatgatgtttcaacaaagaagagaaaggagattgtggaacgggcagtccagcttgatgttgacgttatgaacaagcttgctaggctgcgcagccaagaagatgaatgagattaagcttgtcttttatgatcatttttgagctttgtttgcgtttcttataaatttttg

SEQ ID NO: 1571 - DNA, 384 bp, Gossypium hirsutum
  Clone ID: uC-gsronu33B058a05b1
ttcattttctcgaaaaaaaaaaatgtcttcagggtgcttttgtggatctaactgccgctgctgcgacaactgctcatgcagcaggaaccttaaccttggatattcggagaagacaaccagcactcataccatcatctccggagttgcgccagtgaagatgacctttgagggaccagagatgagcactactgaatcaggacatggatgcaagtgtggatcaaactggtcttgtgatccatgcaactgttgaaaagcttgatgaaagccatagattaataaaagaagaatgcaggaaaaataacaggcctctgggcatgaatactggcaaggatgggtggctgcaaggcatataataatgactctgcctgtgtcttgcgtaataga

SEQ ID NO: 1572 - DNA, 327 bp, Gossypium hirsutum
  Clone ID: uC-gsronu33B058a06b1
tttgtttgaaatggagggaagcaaaatgagcgtgattttgattgcctacatcacacttgttgcgagcggagcgatgggtttgagggaggaccaaggagcggctgcaccctcaccaatggaaagtggcggagtggctctgggtgttccggccgcacttgctgctgacttagcttctatgcttgcatttggctgcttattttgattttaattcctttggtgaatactgttttccaatttccatttcctttcatttgccaactagtttctttctctgtaaatttcattggtatttttaagaaattgaataaaatcttgatttatttcaaa

SEQ ID NO: 1573 - DNA, 441 bp, Gossypium hirsutum
  Clone ID: uC-gsronu33B058a07b1
ttggtttggtcaatacttttagcatcgattttctgtcttttgtgggctcgagtcaacccctttatatcgaaaggaggcattgttttagaagtgtgtgggttgaactgtgactaaaaataaattgtagaagaaaaaccaaaggagtagaattagatgttcagtgttcaaagcaagcaaggctgtctgaaaattgcataaatcggctacgattttggtcaaagatgaagacatctcccaattcaacatggttgccctcaaggtgaggaaaagaggaaaacgtgttggaaggtgtttgtagatacatatatatatacaaaactgtgatccaatatttgtcagtgttttcctccgttttgattctttctatacttttgtgggttttgtgggttagaagttattgatttcataaagtcttttgtattatctcttaagagaagagac

SEQ ID NO: 1574 - DNA, 441 bp, Gossypium hirsutum
  Clone ID: uC-gsronu33B058a08b1
tcgtttcacgcgtccgcccacgcgtccgcttctttttccttcatagcttccagacaggtccagggaatgcagaaagatgtgcttgcatgctgtgaactttttatctgaagcacataaagttgtatccggttctgaattacccgcattcattcccgatgatgttggatgctcaacagacagtaaattcattccctgtatccatattgtaaatagagttgaaagtaaaatctctgccatgttgaagggtgacctcgttgaagacggttgagcactccggttatagccactcctgctctttagatgttatacatatatatagttactgcaggagataaaaaattatctaagggtgttaagatttgaactttagaatggaaaataaagggaaggtgttgatgcataagtatgaattcggaagattgttaggacaaggaaactttg

SEQ ID NO: 1575 - DNA, 438 bp, Gossypium hirsutum
  Clone ID: uC-gsronu33B058a09b1
ttgttcgtccaaaaaggagtggcactttggctgaatattctgttgccgaagagaatctattggctctcaaaccaaaaaatctgggtttcattgaagctgctgccattcccttagccattggaactgcctatgaaggccttcaaaaaactgccttgtctcctggtaaatccatcctagttttaggcggtgctggtggggttggcaccatggttattcagctagctaagcatgtctttggagcatctaaagttgcagctacctcaagctcagccaaactggaattgctaaagagcttgggtgctgatttagccattgattacaccaaagacaactttgaagatttgccagagaaatttgatgtaatatatgatgcaattgggcaatctgaaagggcagtgaaggctatcaaagaaggtggaaaggttgtaacaatagaac

SEQ ID NO: 1576 - DNA, 449 bp, Gossypium hirsutum
  Clone ID: uC-gsronu33B058a10b1
ttcttgaattcttttattatagctactaagactggtagtgctgaggtttttgtgtttgattatagcaaacatccttcgaaaccgcctttggatggggcttgtagtcctgatttgagacttaggggtcatagtactgaaggttatggtttgtcttggagtaagtttaaagaaggtcatttgcttagtggttctgatgatgctcagatttgtttatgggatgttaatgctactcccaagaacaaagctcttgatgctatgcagatctttaaggttcatgaaggtgttgttgaagatgttgcctggcatctcaggcatgaatacttgtttgggtctgttggggatgaccaatatttacttatttgggacttgagaaccccttctgttaccaagcctatccaatctgtagttgcttaccagagtgaggtcaactgcttagctttcaatccctt

SEQ ID NO: 1577 - DNA, 294 bp, Gossypium hirsutum
  Clone ID: uC-gsronu33B058a11b1
ttcgtgtaatatctttgaaaatctctacctggggctgaattttaagggctctcttttttcctccccagaaaaaaaagcttaaacaaaaaaatggagaataataacaaccaggtcacgggagagttgaagtctgggaataagaagcaagttcgattgtcctactgtatggagtgtgaagagcttgcccgtaaagatgctgcttactcccaactcattacccttcaatgtatcaactggaggagcttcgatgatggattaccaaatctttgtataaacaattgcacctgatatccg

SEQ ID NO: 1578 - DNA, 379 bp, Gossypium hirsutum
  Clone ID: uC-gsronu33B058a12b1
tctttttatgagctctcgtgtttgcctattgaatgctttccctcactttctcgaaaaaaaaaatgtcttcaggttgcaattgcggatctaactgcagctgcggtgacaactgctcatgcagtaggaaccttaaccttggatattcggagaagacaaccagcactcagaccatcatatccggagttgcgccagagaagatgacctttgagggaccagagatgagcactactgaatcaggacatggatgcaagtgtggaacaaactgctcttgtgatccatgccacttgttgaaagcttgatgaaagccatagattctgttctttagaaaggccgcaaaaataaccggccctctgaatgatatattggcaaggatggatgc

SEQ ID NO: 1579 - DNA, 165 bp, Gossypium hirsutum
  Clone ID: uC-gsronu33B058b04b1
ttgactaatgggtgggaggcaagattccccaaaaaggaatcattggagccaaggtagactacaagcaaattcttttatgtaactaagaaagtattatatatgctatgtatcctaaattgagatcctgcaaaagacttttttgtagtattatgtaacaagttcaag

SEQ ID NO: 1580 - DNA, 396 bp, Gossypium hirsutum
  Clone ID: uC-gsronu33B058b05b1
cgtccgtgaatatcagaccattcctctgaataagattgaagactttggtgtgctctgtaaacagtattatgcattggacatcacttatttcaagtcctcacttgattgtcacctcctggatctgttatggaataagtactgggtaaacaccctttcttcttcacctttcttgggtaatggagattatgttgcaggacaaatttcagatttagctgaaaagctggagcaagcagagaaccaactggctcactctcgcattggcccactaggaccccctcgaaagaagttgcaggaagaatctcagcttgcttagaatactagagatagtgcaaagataactgtggagcaagtccatggtttaatgtcacaggtcaataaaaacatttttttaacttt

SEQ ID NO: 1581 - DNA, 237 bp, Gossypium hirsutum
  Clone ID: uC-gsronu33B058b06b1
ttgtctcgtgggtttgaatgagaatgttgtgggctgtataccccattgccgcttctcttttttattcgttatgtggttttcttgataatttagtattatagatttactactatctgatttattctccccttagcttgtaaaagtaatcaatgtttagatttttcgtttctcggtgtttatgtttgatatatttgaacaaaaagtgtaagatgtgcttatgtttaaaaataaaattat

SEQ ID NO: 1582 - DNA, 244 bp, Gossypium hirsutum
  Clone ID: uC-gsronu33B058b08b1
tccaaaaatccaccgacgaggacaggcccgagggaaaatttattgagccatcgaatatctaaagcaagcaactttgggtatgggaagccgaggtctagaaactgttcaaaggaactaaaagtacaacgacctggaaaagaaagtcaaatttcctttgcgtaatgatcagaacggcttctgaatctggaatgaataacgaagttcaaattttatgggcagaatgaacttgggtaacgcgagccac

SEQ ID NO: 1583 - DNA, 434 bp, Gossypium hirsutum
  Clone ID: uC-gsronu33B058b10b1
ttcacgcgtccgatgaagctcatggagcataggtacggagccaaggatttcgtgacaagcaaagactgtagccttttgtctcccggaacatactacctcaccgaagttgattccatgtaccggagattctacgcaaagaaagacggggactttgctgcttgcgataatggttccggtgccaacggtcattagcggacagatttatcatgcccccaatgcaatgaagaaagcatttgtgttagatgtgtttgtgagtaccaaaatactgggttcctgtgtatgttaaaaaagcaaaaatagtttgattcagcatcaatttcagcttaagttttctttttattttatcttgtaataagttatttttctagagccagttatgttaaaacccagagctagtttgcaatctctttgatgataatataagatatttttat

SEQ ID NO: 1584 - DNA, 443 bp, Gossypium hirsutum
  Clone ID: uC-gsronu33B058b12b1
tcgttctgctcggcgacgatctgatcgtctgggtgtgtctgattaacaccaacttcaatcaaaatcaatggctgcaatcttcgctcgtaactctctcaacgctctccgagctcgacaccttgctgtgtcagggcaagtgttgcagggttcacagcactacgggttgcgactcagttcacgctcatatggcacgcagaaagatgatgaagaaagagagcagcttgcaaaggagatttcaaaggactggagttctgttttcgagagaagcataaacacactgtttctaactgaaatggttcggggtctcatgctgacactcaaatacttctttgaaagaaaagttactattaactatccatttgagaagggtccattgagccctcgttttcgaggggagcatgctctccgccgatatccaactggagaggaacgttgcattgcct

SEQ ID NO: 1585 - DNA, 441 bp, Gossypium hirsutum
  Clone ID: uC-gsronu33B058c01b1
tttatgttctcttgcttgtttcttcactgtcaagaattttgtgatcccgcgttttcttcattttctcagatctttgttatagaagaaaaaactgctgctaacaatgactttggctaatggcgaagctcatcaagtgactaacaatggcgatttaagcaaacccttcaaaatctttgtcggttacgatccgcgtgaagatctagcctatgaggtctgccgccattctatcttgaaacgttcatcggtttcctgacgagatcacttcccattgtttcaatcagatcctccggcaaaaaggccctttactggcgccgagcggaacaagcttgagagtaccgagttcttgttttcccggttgctgactccctacttggcgaataacaagggttgggcgctgtgcattgacggtgacttcctttacttagctgatataaaggaatt

SEQ ID NO: 1586 - DNA, 435 bp, Gossypium hirsutum
  Clone ID: uC-gsronu33B058c04b1
gttgacgtaccctctcgagttgctcaaagctcgtttaactgtcaatgaagattacaagaatctattggacgcggttgcgaaaattgtacaggcggaaggaccgggaggactatacaaaggcctcactccaagtgtgatgggagttgttccttatgctgcctctaattattttgcttatgatacactaagaaatgcttataaaaaagcttttaagaaagaggaaattgggaatgttatgactcttctaataggatcagcggccggtgcgatcttgagcacggcaacttaccctctcgaggtggctcggaagcagatgcaggctggtgctattaatggaagacaatgccacagcatgattcaagcattaacaagcatagttgagaaagaggggatggcagggctttatagagggttgggaccaagctgctgaaattg

SEQ ID NO: 1587 - DNA, 446 bp, Gossypium hirsutum
  Clone ID: uC-gsronu33B058c05b1
tttatttcgtacgcgatgctttccacggcgatgagagatttgttggaatccaaaatggttctactatagtgctgtggcattggaacatgggagataaccagatatggaagattgtaccatattgaggcttgtaatatggtgctgctagttctacattgaagctctatcattcctgcggttgaaggttccctactcattatctttgtgaggtttttttcgagtgtttttcataccaagtgtcatgaaaatttttgatgggtcgagaggcctactaaatatttataccagtagtaaagaagagctattgcagagtttctatggctgcaaaatttggataaaatagtttctctattatacatacttgtaagattagcattgcatttcaatttttattttcggggatttcctggactcatctaagcattaccataccgtttgcaaaaatc

SEQ ID NO: 1588 - DNA, 433 bp, Gossypium hirsutum
  Clone ID: uC-gsronu33B058c06b1
tccacgcgtccgattttcttaagaaagaacaactttcagcggtaacagccgcttcctccaacatggctagagggttgaagaaacacttgaagaggctcaatgcccccaggcattggatgctcgacaagcttggtggtgcattcgcgcccaagccatcgtctggaccccacaagtcgagggaatgtttgccacttattcttattctgcgaaacagactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtctcctttatgacactaaaggtcgtttccgccttcatgccatcactggtgatgagactaagtttaagctctg

SEQ ID NO: 1589 - DNA, 435 bp, Gossypium hirsutum
  Clone ID: uC-gsronu33B058c08b1
tctttcctcatccccaaagtccccgacttctttactttctgttcaacaattaaaggttcctgttggtggcaaggcgccaactggtggtattgcagtgagacatgtccgtcggtctcactcagggaaatccattcgtgtaaagaaggatggtgctggtggtaagggtacatggggaaaacttcttgatactgacggggaatcacatatagatcgaaatgatcctaactatgacagtggagaggaaccatatcaacttgttgggtcaactatttctgatccactagatgagtataaaaaagctgttgtttcgattatagaagaatattttagcactagtgatgtggaagtggcttgattagacctcaaagatcttgggctaagtgaatatcatccttaatttattaaaaggcttgtcttcatggccctggacaggca

SEQ ID NO: 1590 - DNA, 439 bp, Gossypium hirsutum
  Clone ID: uC-gsronu33B058c10b1
tcgttaaattcccaaagcgatacttaattgtgcttgtatcctttgtcagcacatgcgtatgttatatagaacgtgtgggtttttccatagcatacacagttgcagctgatgctgctgggattaaccaatcaagcaaagggacaatactatcaacattctattacggttatgcttgttctcaggtacctgggggatgggcggctcaaaagatcgggggaaggcaggatcttcttctctcattcgttttatggtcatcaacttgttttttggttccattagatcccaatagagtcactatgttggttgttgctcgcttgcttgttggtgtggcacaaggtttcatgttcccttctattcacactgtcctagcacagtgggtaccaccacatgaaaggtcaagatctgtttcgttacaacttcagtgatgtacctaggtgca

SEQ ID NO: 1591 - DNA, 413 bp, Gossypium hirsutum
  Clone ID: uC-gsronu33B058c12b1
tcgtttacgcgtccgcccacgcgtccggccatgctgataaattaaagaaaattagcgaattttactcttactttatttgacatcaggtccaaaaaaaaattgatacatgatacgccttataaattacgagaaaaaaattataaaaaaaattaaaactaaatatcggtaagggtgagaaaaaaaatctagaaaatcaatttaaattatagcatttgatttgatttctattggtatttattaaatttgattaagttttaatttagcttgtatttagaagtatttatttggtttaattttctgttcttaagtaaaaatataaatttttctgattgtatctttacaaggccttcttctttgttgatatttttgaatggctgagtcacatatctctctgccaatttggttgtcaattt

SEQ ID NO: 1592 - DNA, 443 bp, Gossypium hirsutum
  Clone ID: uC-gsronu33B058d01b1
gttatatgcctcccccgatgctctccctctctcgtgactccaagctccattacatgcgcgatattattcttcgttactctcctgaaggcgaacgtactcgcgttcaaaagcagcgagaatacaggcaaaagattatatcacactatcagcctctacaaagggaactgtatgccatgcatgcctcaaacttctttgcgccctcatttctcaaagcaattaatgagaataaaggggaaagttttagaagtataatggctgaacctactcaaggagtttttacatttgaaatgcttcagccccatttctgtgaattgttgttatctgaggttctgattgcttaggtagaaaacttcgaaaaatgggtccacgagacaaaattcagaatcatgcgaccgaacacaatggacaaatttggtgctgttttagatgactttggtctggaa

SEQ ID NO: 1593 - DNA, 440 bp, Gossypium hirsutum
  Clone ID: uC-gsronu33B058d04b1
atcgtttatggctaccgaagaggaatcgatagaacaagtcttttgcgtcacgtcgtgagttgcttaaagctcttaaagcagctcaggagctgttgaatgccccagatgaagattcttctcaagctgctgagaatcaaacggatgatactaatgaagaaaataaccccagtatgaagtttcgaaattatgtacctcatgataaacagcttcaggagggaaaggttgctcccccagtgctgccgaaatttgaagaccctgttgcagcagaacctccagcatctgaagaaaaagaggatccatttgtcaacattgctcccaagaaaccgaactgggatcttcgaagggatgtgcagaagaagctcgataagcttgaaaggcgcacacagaaggctattttcaaacttatggagcaacaagaacaagaaaaacagttagatgaa

SEQ ID NO: 1594 - DNA, 442 bp, Gossypium hirsutum
  Clone ID: uC-gsronu33B058d06b1
tcattcgtccgccagtgctatgagaggccaaaacaacggttttgtaaggggatttgcttcgccagataggggtgcgcacgataagagagttggtggtaacaaccataacaataacaaccaccaccaccaccaccaccaccacaacaaatctgcggcatcttcggatatgacccatgacagcaaaaaaggaggctcatcttcaggaagcggtgaggcagctccacccatcgtttggccaccaaaatttgtgattgctttaactaataaagagaaagaagaagatttcatggccattaaaggatctaagctgccgcagagacccaaaaaacgagcgaaatttattcaacgtaccctcaacctggtaagtccgggggcatggctatgcgatttaacacttgaacgatacgaggtcagggagaagaagatctcaaagaaggtaaca

SEQ ID NO: 1595 - DNA, 315 bp, Gossypium hirsutum
  unsure (1)..(315): unsure at all n locations
  Clone ID: uC-gsronu33B058d08b1
ngtcatacccccgaaccaactatcaatcatgaggggtattttaaaaaacacaccattaattcacccctccctttatttgcattactctcacttctcctgtatgtagacaccatcgccccagctaggaaagatgctggagagaactgaggagctgtaaccaaagatcaacctatgcctgaggcactccaagagcttgatcggatcgaggctcccgttgtcagcccccatgagaaaaccaagtgccatacatcaggtaatattgagcttaaggaagagaagattattgctaacgaggagttcgaaccaaggccaaac

SEQ ID NO: 1596 - DNA, 443 bp, Gossypium hirsutum
  Clone ID: uC-gsronu33B058d10b1
tcgttaacatttccttagagcataaaagaaaagttacgaacatgccgggtgtcaatcctgaaattgagttcccagccattgagtttcgtttatcggatttgaagcgaggaactgaaggatggaaccgtttgtgcaagagggttcaagaggcttgtgagactttcggttgtttcgaggtggtatatgaaaaggtatcgactaaactccgagaggatgcgtttgggttgatgaaagaaatggttgagctcccagtggagacgaaacagaagaataatagtcccatgccttaccatggttgggttggaccatgcaagcaggtttctgtgttgtatgaaggctttggagttggagatgcctccaactatgactctgttaaaagttttgctcaacttatgtggcctaatggtcacccacacttttctgacactattcataccctaggg

SEQ ID NO: 1597 - DNA, 445 bp, Gossypium hirsutum
  Clone ID: uC-gsronu33B058d11b1
ttcgtcattatttcctttcttcgagttttctctggttgctttcgacacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaagcccaactcaaagctattatcgctgaagagaagctcacggcgccctttgacttccctcgctttttagatctcatgtccaagcatatgaaacctgagcccttcgataggcagctacgcgatgctttcaaggttctggataaggacaatactggctttgtctccgttgcagatctgagacatatactgactagcatcggagagaagctggagccctcggagttcgatgagtggatcaggg

SEQ ID NO: 1598 - DNA, 318 bp, Gossypium hirsutum
  Clone ID: uC-gsronu33B058e02b1
tataaaaaaaaagagagtgtgaggacagagcgatttccggtgggactccggccaagggtccgtgccaccggagcctcgctggcgccggcgccggccactgtacacggtggccgtagaggtggagcagtccggtgacagagggtaagtagggagagttggtggccatggcatgggtgttgcggcgctgaggtgactccgttgatgggggtaggtgggtaggttcggcgcatgtgggaaggttagggtttcagtttctgaaaccctaagtctatagttgggcttctgagtttgggttgagtatatgggtataggttactt

SEQ ID NO: 1599 - DNA, 437 bp, Gossypium hirsutum
  Clone ID: uC-gsronu33B058e03b1
ctcttttgttcttatctcttggactgccgccttcggtctcatcgaacttgcctgagcctctttggtacattcttatgacaccaatattgtgtttggagcttaaaatctacggacagtggatgtcgggtggtcaaaggaggctttcgaaagtggctaacccttcgaaccatctcgcaatcgtcgggaactttgttggggcattgttgggtgcatcaatggggcttaaagaagggcctatatttttctttgctgttggactggctcattatttagtcctttttgtaacactttatcaaaggcttccaacaaatgaaacactcccaaaagagctccatcctgtattcttcctttttgttgcagcaccgagtgttgcttcgatggcatgggctaaaatccgaggctccttcgattacggatcacggatagcttacttcatt

SEQ ID NO: 1600 - DNA, 438 bp, Gossypium hirsutum
  Clone ID: uC-gsronu33B058e05b1
gtatttcataactcctcaaaactcttcttcaagggcgtatttagaccttgttttggctttaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagaggttcccggccgggaccgactcgtcttataagaccatcaaggtccagctttgctatgcacccatcagccaagttgaccgtgcatggcggaaaaccgaggaccatcttaacaaagacaagacatgccagttcaagatagtcaagaaaccctacatcaacgtcaacgaaacccttgaatggaccatcgaaagagacgtgccgacggtgacgttctttatccgagccta

SEQ ID NO: 1601 - DNA, 281 bp, Gossypium hirsutum
  Clone ID: uC-gsronu33B058e06b1
tttttgtgaatcagatgattgaagactgcgagccatttgttggagagcctctcttggttgccaagtgctttaagtgaatatgtcttggttttatgttgcttgctactgttctgcctgacagggttctctatacggtcagttttttcaggttcggacttatttttcttttctcccctttttgagtctggttcagccaacattacaattaagttttaagttctcagatgttgattatggaacgcgttatttatgttattaaggaggtatggtttttgtttttt

SEQ ID NO: 1602 - DNA, 444 bp, Gossypium hirsutum
  Clone ID: uC-gsronu33B058e10b1
tcgtttccgcgtccgcccacgcgtccggccatccgaatacccaccgtgtcgtttcccttaccctgttctccgatgatcgtctcaccggccaaatcccccctgaagttggcgaccttccgtaccttgaaacccttcttttcagacacctccctaacctcaatggaaccatacaacccgccattgccaagctcaagaacctcaagacgcttcgcttgagctggaccaatctttccggtccagtccctaattttcttagccaacttaagaacttgacttacttggacctttcatttaataacctctcgggatctattccaagctccctttcaacactcccaaatctcgaggctttgcatttggatagaaacaagttaactggtaccataccagaatcttttggtatgtttcctagcaaaaacctgtatttgttcatcttgtctcaca

SEQ ID NO: 1603 - DNA, 265 bp, Gossypium hirsutum
  Clone ID: uC-gsronu33B058f02b1
tttttcaagtggttcgatcactaaagaagagctcaactgagtcagctggagcttttgttagcagagtgacgcgagtcaagtctcctgttgtgctgtgctccgagggtcccatttccatgcttgttgaatgctttagcccttgaaataagtgtgtaacatgatcggatttttgttctttatgtccgattttctgtttatggatttcaagtatccattccttgttgtaaaatatatgacgtattaaaatctacggtacttttgattg

SEQ ID NO: 1604 - DNA, 446 bp, Gossypium hirsutum
  Clone ID: uC-gsronu33B058f03b1
tgtaatattgtttgtaatgaagactgtatctgttggaaggcggaggttcagtgcaagctatcatcttgttttccggctcatcaagggattaatattcttgacatttgtgtccattctggttattttggtcacacttgctcatatgacaattcaagacattatagtgtgtatttttatcttcatgcctacgggttggggaatgctcctgattgctcaggctttgaggcctgttgttaagaaagctggcttctggggatcagttcgaacacttgctcgtggatatgagattgtaatgggcttgcttcttttcactcctgttgcattcctttgcctggtttccattttgtctctgagtttcaaactcgaatgcttttcaaccaagcattcagcacaggtctgcagattttcacgtattctaagccgccaccgttaagatcgcacatttt

SEQ ID NO: 1605 - DNA, 238 bp, Gossypium hirsutum
  Clone ID: uC-gsronu33B058f04b1
tcctttcgtccggcttttgtacatgaggatacttgtaacattcggcagttcacttgagaattgtaagaccttgtttttgctgcatgcattgcttgtagcaaatgaaaatgattccccaacataaattttacagaacaaactttaagcagaaccggtccaagcttttcatgaagatttgtcagatagcgaaattcatctggttttcgtattataatcttaaatatgttgtatttatatt

SEQ ID NO: 1606 - DNA, 121 bp, Gossypium hirsutum
  Clone ID: uC-gsronu33B058f06b1
gaaaagggacgcgcccctttatatgcgcaattaaacccaaaggttgcgttggtcacccccaagggaccccctacatattgccaatcccctaacccccggtcctttgggtttcttcccttcc

SEQ ID NO: 1607 - DNA, 360 bp, Gossypium hirsutum
  Clone ID: uC-gsronu33B058f07b1
ttgtcacgcgtccgcccacgcgtccgaaaacatagagcgttaagtccctataaccaagatcatttgattaggcactcgcttgatgcacctaggcatgctgttttgtaaggcaatattcataaaaaatgtctacatggttaaaaaaacgtgcttttttttttgcacttttggcatcttgcgccctttacaacattggttaagaaatttgttgttggataagcttgtagtgatttttgctttcccaatgcaattttcttttctaaattttaatgcttgctgtacaaacttggcatattttctatggcttctcctttgcaggtttcgcttttgactgataattatcagctgataatggatgct

SEQ ID NO: 1608 - DNA, 376 bp, Gossypium hirsutum
  Clone ID: uC-gsronu33B058f08b1
gtgatagatcatcaacaaaataatgggttctttattgtcaggatgggattctactatatctgatccttcatcagttatacttaaaagaaatcggtcacttactaaagaagagattgaagctttctggagatcaaaaaggaaaacagaggaagagcatcttaatgctatatatggttcaccagatagttgcaatcagcagtatggaaggaaatatatgagatcaagctccatgcctacaccaaatagaaaccagggtttcctagacatggacaccgaaacaagcctggaaaatatcgtaaagcaaagtgggtggtggacaaggagcacttgggcattcttgaatgaaccttcaagttttgaccgccctacaaacaat

SEQ ID NO: 1609 - DNA, 347 bp, Gossypium hirsutum
  Clone ID: uC-gsronu33B058f11b1
tttcacgcgtccggcggctcggcgcagcgcatggaggctcacgtgagagggcagagcctgattgcggcgcgatagcttgctgcaagctgctagggtttctaatcctctttgggtgttgggctgggtgtagtgggctaggctagtgtttgggtcactttggatttaggcctgctattgtaacaaaagaactgaacattttatttattttattttatattttggttttaaaaaaaaaaaaaaaaaaaaaaaataaaaaaaataaaaaaaaaaaaaataaaaaaaaaaaaaaaaaaaaaaaaaaaaataaaataaaaaaaataaaatgggggggcccttttaagggatcc

SEQ ID NO: 1610 - DNA, 294 bp, Gossypium hirsutum
  Clone ID: uC-gsronu33B058g01b1
gctggacgcccgcggaccgtttttattatccgggtcgcctacgcgaccgttatcctaactgtacatcgtctttggtccgggggttttttaaaagcatatgcctgttgcatccaaaggtgcctaagcaatgtttgggattatctttgacgcgtactttctttttctgggcgtgacaaatccaggcgattggacaagacaagggctcgatcaaacggtcacggactataaccttaaccaacactcaattttcatctatctattcaatttcctgtaatgccagcaagaaagaaggcg

SEQ ID NO: 1611 - DNA, 262 bp, Gossypium hirsutum
  Clone ID: uC-gsronu33B058g06b1
tatctatccgcccttcctatttttcttaagactgtttcttacatacctgtgtttcaccactcggattatctcttcggcaacgtcttcctggtggtggaagtggtgaacactgacggctaagtaacaagttagcaaaatgggacctggtggaccgggaggagggccgggaggaccaggtggaccgggaggatggggaggaggacctggtggttggggtcctggccctggaggacctggcggatttgggcctggaggttctggt

SEQ ID NO: 1612 - DNA, 458 bp, Gossypium hirsutum
  unsure (1)..(458): unsure at all n locations
  Clone ID: uC-gsronu33B058g07b1
ttttcacgcgtccgcccacgcgtccgctgaattgatgccttttagccatgtccttgcaactaagctcggngcacgtcttactgatgttaggaagaatggcacctgcccctggctaaggcctgatggtaaaacccaggtcactgttgagtactacaatgacagtggtgccatggttccagttcgtgtgcacactgtccttatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaatcggtggtcctcatggtgatgcaggcctcaccggacgtaagatcattattgacacttatggtggctggggagcccatggtggtggtgctttcttcggaaaggacccaaccaaggtgg

SEQ ID NO: 1613 - DNA, 454 bp, Gossypium hirsutum
  Clone ID: uC-gsronu33B058g09b1
tctctcacgcgtccgcccacgcgtccggaatgatggctggttgtgtcactctttcggaggacaatgcttcaactacacagcttttcaacctgcaattgatgttttgaaagaggttcgagtgtttcttgaagcaaatccattggagattgttaccattatcatcgaagactatgtgacatctccaaggggattgagtaaagtattcgatgctgccggcttgaggaagttctggtttccggtatctcgaatgccgaaaaacggtgaaaattggccaacggtcgatgatatggttcaaaagaatcagcgccttgtggttttcacttcgaagtcggctaaagaggcctctgaaggtatagcttatcaatggagatacatggtggaaaaccaatatggagatggtgggaaggtagcttgttcgtggccgaacagagcggaatcacccgtgatgaaacac

SEQ ID NO: 1614 - DNA, 433 bp, Gossypium hirsutum
  Clone ID: uC-gsronu33B058g11b1
tctcaatcgaaacctttaggcggcgactactggtcgagcttcataacacacgaagcttttaactatggcgggtgtagagacggaggttgcggcggccggtgtgcccaagaagagaacattcaagaagtttagcttccgaggtgtcgatttggatgctctccttgatatgtccactgatgagcttgtcaagctcttccctgctcgagctcgcagaaggttccagaggggtttgaagagaaagcccatggctctaattaagaagcttcgcaaggcgaaaagggaggctccacctggtgagaagccggaaccagttagaacccacctgcgtaacatgatcattgtacccgaaatgattggaagcattatcggtgtgtacaatggcaagacattcaaccaagttgaaatcaagcctgaaatgattagccattacctt

SEQ ID NO: 1615 - DNA, 325 bp, Gossypium hirsutum
  Clone ID: uC-gsronu33B058h01b1
tttttgcgtccgcccacgcgtccgattgactatcaacgttcgatatcggaaccaccatacacggctcttgagctccatcttctttacttaatgaagtgggatcttcagttgcctctataccagctaactcatcaaataactgaatcggtgcatttcggttgcttcgagtcccacaataaacagctaccattgtctccacgtcttcatcggctatgagttccatttcagtgaattttatgggatctgtcgaaactggaaacttgtagaaaagtttcgacatacttcttccacaacgtctataaaatttttcactaattttttcctt

SEQ ID NO: 1616 - DNA, 308 bp, Gossypium hirsutum
  Clone ID: uC-gsronu33B058h04b1
tttcttgctagaaggcaaggtagccataatcagcggcgttttaatgcggaatcggttcattcaccgtccatcatttcgccgtacatggtgcccgtatgatcgagaacgctgatatccaagatgaatgaggccaaaaaggagtcgaagccattggttcaaataagtgctcatacatgcaccgggatgttaccgatgaagaacaagtaaaataatttagtccaatcgacggttcaaaactaccggagacttgacatcatgtttagtaaccctgggacagttagcaacttaattcaaaccaatcttgaact

SEQ ID NO: 1617 - DNA, 431 bp, Gossypium hirsutum
  Clone ID: uC-gsronu33B058h06b1
catggttaccttgttattccacctacggggttttttaacagttttctctttttttcctcttccttgtcattcagctgaccctgatccattacaagacttttgtgtagcaaacctgagtgcctctatatctgttaacgggtttccttgcaaaccagcatacgaggtgacttcggatgactctttctttgatgggttcacccaggaaggtaacaccacaaacgccttttcgtcattcctcacacctggaaatgacctctcattcccagggctgaatactcttgggatttaaatgaaccgggtggactttgccccggatggaatcaaccctcctcattcgcatccacgtgcgagcgaggtcggtgcagtcattgaagggaagctccttgtaggttttgtgactactaacaatgagtattactcgaaagacttga

SEQ ID NO: 1618 - DNA, 312 bp, Gossypium hirsutum
  Clone ID: uC-gsronu33B058h08b1
tgtttacgcgtccgaaaagaatggcaagcgagggggagagctcggtgaaggagcctttggatttgataaggctcagcctcgacgagcgtatttacgtcaagctccgctctgaccgtgagctccgtggcaagctccatgcttatgatcagcatttgaatatgattctaggtgatgttgaagaggttgttacaacggttgaaatagatgatgaaacctatgaagagattgttcggactacaaagcgcacggatccatttctctttgttaggggagatggagttatattggtttcttcaccctttccgactgttt

SEQ ID NO: 1619 - DNA, 432 bp, Gossypium hirsutum
  Clone ID: uC-gsronu33B058h12b1
agtctcccagctcccttttggtctctacagttttcttagtgtaaaaaaagaaaattagatatgggtaaggatatagagagtagtgtagagcaagtgtcaggcaaggactaccatgatccgccaccagcaccattgattgatgctgaagagctgactaaatggtcgttttacagagcagtcattgctgagttcattgctacccttctcttcttgtatgtcacagtattgactgtgattggttataaggtccaaaccgatcctctcaagaacacagttgaccctgactgtggtggtgttggtatcctgggtattgcttgggcctttggtggcatgatctttattcttgtttactgcactgctggtatctctggaggacatatcaacccggctgtgacctttggactgttcttaggacgaaaggtatcactgatc

SEQ ID NO: 1620 - DNA, 330 bp, Gossypium hirsutum
  Clone ID: uC-gsronu33B060a01b1
tccttgctttcgtatcatctatctcctcggtctggggggcacaaatgctgaacaggtctgataccattgacccaggcttctaagggaaaatcactgctgaggaagcccttgtccagatgatgtgggctgtctaggaccatctacatgccaaaaactgcgtaggacaaatggagcggttcttagaatcacagatggatggcgttacatacatactgaaccttgtcaccacctgggagacgcttcagccagctgttctcataatagtcgctgtagagccccataaggatagcattgttcagtctgcacgaccctatggtgagagggctgtct

SEQ ID NO: 1621 - DNA, 554 bp, Gossypium hirsutum
  Clone ID: uC-gsronu33B060a02b1
ccctctcttgcgcccaattctagtagcaactgatgtggcagctcgaggtcttgatattcctcacgttgcacacgtggtgaacttggaccttcctaacgatatcgatgactatgctcatcgaattggacgtacagggcgtgcaggcaaaactggcttagccacagccttcttcaatgagaacaatactaatatggcaaaggcattagcagatctaatgcaagaagcgaatcaagaggtacctgcttggctcactcgatatgcagctcgttcattcggagcgaggaatcgttgtcctggaggacgaggccgattcggtggacgtgactttcgaagggattcatcttacaacagaggtggtgcagattactatagtggaggcaacaacaattcaggtggatacggtggaggctacggcgcaaacgttgcagtgctgggattgggtacacactcatttatttctactagtctcagcgtcaaatgtagcagagcttccctttctttcatagggacaatttttctgtcttgagtttactatatttgctagcacatagtga

SEQ ID NO: 1622 - DNA, 535 bp, Gossypium hirsutum
  Clone ID: uC-gsronu33B060a03b1
gtactttattggtggaagtggaaaatcggctgcccgtctgaagtgcccaaaaaatactttgatttctaatgtgaaatttgctagcttcggaaatcctacaggaaagtgtgggtcttacagcatgggggagtgccatgatcctaactcaacattggcagtcgaaaaggtctgcctaggtaagaatgagtgtgccatagaactaacagaagagaacttcgataagggcttgtgtcctggtactactaagagacttgcaattgaagcagtttgcagctaaagttaccccggtatatgttccgacacaaatgttttggctgcttcctgaagaagaaaacggaagaaaagagcattctgctccgttttctttcgggcacgagctgtgtcttatttcctcaacatgatgcccctaagtttatttttcttttgctcaggtacttgttgtcctttgagggtgttgcgacaattcaagagcatagatagacttagctctaataccgggaaattgcgttttgctttaaatatatcgagagtggtc

SEQ ID NO: 1623 - DNA, 220 bp, Gossypium hirsutum
  Clone ID: uC-gsronu33B060a04b1
atgttctttttctgggttagtaacgcaaaacggcaagacaggagatgagtcatgagacaacctggacacaactgatggtggttcgactgtcatatagaggagtcagagcagcatgtcaacattgttaacttggatatgaagtctattgggatttcgaggtatacagacagacggagggcatgcatgatattaatgaaggattatctgaaacacaccccta

SEQ ID NO: 1624 - DNA, 244 bp, Gossypium hirsutum
  Clone ID: uC-gsronu33B060a06b1
ttccttgtgttcccaagacatactgctcatgttgctcgaggagctgaccgggcaggatggaacctaaagatccatcagagctttatagggatgcaaaacgggaagaacttgatgctgccagctttaaccttagggaaattgacaattatgatgagtctgaaagatcaatgttgatctgtcaaacaagctgtgagaaaacttttggcttatcttcagtcttcattgaagctacactaatggagat

SEQ ID NO: 1625 - DNA, 436 bp, Gossypium hirsutum
  Clone ID: uC-gsronu33B060a07b1
ttcagctagtacaaaacttagagcacgcaaacagcatgccgacatcccactgtcggagtctgccagatgcagaatagccttgcaggatggtaatgtcaagctatttgtggagatactcaattgcagttcccaggacgatggcaagatcctgctacgtgaacagagcatgaaagcttcgaatttgaacttcagaggtcataacaatgtcgatggaaatgcatctatctcaaaggttgatcaaaatatcatttttgcaccggaaaatgttcccaggagaagctatggtttctgggatggcactaggatacaaactggtttgacatgtttgcctgactgtgaaattatagtggcgaagtatgctgctgcgtttgtaaattaccctgttccttatttcaaatgcaggtgcaggcatcgtggctatggttctggatactga

SEQ ID NO: 1626 - DNA, 389 bp, Gossypium hirsutum
  Clone ID: uC-gsronu33B060a08b1
ttctatcgtccatcctaacgagcagccacacgttcgtgtccatttggcatgatatgacgcatgcatcagatatataatggccaagcttacagacacaagcgtgccttccacaatgctattctgaaaggtgagataacgagtatgcgctgacctaagtttctcatggccgaaaaagtgatacatctgacttatgcgacaccattgatatcgacacacatgcgatcgtcaacagctgacgagatagtctattgaatccttctgcttgttcttgctgacggatgtgtagtctgtacgcataatgtgtctggctcccgagcctatcgtgagtcacagacagagtgcggaaaggtcacagctttgacgattccatcgtacatgaccgagttgcc

SEQ ID NO: 1627 - DNA, 284 bp, Gossypium hirsutum
  Clone ID: uC-gsronu33B060a09b1
ttttatcgaacatgatattgatgcgctccatgctatttgttattctgacggacgctctttattaccgacaaacatatgtccgactctatactaggtcctagtgcttcccaggcccgcccgctatttggattgcaacggccgcagtggctgcacatatggtgagcaagactaccgtggtgtgctttgtcgttgcgattacagaagagcagaagcctctgtgagcaggtgctatagaccgaatctgaagaagtttatctcgacgatactgggggataggacaaagg

SEQ ID NO: 1628 - DNA, 430 bp, Gossypium hirsutum
  Clone ID: uC-gsronu33B060a10b1
tttaatttttggctgccgcaggtaccttattgacgaagatgttccttcctgctaccacaatgttcgccgccaagaagaccaagaagacccatgagggcattaacagcagaatggctccctgaatgaaaagtggaaaatacactttgggttacaaaacctgttctcaaatctctcagaagctgcaaaggtaagatgatgattattgacaacaactgccctcctcttaggaagtcggagaacgagtgttatgccatgttgtgcacagttggagttcaccactatattgggaacaacgtagatttgggaactgcttgtggcaaatatttcagagtgtgctgcctaagcattattgaccctggtgactctgatgttattaagagcatgcctagggaccactaaactgcagggggtgacatatctcataggtttt

SEQ ID NO: 1629 - DNA, 113 bp, Gossypium hirsutum
  Clone ID: uC-gsronu33B060a11b1
cacgtttcaggactaatagcccaaacgcactcaccatgagggcaatatatggtgcgccggaggcaaaggccacccgtaagaatgagttgggtatccgggaaataggaaccatg

SEQ ID NO: 1630 - DNA, 248 bp, Gossypium hirsutum
  Clone ID: uC-gsronu33B060a12b1
ccctttcgatttttatacctaaggcatccacaaacacactgacttgaaaggagctcacgatgagatcccatctgtcgccattcctgccgctagagctgcaagccccttgttataatctgttccatgcttctactacatgtataaggccattatgaagagtctgagagagcactgattatctgtcagacaagctgtgagaaaacttttggcttatcttcagtcttcattgaatctacactaatggagat

SEQ ID NO: 1631 - DNA, 548 bp, Gossypium hirsutum
  Clone ID: uC-gsronu33B060b01b1
ccctctcttccgcttttttttgttttttgtttacaacaacaatggctggacacacagtttacaccctctcagaagtgtctcgatacaaatccaagaacgactgttggcttgtcatcgatggccgagttctgaacgtaacaaagttcctggaagaacatccaggaggagaagaggtgttgttggaatcagcagggaaggatgcgacgaaagaattcaacgatatcggacatagcaagtcggctcagaatttgctcctcaagtatcagattggtgttctccagggtcacactttaaagaataatgaacaggttggttcaaccgaggagcccaaaaagaaagagatgagtgcattcgttatcaaggatgacctgacgcctaaatatgctgcagtcgtcgagttcgccgccccactcctggttgctggttcctatttctgttacagatacctcacaccaagctcataagtgctgtaataatttgggtttcaagttcaacctcacatgccccttcttccctttaataattggtggcatagaatgtttacaatg

SEQ ID NO: 1632 - DNA, 455 bp, Gossypium hirsutum
  Clone ID: uC-gsronu33B060b04b1
ctcttagtcttattcccccagcaaaaccgaggggatggctcatagctatgacagctcatcgtcgccctcatgactgaaaggtgacgactcatccacagccctatcagtatccttaccaaaatatgctagcactctcttgggagtgtctgattccagaaggtaggacaagcgagcagagaacgttaggctagatgacgaaccatcactgcaaatcgaaggggaagccattagagtccctacatgcacatctataacgtgaatcaagtcggctttcgttaggcctaagcatactttcacccacagccatgatggctagacaatattccatccactagtggatgtggaaggacgtgtctacaatgctgattttgtgacatgctgtagatgatcaatgcgaggacgttaatagaggaagaccagtcttaaatcatgaacatgcaccaaaatggatatgt

SEQ ID NO: 1633 - DNA, 450 bp, Gossypium hirsutum
  unsure (1)..(450): unsure at all n locations
  Clone ID: uC-gsronu33B060b07b1
accgttctcatggtctgtagngtaccgacggacggtggcgagaattatatgtagagactcccacgcatccacgctacagactgctatgctggttttatagggtctttctataactgatactgaaatattcaattgataaggccagaggtttaatcatctaaaagaatgccataaaatctgtggatcacgactgagcttgcggtgttgttaggcctctttgatcaaactaaggtacatgtgtgaaggtgacgatcaaattcctactgcattagatgcctatgctgatgcaaatgctgaggactcacgtgcgggtgcaatggagcatgtgcattttcgtattcagcagaagaatggccgctaaagcctgacaactgttcaggggttgtagaaagaattcagctattacatgatacttaaagacctgagaaggagttgtgctgcaatgggacc

SEQ ID NO: 1634 - DNA, 449 bp, Gossypium hirsutum
  Clone ID: uC-gsronu33B060b11b1
tcgatgcgtgcgcgtgcccaagctcgtacgcctgaccccattttaaatctttaccatgatgaatttcctatcgcgggtaagaaacaggactgaagcgataccactgtagatgtctcgcatgctactcatactacaggcctgcatgtagagttcactcacctgagcagcatgatgcatcttagcaccagcgccggagatggaggacccggtgctaaccatgcagaagcttcaagagatgctacctcagagattccgcatcatggctgttagctctaggtgctgggactctacctttcggtaccctttggatcgagctcttcttcatcatgttaagcatatggatgggacgcgtgtactacgtcttcggctttgttctcatcgctatggtcctcctcgttgtggtgtgtgcccgaagagtatcggggttaactcacatgcatctctgcgta

SEQ ID NO: 1635 - DNA, 406 bp, Gossypium hirsutum
  Clone ID: uC-gsronu33B060c01b1
acctctcttccgccaagacaaagctgcatattatctttgtttgttccgacagatgcaaacgaactagatagaggatgaaattcattcgctgtttttttgaagacggttttatgttttcggggtgaacataatgatgggaggctatagcagggcgattgtgtctttgtcggacgagctgactgaggtcgggtgccggacttcttcacctaggataacgggggacgccctggtgactcggactcttgagactaactcctgcagcctgtccatgcacatgggtgaccatgtgcaattggcttatgtctaccatacagaggattcttgacagcgcagatcattggctgtgaaggacgaaagcttttgctcgttggagggagcccttgactacttgtggagattagagcac

SEQ ID NO: 1636 - DNA, 482 bp, Gossypium hirsutum
  Clone ID: uC-gsronu33B060c04b1
gccgcccgcctgcaccgacccggaactgaccgtgccgacccacgcgtgcgcccttcttccactcttcgtcactctctcgaagaagaaagcgtgtctcggatggaatagctgatctaactgcagcggcggtgacaactggtcacgcaccccgaaccttagccttggatatactaagaagacgtccagcagtcagaccatgttctacggacttaaaccagcatagatgaccttggagggaccagataccagctctactgcatcacgacatggatggaaggggtgcacaatctgaatttgtgatccatgccactgatgtatagcatgattatggccgttagtgttgtgaaaatgaaagcctccggtggaacacgccgttagtcagacatattgtcaaggttggatgcctgcaagggctataattatgtcctatgtctgtggctggcgtaatagaagctttggctgtggtgaaaataacgtataag

SEQ ID NO: 1637 - DNA, 91 bp, Gossypium hirsutum
  Clone ID: uC-gsronu33B060c06b1
tctttcattttggtgggtaacgcaaaatgctgggggggggtgatgacagctgccgccctcactgaaggtagccaaggaagcacgaaaacaa

SEQ ID NO: 1638 - DNA, 407 bp, Gossypium hirsutum
  Clone ID: uC-gsronu33B060c07b1
tattttcggttggagaagacgagagctcatctctctgctttaaagctcctgtccaggtagaaatctcttcttcctttgcgatgagttctttgttgttcagtcgccatggcttctaagccggattttaaaggaactcatggatttgcaagaaagatccacccacttcttgcagtgctggtccagtagctgaagacatgcttcattggcaagcaacactcatgggaccctgagatagcccttatgctggaggagcgtattttagttaccatccatttacctccagattatgcttataagccttctaaggccacgtttaggaccaaggtcttccattctaacattaacatgaatggaagcatttgtcttgatatccttacagaacaatggactcctgcactaaccatttc

SEQ ID NO: 1639 - DNA, 357 bp, Gossypium hirsutum
  Clone ID: uC-gsronu33B060c08b1
ctggcgcgcacgcgtacggaaaaaaactcgcttctggacgatagatggcccattataacttgaaggggaaggtgaagctcgctcacggggactgatattcagagaaattctttcatgagcaggtccaaggcgtagggatgtcctaccattttacaatttggtgcagacacagggggtccaatgctctacgagggagccagagctgcatcttgaattgaatcattggctctggagcagctccaaacaaatgtacgacctgctggagtgacggcggggactgtcccagatggtatgcaggacaaatgtgtgttggctgacatacgctttgctggtttctgaactgatatttcagactcc

SEQ ID NO: 1640 - DNA, 533 bp, Gossypium hirsutum
  Clone ID: uC-gsronu33B060c09b1
tcttttttttttatattactctcaattcccattgaaactttcagactttcagccataattaagcttcttaccttcagaaaacttcgactgaagctgctccaagattaaagaagctttaatttataatactctgtcccttaaactagcaagcctgatctgctgcataatcgtctaaagaaaatttgatggggataaataagctgctgtgttggtttgcagttttcttctttttgttgggttactctgcttgcactttgatttcggatggtgttttcgactctctcacttctactggaaggcaccttcttcaagctaagaaagcttgccctgtgaacttggagtttctgaactacacaattatcacaagccaatgcaaaggaccaaagtatccgcctcaaagttgttgttctgcattcaaggaatttgcttgttcttatgcagaacagatcaacggcttgacgactgaatgcgctacaactatgttcagttacattaatctttacgggaaatacccttctggtctttgtgctagc

SEQ ID NO: 1641 - DNA, 543 bp, Gossypium hirsutum
  Clone ID: uC-gsronu33B060c10b1
tcctcgcgtccgcagcagcagcatgagttaccaaagagaacctcaagacccttaccctcctcctgggtatgcctctccttatccacccccacccccatctggatacccttgtgctccaccttacgaaggctacccaccaccgccgcctccaggttatccaccgtatcctcagccgcaacgccagccttacgagggttaccaagggtattttgctgaagggtatccaccaccaccacctgcacctgcaggtcatgctcaatatcaccactgccactacgagcatcaccatcaccacaatcattctgatgatggctgtttctctttcttaaaaggctgtttggctgctctatgttgttgctgcatgttggaggaatgctgcttttagtgaagttctactttgcattttgtggaggtcaggtcatatgctatgtattgtgttccgtacccatctattattataatctatctactcaaaccttataaaccaaaggtttcattataaatacaggctgctctgagttcccgttgtatataaagatttta

SEQ ID NO: 1642 - DNA, 405 bp, Gossypium hirsutum
  Clone ID: uC-gsronu33B060c11b1
tattgtatatggggagctactgaaagacctagggctggtgtgatgaaagctggcacacttgatcaaccatggcagggaattgctgatccagaagcatgcgctgtgctaaggcaagcctggctagacgagacttactaccacatgctgatgccgatgatggcgagataagccagatacagaccaggacggagctctccgatagaacttgtgtacagagattggagagagcctggtgacgatccagcctatgctgcttttgggacaagtgacctacatgctaatatggcaccgagacagacatgatatgctcattggactcgacaaataaagagggtgatgctgctaatgaatggatgctccttcaggtgatggtcattcacattcaaagtcaactaagaaagacaa

SEQ ID NO: 1643 - DNA, 141 bp, Gossypium hirsutum
  Clone ID: uC-gsronu33B060d02b1
ccctctgtcttccgatttggatagatgggagatggtgctggtggtggcagtggtggaggcggagccagtgcaggtggtacttctgggtatggcaatggaggtggcgaaggaggtggaacttggtagtggttatggaggagc

SEQ ID NO: 1644 - DNA, 546 bp, Gossypium hirsutum
  Clone ID: uC-gsronu33B060d05b1
ggctcgcccgcacggtacggagccgggactgactggctggacccacgcgcgcggtcttgcttgggtcagatcaagcaaaagcagatgcttgggagaaagcagagatggttaaaatcaaagaccggtaataatacattgacaccgagaagcactaattgtttagtactaaacagttgtaggcaattagaagcatatgatcttcttcactaacaatgaattacaggtatgtgaagttaaataacactatactcgaatgggaggaaaagaagaaaaagaaggccagaagcaagctggacaaagcagagaagagtgaatcggagaaaaagagagcaagagccttaaccaaatttaggaatgaaatggactacatcaaacaagttgcagatggagcaagagcacaggcaaatgctagacaaagaaatgatgagcttaaagcaaaggaaaaggcaaacataattagaacaacaggagagctttcaatgacatgcttttgttgtgaatttaactaataagagtatcatgactttaaggcacatataaaaccac

SEQ ID NO: 1645 - DNA, 247 bp, Gossypium hirsutum
  Clone ID: uC-gsronu33B060d06b1
ccctctctttcgattgatggaaaaaggttgatgccgaggggtctaccattccgggactcgctattacacagtgaacgcgccctccctgcactgactcccaccatggctgtacattcttcctgcttaaaagctgcttgctgagtgagtcccctcaaatcggatcttgtgaagtacactagtgcttatcactacatcactagagtaaaagggagagaaacagggagagatgtatgttgggccgccaccc

SEQ ID NO: 1646 - DNA, 345 bp, Gossypium hirsutum
  Clone ID: uC-gsronu33B060d08b1
cgcttgtatttggggtggcaactcttgagaaaacagctcatgatgacatcaaaaagcttgcctcagctgtatatttgcaagtgagcattataagtcaggccctaatatttgtaactcgatctagaagttggtcctttgttgagcgtccgggtttactactattggcggcctttgtcatagctcagttgattgctactcttattgctgtgtatgccaattggagctttgctgcaattgaagggatcggatggggttgggctggtgtgatctggctttataatattatcttctatatcccacttgatttcatcaaggtttcttcattcgctatgctttgagtggccg

SEQ ID NO: 1647 - DNA, 302 bp, Gossypium hirsutum
  Clone ID: uC-gsronu33B060d12b1
tgatttccaggcttgacctatctcttgactgtaatgatgggtccagaaagagagaattggttcaaatctgaacggcaagcaatggtgggaggtaccctgatatgtgcatatggtcctatattaatgatgctgtttcgatgaacatctttgattggacagaaagatgcacacttagctctcaatgacataagcaccaggggtcagccagacccttgtggatggctcgagtctactattctgagattgggactggaacattggcatattggaggcctatgcttgataggaaactgaatgagcat

SEQ ID NO: 1648 - DNA, 273 bp, Gossypium hirsutum
  Clone ID: uC-gsronu33B060e01b1
gattttcttttcggaagacattgtacgatggctagttgggacagaggactcacatatgcgaaatgatgacattggtgttccaggatgagccaagggatgacatatggtgcccggggaacaaaagcttaacggattgtcacataggttgcttcagtgcaagcacataccgcgacagcctggccattcgatgctttagaccataagaacttcggagctgaaggtggactgaaattaacgacaggggtaactggatggagctcaacactctgtgat

SEQ ID NO: 1649 - DNA, 344 bp, Gossypium hirsutum
  Clone ID: uC-gsronu33B060e04b1
ccctcttgcttccgtctagacctaggtctaggtctaggtcaagatcccgctcctggtcgaggccaaggcataggtccaggtcacatagtcgcggcaggtcatggtcaagaagtcgaggcagggttgacgctggaaatcctggcaacacactatatgtgaccggtctatctcaaagggtcactgagagggaccttgaagagcatttctccaaggaggggaaggtggcatcgagtttcctggttgttgaacctcgtactcgcatatctcgtggtttggctttcgttactatggacagtgttgaggatgccagccgttgcatcacgtatttcatcccatcaatttta

SEQ ID NO: 1650 - DNA, 404 bp, Gossypium hirsutum
  Clone ID: uC-gsronu33B060e05b1
ccctcgcttacgcccacgcgtgcgcgatcctcccttaggttcaggtgatggaggttctgaacagaaaactgagaggcctttagaggaggaacctatgcttgcagctagaatcaccattgaagacggtctgtctctttttcttgatgtagatgatattgaccggctcatacaatttagtcaaccccaggatggtgggatccagctcagacggaggcggcagatcctgcttgaaggtatggcagcatcactgcagcttgttgatccacttagcaaaggtgcgcatgcagttaaatgtgttgccaaagacgacattgtgttcctaagattagactctcttgcaaagggccgtaagctggtcaccaggttcctttagcttcttatccctggaagtgagcttgttcgag

SEQ ID NO: 1651 - DNA, 265 bp, Gossypium hirsutum
  Clone ID: uC-gsronu33B060e08b1
agggtgtcttgtccgggatagcaaattgcaaagatgcataccgatcatggtcgaattggggacctctacatcgcccgggtatgcatggccactaacaatgaacattacctgtgaggctcatgctgccgagcattacactgtcggcaattgggattagccagccgcatacactggtacattgttcaccttaggtatctgcggctttgtccgttctcaggccgatgatgatagcactctagacaggctttgggtgaacaggaaagcc

SEQ ID NO: 1652 - DNA, 308 bp, Gossypium hirsutum
  Clone ID: uC-gsronu33B060e10b1
ttcatgcgatcggtacgttgaaattatctaccagcaaaaatatctgataaggcctattgtctgaacttggttcaagggactggtgcacgagacacttcttcgtgatttgagtataggaactgaacgctgaccgataggacataatgatccaagcgcacgcgctctgcccggccagtggactgggaggccaggctgggacgcacgacgcttgtgtacatatagatgctggcatcccgtaccggagcgtccaaggccccctgcgggtttgtgactgaaccaatacattaacgatgatgaggaaaccgggc

SEQ ID NO: 1653 - DNA, 133 bp, Gossypium hirsutum
  Clone ID: uC-gsronu33B060e12b1
ttcttgaataagagatgaataaaaattgttttcattatacaattatatttctcaatttcattactagtttttttcttttggggttaaaaaaaaaaaaaaaaaaaaaaaaaaaaaaaataaaatcaatctaatt

SEQ ID NO: 1654 - DNA, 88 bp, Gossypium hirsutum
  Clone ID: uC-gsronu33B060f04b1
accatgcttacgaaaaacagtgctttggctgttaaaaaacctgatttttgcatttgcatttcatgctctcagaggatactatgcttac

SEQ ID NO: 1655 - DNA, 102 bp, Gossypium hirsutum
  Clone ID: uC-gsronu33B060f05b1
gcgacctcattttcgaacaactagaggatggtgataggcaatgcaaatcttggaaacttcccccactggtataaagcataccggtgacgggaagatggcatt

SEQ ID NO: 1656 - DNA, 374 bp, Gossypium hirsutum
  Clone ID: uC-gsronu33B060f08b1
ggcgcttcttcttatgtcatagacagtatgttgtgaaaccaagtccaggacttggtgatcccaaaggctgttttgtagaatccaaggcggtccattggatcctgctattcttattctaagcttcccgaggagcccattaagctatatgtttggaaactggatgtatcttcctttgaggttgaagttctaaagtcagccaccattgacgaccataagctgcctgttcaacacgtgtttagtcatatgccaaggaaaggtcccggtaagattgcatggccacatgtttggggacatattagctagtgctatgatggacagaagtgtgctcacagacactgatcatatcatgaattatggcatcaaggatggtcatc

SEQ ID NO: 1657 - DNA, 264 bp, Gossypium hirsutum
  Clone ID: uC-gsronu33B060f10b1
ttatttcttccaggtgggatgcagatctttagaaagactattaccgataagaccattactttagaagtggagagctcggatacaattgctaacgtgaaagcgagaattcacgacagagaacgaattccaccagagcaggaaaggttgattatggctgggaaacagtaggaagatgcaaggactgtgggtgagtacaatattaaaaaggagtgcactattgaccttgaacttggtcttcggggaggccattaaaccttaaggtct

SEQ ID NO: 1658 - DNA, 407 bp, Gossypium hirsutum
  Clone ID: uC-gsronu33B060f12b1
ctgctgttggtactgctggtcagcgctgtaccacatgtcgtagactgcttcttcatgaaagtatatatcggactgtagttgaccagctacttgatgtgtacaaacaagttaagataggggacccactagaaaagggtaccttgcttgggccattgcacacttcttcttcaaggaagaactttgagaaaggaatagagataatcaagtcacaggggggaaagattcttactggtggcggtataatagagtctgaggggaactttgtgcagcccacaattggtgagatttctccggatgccgatgttgttaaagaagagctgtttgcaccaggtctttatgtcatgaaatttaagactttgaaagaagcatttgaaataaacaactctgttcctaaggaatgagcagtt

SEQ ID NO: 1659 - DNA, 98 bp, Gossypium hirsutum
  Clone ID: uC-gsronu33B060g01b1
tttatatcttgcgaacgcaacaacgaagaataatgagaaagatttagaaaaaaaccacaagttattgctggcgaagttaccaatgctcttctttcgga

SEQ ID NO: 1660 - DNA, 67 bp, Gossypium hirsutum
  Clone ID: uC-gsronu33B060g02b1
gacattgttgggtctcggtgacactgaaactgtggcaacactgacgccattatagctacagtgacac

SEQ ID NO: 1661 - DNA, 107 bp, Gossypium hirsutum
  Clone ID: uC-gsronu33B060g03b1
accatcttttcgtttgactgtgcttgaacatgtgctgaaattgatacttgtagttggataccctgctttacaagaatagtatgcaggcatacgggtttataatcgtt

SEQ ID NO: 1662 - DNA, 182 bp, Gossypium hirsutum
  Clone ID: uC-gsronu33B060g04b1
accttgcttacgcacacccgtgctttttttcttacacttttctatcccggtatttgcatttcctgccttaaaaagctatgactcagactgatgggcttatggccgttatgaaatgtgagggctggatggcagccgtaacgagagacatgacgaaaatgcaaggggttgaaacatagcaagtg

SEQ ID NO: 1663 - DNA, 226 bp, Gossypium hirsutum
  Clone ID: uC-gsronu33B060g07b1
tttaatcctgcggactcatcagtgaagttcagcccgcgtgtgttctcctgtagccgcaagagccgaaaggcccatttaacaggcccttctaccggacgccgcgtgttattgagcgcaccccctctcattctatctgaagttcaagaacaacgttcggtctatgcctgtgcgcaagtgttgactggtccaagtgttttgggggacctacaatgaacggcaaggtaat

SEQ ID NO: 1664 - DNA, 94 bp, Gossypium hirsutum
  Clone ID: uC-gsronu33B060g08b1
tctattcgtacgcaaacgcgtacgaatacggggacgctatgaccaacatctacccccactcgctgcgagcaaaagaaggcgaatcgcccgcttt

SEQ ID NO: 1665 - DNA, 449 bp, Gossypium hirsutum
  Clone ID: uC-gsronu33B060g09b1
ttcattcgtccggtatatttatccctgaaaacagagagaggccgacgttgtcgttcagcagcagaacagcaaaagaagcaaagcaatggcaaggatcaaggtttatgagttgcgacagaaatcaaaacccgagcttttagctcagttgaaagatctcaaagctgaacttgctcttcttcgcgttgctaaagttaccggtggtgcacctaacaagctttctaagataaaggtggtgaggctgtccattgctcaagttctgactgcaatctcacagaagcagaagtctgcattgagggaggcatacaacaataagaaattcttgcctcttgatcttcgtcccaagatgacccgagccattcgcaggaggcttaccaagcaccaggcttttttgagacccgaagggagaagaagaaggaaatgtacttcccatgggggaatatgccatttaa

SEQ ID NO: 1666 - DNA, 112 bp, Gossypium hirsutum
  Clone ID: uC-gsronu33B060g10b1
tgttgttatgaagaggaaaaagacgatgaagatgatgatgaagaagagaaagtggagacgttctttgctttgataaggagcacaagggatatgcccgatcgtctaataaacg

SEQ ID NO: 1667 - DNA, 334 bp, Gossypium hirsutum
  Clone ID: uC-gsronu33B060g11b1
tggctttcttgagggagtcaagagccttgtcatttaattagtgacacacatgaatggcttaacgagacaaccactgatcttgctgactatgcagcgacaccacatccagcggaacgaacctgacccatggagcgtggaaagaaaaacccggagcgcataccattatctccactgtttcaactgactagagaagcttaggagaaccagaagctatcactccaaattgaagacccgctacctagaacggttcaaaacgtactccgggtccatgcagctggacaatagctggatgaatgcccgctattttgataaaaagaaagcagccaaaataaca

SEQ ID NO: 1668 - DNA, 462 bp, Gossypium hirsutum
  Clone ID: uC-gsronu33B060g12b1
ttcaaatccctcgaaaaatcctacccatccaatcaccaccggaaaccatggccactccttccccacgcgaagaaaatgtctacatggccaaactcgccgagcaagccgagcgctacgaggagatggtcaagttcatggagaacgtgcgctccgccgtccccgctcccgacgaactctccgtcgaggaacgcaaccttctctctgtcgcctacaagaacgtcatcggcgcccgccgtgcttcctggaggatcgtctcctgcatcgagcagaaggaggaaggccgtggcaacgccgaccacgtcgccgtcatgcgtgactacagggccaagatcgaggccgagtttgtcgagatttgcgctggaattttgatgcctcttgacgagaaccttgttccggctgttggaaacggggattcaaggtgttttatctgtaaacgaaaggagattaccctaggtacttgtc

SEQ ID NO: 1669 - DNA, 117 bp, Gossypium hirsutum
  Clone ID: uC-gsronu33B060h01b1
caattctcacaggtgaagcagccgctccttcttgcatctgctaaacatgaatggattcgcaaattaatgtgtgctgtggagctgaaaataatggcatggaccgggtaaagaggctaa

SEQ ID NO: 1670 - DNA, 201 bp, Gossypium hirsutum
  Clone ID: uC-gsronu33B060h02b1
ttcctttcgtacgaaaccctaaaaggtgttctttggtattcttgaaaagaaaaatatcaattttttacagagtttgttcatcaaggaacgaatttgcacgattagacgttttaagagatgattgcaagttcaaatatgggagccgaagccaagtgatattttgtcaccaagttgttgatgtaatgtcgatttccacccaag

SEQ ID NO: 1671 - DNA, 329 bp, Gossypium hirsutum
  Clone ID: uC-gsronu33B060h08b1
gcgttgttaaaggctgcacagccaaagaaaactctgaaaaccaaggataaagcagaggatgaggagagcgacgaagacaaagacgatgaagataaagagaagaaaaataatgaaagaaggggaggaagatgataaaccaaaaggcccttcaacgctgtcgaagctaaccccagaagaagcggagcaccgcgcactgcaagcagctgtgctacaggaatggcacatgttgtgtaaagatcgaagcatgaaagtgggttaaggtggtgtccggcattagttagttgattggagttgcattttttaccctttggtggatggctggaattggg

SEQ ID NO: 1672 - DNA, 225 bp, Gossypium hirsutum
  Clone ID: uC-gsronu33B060h09b1
tgtttgtcactgtcaccagggatacatccggagagaacattggtaggggtacaaagattactctgtttttgaaagaggatcaacttgagtaccttgaggagcgaccgtttgaaggatttgattaagaagcattctgaatttattagctatccaatttcactttggattgagaagaccactgagaaggagatttctgatgatgaagatgaggaggataagaaggtc

SEQ ID NO: 1673 - DNA, 327 bp, Gossypium hirsutum
  Clone ID: uC-gsronu33B060h11b1
tcctctcgtccgcccacgcgtccgcccacgcgtccgatcaaatgccaaattcgttgctttccatttatcgaggaaaactcagttcagtcgtggattcagtttttctgtttttaacatagttagttgaagcaagcaatcatggcaaggaagatgttggttgatggagacttaaaccaaacgaataacgagggagctgaatatgattttgacttgtttgtcatcggtgctggaagcggtggtgttcgcgctgccaggttctccgctaactatggagcaaaggttgggatttgtgagctcccatttcatccaatcagctcagaagtcatt

SEQ ID NO: 1674 - DNA, 334 bp, Gossypium hirsutum
  Clone ID: uC-gsronu33B060h12b1
tcgacctttcatctgcttcttcttctagggaaagggggagaaagacgcctcttcttagctcgaatccctccaaatctaaatctaaatccaagttcctctcctcaatctaattgcataccatactgaagttagagtaaccatgtacgttgaacatgccttctcgatatctgacgaggatatcatgatggacactccccacgccattaacaatcggcctccgtacaaggagatcggcctcgctgtcgctcttcacgcctttggcacccttgggatcatcctgagtattttcatggtcgtcaacatagctcgagggtgaccgcacacctggtctttt

SEQ ID NO: 1675 - DNA, 486 bp, Gossypium hirsutum
  Clone ID: uC-gsronu33B061a01b1
cctcacgcgtccgcaacatctccctcggcggccgaggtggcacgaatcctggacagcttaaaatttcttcaggggggattttatggaagaaacaaggaggtggaaaagctgtagaagttgataagtctgatatcttaggggttacatggatgaaggtccctaggacaaatcaacttggtgttagaatcaaagatgggttgtattacaaattcactggattccgtgaccaggatgttgccagtttgaccagtttttttcagaataattgtggaatagccccagaagaaaagcagctttctgtcagtggtcgtaattggcaagaagttgatttaagtgggaatatgctcgcctttatgactggtacgaaacaagctttcgaagtgtccttagcagatgtgtcacacacacagcttcaaggaaaaaatgatgtcatcttggagttccatgtggatgatacactggagctaatgagaaagattcactgat

SEQ ID NO: 1676 - DNA, 535 bp, Gossypium hirsutum
  Clone ID: uC-gsronu33B061a03b1
gtacttaaaggtggaagtggaaaatcggctgcccgtgtgaagtgcccaaaaaatactttgatttctaatgtgaaatttgctagcttcggaaatcctacaggaaagtgtgggtcttacagcatgggggagtgccatgatcctaactcaacattggcagtcgaaaaggtctgcctaggtaagaatgagtgtgccatagaactaacagaagagaacttcgataagggcttgtgtcctggtactactaagagacttgcaattgaagcagtttgcagctaaagttaccccggtatatgttccgacacaaatgttttggctgcttcctgaagaagaaaacggaagaaaagagcatcttgctccgttttctttcgggcacgagctgtgtcttattttctcaacatgatgcccctaattttatttttcttttgctcaggtactttttgtcctttgaggtgtttgcgacaattcaagagcatagatagacttaacttttaatacgtgggatattcgttttgcttttaaatatatcgatttgggc

SEQ ID NO: 1677 - DNA, 299 bp, Gossypium hirsutum
  Clone ID: uC-gsronu33B061a06b1
ttagtatcagaaatattttcaaggcatccacgagacacacttacttgaaaggtgcttacgataggatcacatctgtcgccattcctgacggtgtagctgcaagttccttgcttttaatcggacgagggatctataacatgtctcatgggattggaaaaaaggattgagagctgtcactcgtggctagaagacatgtttttctttttttgggtttcattgtagcatgaaattgttcgcttatttgctctaataattggttgggtttttatgccaaatggagatcttaaaagatacccttt

SEQ ID NO: 1678 - DNA, 421 bp, Gossypium hirsutum
  Clone ID: uC-gsronu33B061a08b1
atctattgccgatactaagtagcagccaaaaggttgtattcatttttcatgaccttatgcatggatcagatatatcatggcgaattcttcagaaaaaattgtgtcttccacaatggaatctgataagtgagatttcgcgtcagtgcttacataattttcttctgtccgaagaaatgactcatcgaaataatgagtcaccattgatatcgacacatctgagatcgccaaatgttcaggagttcctctattcaatccttttccttcttcttgttgctggatatctcgttcgtacacatcttctctttgtttcccgagcctatagcgagttacagacagagttcgaaaaggtcaaatctttgatgattccatcatacatgattgagtggcgaaaacttctggataggtattctacatctgaact

SEQ ID NO: 1679 - DNA, 269 bp, Gossypium hirsutum
  Clone ID: uC-gsronu33B061a10b1
gtcattgcctgtgcctccttcggttgaccctgggacggcttgatacatcatgcggtagggtctgactgcccaggatctagtacaacgttgcttcaagggcgaatgcggacacacggaacctgtgcatgctggagctggaggggtcggatctttgtgatgccaacgggcaaacgcagtggatgccactgttatatgaactgacatttgcaacaaaacggtgtccaaagcaaagcacgacgggttttgccgtggtataaattataaggaag

SEQ ID NO: 1680 - DNA, 301 bp, Gossypium hirsutum
  Clone ID: uC-gsronu33B061a11b1
tcggtgacggttactctgacaccttcggatgattagcctgaataatatttggagcactggagaaaaaaactatccctgcgaatgcatggcgtatactagagagaggaaccacagacttaggagcctcttttgtacatatgggtcttcttatacatgtgcatatggattgtgtgttgatctacatgtcaagttttaatttgtcattttcagtgtctgtatatataatctaatgtacagtaactgggaaatgtggagctatcaagctatggaatggtcaaggaccacacaacatggttagata

SEQ ID NO: 1681 - DNA, 360 bp, Gossypium hirsutum
  Clone ID: uC-gsronu33B061b01b1
aaaaaaaaaaaaaaaaaaaaaaaaagggggaattaaaaaaaaaaaaaaaaaaattaaaaatttagggcggccgttttgggggttccttgtttctttcctcttctggggggggcccttttttgggttccagtgttccctccgtgcgcttgcctgttctttttttttttttgtggtgccttaattacctttggttggccccatttttctaccgttgtgtttggtccccctttggctttccccactttttgcgttttggacacttccccttttttttctgttgggttattccccatgggtgccgcccggttctccctttccacctgttgcttaccctgattggcgtttgggcccccccttttc

SEQ ID NO: 1682 - DNA, 448 bp, Gossypium hirsutum
  Clone ID: uC-gsronu33B061b03b1
cccactcgtccgcggacgcgtgggttcgggtgcgggtgtaacccgattcgtccagcccatttacaaggcaatccgagatgagtttgtgaagcatgtgaaaggtccatttacaacaattggagtatttgatacatgctttgatgctacagcagaagctgaggcacctttaataacattacatttcgaaggcttgtcgatgacattgccaatggaaaacagcttcttgcacaccagtgccgggtctcgggcatgcttggccatagcaccggtccccaacaatgtgaacgccgccatgaatgtgatagccaatttgcagcagcagaatcataggattctctttgatgtgatcaattctcgcttgggaatcgctcgtgaagcttgcaattagcttcttattggctttattttgctttggttggtctttgtttgttatcttggctttatgcgt

SEQ ID NO: 1683 - DNA, 427 bp, Gossypium hirsutum
  Clone ID: uC-gsronu33B061b05b1
attcaaggcattatctacacgcgatcaacgatgatgacgaaacccatttaccaaaaccagatccatgttgaaaatattttttttatataaccatttccaaaattgcaataaaatttattcatcttctcttttgaatctttccctttctttccttttcctgtaaaaatggagggttcctcgtctgacaagctgatcgttgtgacccgtgaacctgatgggatcgctattgttaccatcaatcgacccaaatctctcaactccttgacccgacccatgatggtggacttggccaaggctttcaaggctcttgcgaaggacaactcggtgcgggtcatcatcttgtctggagctggacggcgtttcttgtcaggcgtggatttgacggctgcacaagatgttttcaagggtgacgttaaggacccggaga

SEQ ID NO: 1684 - DNA, 332 bp, Gossypium hirsutum
  Clone ID: uC-gsronu33B061b06b1
cccacgcgtccgcccacgcgtccggaagattaagatgggttcaaaaatatttcatgatttataactattgtactgatttgaaacgtttccctcaaggtgttccaccagagtgtaaacgcccaaggttctaaaatcaaacctctcctcctttccatgtaatatattctttttttcactactttcttactatgtattcaagttgcactcaacttgatgcttggggatggatggaatacagttgctattattattattcttttttttatgtaaaaaaaaaaaacaaataaaaaaacaataatttatattctcaacaaaaaaaaaaaataaatatc

SEQ ID NO: 1685 - DNA, 279 bp, Gossypium hirsutum
  Clone ID: uC-gsronu33B061b08b1
tttcacgcgtccgacaaaagaaaaaaaaaagagggggatatattaaaaaaaaacaggagaattaaaaaaataaaaaaaaaaataaaaaatgggtggccgctttggggggtccgtttttgcggcccctggtttccccacggggtgcgttccttttttggggtctcttttttggggccccttggccgcctttttctggcttcttttttgggttctccttgttggtccccccctgggtttctttgctggacttcccttgtttccccgctggttttctcctgt

SEQ ID NO: 1686 - DNA, 69 bp, Gossypium hirsutum
  Clone ID: uC-gsronu33B061b09b1
ctcttaccactcctccggagcattatgtgactttgtgggggctcaaaaactgaacagcttaaaatttct

SEQ ID NO: 1687 - DNA, 300 bp, Gossypium hirsutum
  Clone ID: uC-gsronu33B061b10b1
cttcggcaggcttattatgaacatctaagggacggagtgcttttatcaacccctcaattcctagtccccattgtgactaatttaagtagatccagcggctgcaggaagatatctttttccaaaccgagaattcaaataaaatgatttctctatggacagaaggctagacagaaaagttctcctcgttatccggtgcttgaaaccatctgtggaaatcggacggcagggaaccacatctcctatttacactattatcatgactggttctaccaatctcttaggcctaaataaaagatacct

SEQ ID NO: 1688 - DNA, 247 bp, Gossypium hirsutum
  Clone ID: uC-gsronu33B061b11b1
tcgacgatgtctacggctggcgaagctgcttgttcttacgctgctttaattctctatgatgatggtattcccatcaccgctgagaaaattgcaacaattgttaaagctgcaaatgtctcggttgaatcttattggccaagcttgtttgcaaagcttttcgaaaagtgcaacattgaggatcttataaccaatgttggtgctggtggtgctggtgctccagttgccgcagctgcacctgttgctgctg

SEQ ID NO: 1689 - DNA, 399 bp, Gossypium hirsutum
  Clone ID: uC-gsronu33B061c01b1
accgttattgttcgagaacaaaagagtaggcagaagaagcataataggatgtgtacaaaggaactagctttagcattccttctattaacagctgcagctaggagtcttttatcagcacagggtatccattggtacttcttgctatttcaagggatatctctccttcttgctgggctagacttaattggtgagcagggtttataagaagagcggccgatgtaaatacaggcggactcgaactcggggggttaccaaatgaaaacttcgggcggagagggtcggctgagagcagaggccatcgaatgctatgctcgagaccacggttctaggggccacctgatacgaaggagaaagtgtgtgttaacatttgatagaacgatgggactcaatttggacata

SEQ ID NO: 1690 - DNA, 462 bp, Gossypium hirsutum
  Clone ID: uC-gsronu33B061c02b1
gtggtgttagggtcaagcttgacgatggagaaagtggctgctgctaaacagtttatcgagaatcattatagagctcagatgaagaatattcaagaacgcaaagaaagacgatgggtccttgagagaaagctagctgcttcagatgtgcccaaggaggaacagatcaatctgataaaggatttagagaggaaagagacagagtttatgagactcaaaaggcacaagatttgtgttgatgattttgatcttttaaccattattggcaggggagcctttggtgagggttcggttgcgccgggagaagaaatctggaaatatttttgcaatgaagaagttaaagaaatctgaaatgcttatgaggggacaggtagaacatgttagagctgagaggaacccgctggcccaagttgcaagccactgcatagtaaaactttattatttatttcaggatgccgagtactt

SEQ ID NO: 1691 - DNA, 353 bp, Gossypium hirsutum
  Clone ID: uC-gsronu33B061c04b1
aaacgcactcaatgcagtgtggtgctgaattggtgcaggcaaaaacttaaataaaaaacttttgctgtttttattgtatttcatatgttgaagccttcaccaagagcctgaattgtgattcatagttagtgtttagtaagccagtgaatgtatgaacgaataaaatgcccataaatttatttgtttagtatattttccaaatggcagagaagttcaatgtttagggtggcatccaaattcgaaatcgttgtttgttaatatatatgtatttcataattctcaatgttatgatgttgataattaaacactttgctgtaatccaatgtgaatcacccagattatttatcttaaaa

SEQ ID NO: 1692 - DNA, 466 bp, Gossypium hirsutum
  Clone ID: uC-gsronu33B061c05b1
cccacgcgtccgcccacgcgtccggctcagacacgattgataatgttaaggccaagatccaggataaggaaggaattcctccagaccagcagaggctgatttttgctgggaagcaacttgaagatgggaggacccttgcagattacaacatccagaaggagtccaccctccacctggtccttcgcctccgcggcgggatgcaaattttcgtgaagaccctgactggaaagaccatcaccctggaagttgagagctcagacacgattgataatgttaaggccaagatccaggataaggaaggaatcccaccagaccagcagaggctgatttttgctgggaagcaacttgaagatgggaggacccttgcagattacaacatccagaaggaatccactttgcacctggtccttcgctttcgcggtggcttttaagtgtggtgccgaacacctgtccagttattgttgat

SEQ ID NO: 1693 - DNA, 204 bp, Gossypium hirsutum
  Clone ID: uC-gsronu33B061c06b1
gctgttgctatttcgttgggaaacctttcatggggcggtgtgtcatagtatgctgcgatgatgattgctgttagctatgttagcatgagatttaaggttgaatcattatgaggatcatcttttttcccctttgttgaatgtaatgcaattgcaccaaataaaaaataaaaataaggcttatccaattataaaatttttcatttt

SEQ ID NO: 1694 - DNA, 226 bp, Gossypium hirsutum
  Clone ID: uC-gsronu33B061c08b1
ttttcacgcgtccgcccacgcgtccggtaaaagacttgctcctgagtggaagatggctgctaataacttgaaggggaaggtgaaactatttcacagcgaactgaaagaagaaaggtctttcatagacagctacatggttcaggggtgccctacgatgatcagatcaatctgatacaggattgagacaggtatgtgacagggtgcttgagacttaaatggcacagga

SEQ ID NO: 1695 - DNA, 388 bp, Gossypium hirsutum
  unsure (1)..(388): unsure at all n locations
  Clone ID: uC-gsronu33B061c11b1
atttcattagggtcactcaagaaattatggggcaaaatctgctgtcagctgacaaatttccccaattattccaatggtctgaagatttcgcaaattgcagcattgttaaggaaagtttgcctccaagagacaaactacttccctttgtcaaaggtctcattgccaaatatcagcaagataatgctaaggcctaagccctcccaatgaacgtctttcacaatgattgtcgcatgcattttgccatttttgtatttgctgcttttgtgtgtaatgacctacttgcttttatgttcgagtgaaaaaataaattaactcattgtactcttaaataaaattggttattaagttatcaatgagtttttccataaanncnaaaaccacaacaaat

SEQ ID NO: 1696 - DNA, 443 bp, Gossypium hirsutum
  Clone ID: uC-gsronu33B061d01b1
cccacgcgtccgcccacttccattttctattcccacccaaaggtcacctatcgaacagcactcggtcaggtctctcctccgcatatccacctccgatgttccttgcttagggacccttccggtcacgtatgctcacgattcttctcttatcgcctctctagctaagttgtgagccactagatttgtagatctgtaggctatttggtgaaaacattgcttttgttgctaaatgtttcgtattatactcccaatcatcgatttaccaatcttatctgatttacttttttttattactgataccgagtctccttcgataacaactaatgtgaaccccatctgttttcccatgaaaactgcttggaggcacgcaagggtctctattgcaaacgaagaggccacctccccgtgaaccactgttttgaatgcgaagaccttccctaaaa

SEQ ID NO: 1697 - DNA, 336 bp, Gossypium hirsutum
  Clone ID: uC-gsronu33B061d06b1
cccacgcgtccgtttgttggaaaaaggctcatgccttgtcgcctacccttccccgactcgctattacacagttaactcgccctcccttcactcactcccaccatggctttccatttttctgcttaaaagctctttcctatttttttcccctcaaatctcatcttttgaagtaaattatttttatcataattctttagagtaaaagggagagtaaaagggagagatgtactgtggtgccgccaccccagcgatcggatccgggttccatcggcggcgggtcgggcgattcacgggcctaccaagctcggaaaggccgcattatatttttacctcaag

SEQ ID NO: 1698 - DNA, 323 bp, Gossypium hirsutum
  Clone ID: uC-gsronu33B061d07b1
tcgataacagagggtcagaaaccgatcttcagtgtgaaaagatcgtccataatcggacggtgcgggatgacagtggaagtgttcaacaatccagggctggagtaccagatagaagggaatttcggacaacggagctgcacgatcttcaacgcggccaaggaatcagtggctgagattaaacgcaaagttgatgcttccactaacgtggtgcttggaaagacgttttcttgctttctttaaaacccggttttgatggggcctttgctatgggcttcggtgctcgctcttgatcaggttaacgggggtgattacgtagaaactga

SEQ ID NO: 1699 - DNA, 342 bp, Gossypium hirsutum
  Clone ID: uC-gsronu33B061d10b1
tcgtgatgtcggacgacgagcgagaggaaaaggagttggatctcacctctcctgaagttgttactaaatacaagagtgctgctgagatcgctaacatgtttggaaatatgcagaggctttgcagttagttgtaaaagaatgcaaaccaaaaactaagattgttgacatttgcgagaagggtgatgcatttatcacagagcaaacaggcaatatgtataagaatgctaagaggaagattgagagaggcgtcgcctttcccacttgcctttctgttaataacatcgtttgacatttttcttccacttgctagtgacaccttcgagctgcaagaaggtgatccgg

SEQ ID NO: 1700 - DNA, 466 bp, Gossypium hirsutum
  Clone ID: uC-gsronu33B061e02b1
gtatggtcaagatgcaaccaatgtcggtgatgaaggtggctttgctcctaatatccaggagaacaaggaaggacttgaattgttgaatacagccattgctaaagctggttacactggcaaagttgttattggaatggatgttgccgcgtctgaattttatggaacagataaaacttacgacctgaacttcaaagaagagaacaatgacggtaaacaaaagatctcaggagatgctttgaaagatttatacaagtcattcgtagccgagtatccaattgtgtcaatcgaagatccatttgaccaagatgattgggagcactactccaaactaaccaaggaaatcggagaaaaagttcagattgtaggagatgattttttggtcaccaacccaaagagggttgcgaaggctattgccgaaaaaacttgtaatgcccttcttctcaaggtcaatcaaattggatcttgt

SEQ ID NO: 1701 - DNA, 530 bp, Gossypium hirsutum
  Clone ID: uC-gsronu33B061e05b1
cccacgcgtccgcccacgcgtccgcgatcctcccttaggttcaggtgatggaggttctgaacagaaaactgagaggcctttagaggaggaacctatgcttgcagctagaatcaccattgaagatggtctgtctcttcttcttgatgtagatgatattgaccggctcatacaatttagtcaaccccaggatggtgggatccagctcagacggaggcggcagatcctgcttgaaggtatggcagcatcactgcagcttgttgatccacttagcaaaggtgcgcatgcagttaaatgtgttgccaaagacgacattgtgttcctaagattagtctctcttgcaaagggccgtaagctggtcaccaggttccttcagcttcttatcttggaagtgagcttgttcgagtagtgtgcatggcaattttccgtcacttgagactcttgttgggggggctttcttctgaactggaagcagctgagacaactactaaatttgcaaagactgtttctacatgtgttaatgggatggatct

SEQ ID NO: 1702 - DNA, 369 bp, Gossypium hirsutum
  Clone ID: uC-gsronu33B061e09b1
agacaatggagatcaacccggagaaccccatcatggaagagctgagaaagagagccgatgcagagaagaatgataaatctgtgaaggaccttgttctccttctcttcgagactgctctcctcacctctggcttcagccttgatgagcctaacacctttggcaacagaatccacaggatgctgaaactcggcttgagcattgatgaggctgcaggtgaaggtgaaggtgatgctgatatgcccccattggaggatgctgacgcccaaggctgcatgactgtttgaagttactgaagcctaacatgcttcgttagcaactaatgtgaaccccacctgttatcccatgaaaactgtttgtaggcacccaagg

SEQ ID NO: 1703 - DNA, 529 bp, Gossypium hirsutum
  Clone ID: uC-gsronu33B061e10b1
tcggtcaaaccatttctccgctggcatttgcttacaacaaaaaaaattcaaattgaagaatgcctgtatttgcttcaagagttgggttcaggagacacgactacaagaatagatcaaaggaacgaaacgatgaccgtaaagacaaattgtccgaagtgttcaagagctatgctgctaatgggctgctagacaaggaagggctgaaagacgcttttctacatctagatgctgccatgccgtaccggcaagccgaagacgccctccgtgtcgtcggcaaaacctataacattaacgtcgaggaggaaaccgagcttaacgcccttatcgactatgcttacaataagggttacgggtcttcaatttgattagctaatttataagctaaatttctttttctttttcacttttaatcatctaatatgtttttttatatatctttaagttttcgtcccaaaagacgttattatagaataaaggtttcgcggcttatgatggtgaagtagttttttgcatgtactttgcaaagact

SEQ ID NO: 1704 - DNA, 385 bp, Gossypium hirsutum
  Clone ID: uC-gsronu33B061e11b1
tcgattggttcgactagtgcagcgagctaacatgagcaagagaacaatagggacggaccaaggcgcatctccacgaaccaacaacactgatgaacaacatgactacatgtcttaaattgctgtactgtagtagccttgcattttgaatgtaatcatgttgaatgtttttatttgattgcaagattagtatataaattccccctagctgtagctccagtttcaagctagccctgcattttgtaatatgttgcaatacagtacttaccggggcagttaagtgcccggcccgattttaaaaaattccaggcctgagactcagccaggccaggtctgctcaaaaagcacatattattgttgaaaataataaaataacacattattttat

SEQ ID NO: 1705 - DNA, 197 bp, Gossypium hirsutum
  Clone ID: uC-gsronu33B061e12b1
tcgtttagatcgcgagcgccgcccttttttttttggttattttacaattgtttttaggggaatcacacattttgctcttgcattaccaacaagaaaaaaaaaagttatacaaataaacaagataacaaaaaataggtttacatttagaaagtaaaaaaagtaaataattttatcagacaaggaaaatattatataaa

SEQ ID NO: 1706 - DNA, 224 bp, Gossypium hirsutum
  Clone ID: uC-gsronu33B061f03b1
gtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtctttcccttttccttttttcgtcggcattgtttgaacatggggt

SEQ ID NO: 1707 - DNA, 216 bp, Gossypium hirsutum
  Clone ID: uC-gsronu33B061f05b1
atcgcatcagggaagaactcatgactcagaaaaggcatttgcaagcacagaggggacagttaccccatgaaagctttccactgacggaaggatggcagaactgtttctccccagcttggataaggacatcgtatttgactacaaatccaccgttgtacgttgctaagttacatgcatagtcttgccttatctgcttctcctgtacttgctcattgt

SEQ ID NO: 1708 - DNA, 331 bp, Gossypium hirsutum
  Clone ID: uC-gsronu33B061f06b1
attacgaggcattggtagaggtctatccggtcagccttcatctactataccccttgtttctggaagtgtggcttctggtaacggagcccttggcgctgcccctcctgcctctgacatggcaaaaagaaatattttgggagttgatgagagacttgggaatagcagcatggggcaatctttgacatcacctattagtaacagaatgatcttgcctcaggcagccaaggcaaatgatggaagcgcacctgttgattctagtaatcctaatgagcctgctggactacctggcagagcattttctccttcaatggttcctggcatgcagcggagg

SEQ ID NO: 1709 - DNA, 457 bp, Gossypium hirsutum
  Clone ID: uC-gsronu33B061f08b1
ttgcaaaaaggcgcttctccttatttcatagacagcatgttgagaaaccaagttcaggatttggtgatcccaagggcttttttgcagaagccaaggcggtccattggttcctcttattcttattctaagcttcccgaggagcccatcaagctctctgttcggaaactggatggctcttcctttgatgttgaagttataaagtcagccaccattgccgacctcaagctggctgttcaacacgtgtttagtcatatgccaaggaaaggtcccggcaagatttcatggccacatgtttggggacatttttgcttgtgctatgatggtcaagaagttgctcacagacactgatcatatcatgaattatggcataaggatggtgatcagcttattttattaggcatgtcacttccagctataacctgacaaagattcattaaagagaagaatggctgcccaa

SEQ ID NO: 1710 - DNA, 547 bp, Gossypium hirsutum
  Clone ID: uC-gsronu33B061f09b1
ctttttgttccttttccaagggagagtgtgatctgttcttcttcacttcatttcactaacccatggctctttccgtcgagaaaaccgccgccggccgcgagtgcaaggtcaaggacatgtctcaggctgacttcggtcgtctcgagatcgagttggccgaggtcgaaatgcccggtctcatggcttgccgagccgagttcggccctgcccaacctttcaagggagccaaaatcaccggttctcttcacatgaccatccagaccgctgtcctcatcgaaaccctcaccgccctcggagctgaagtccgttggtgctcttgcaatatcttctctacccaagaccatgccgccgccgccattgcccgtgactcggcagccgtgttcgcctggaaaggtgagaccctccaggaatactggtggtgtaccgagagagcccttgactggggtcccaccggtggacctgatctgatcgtggatgatggtggcgatgctactctgctgatccatgaaggagttaaagccggggaggtttatgagaaaaccggcca

SEQ ID NO: 1711 - DNA, 466 bp, Gossypium hirsutum
  Clone ID: uC-gsronu33B061f11b1
tttttcaacccgtttgttaaaggtccacctgtcggtatcaatctttcaatggatttccgtcagtttttcgtggttgtttttgctcttttcaaccttatcaactttgccagcactactgatgttgccatcacgtttggtcaagtttctaatttgaatttgtgtaccaccgacctggccaacaacggtgttgattttcaagtcagcgatttgactatcacattcgaagtgtcctacaacttaaccttcagttgtttgtatttcactagtatcgaaatctccgaccaaacccaaacccctgtttatttgacttattacttcgcaagcaaccaagcaagaaacaattatttggttgaaatgtcttgtttgaccaacgttaatcttttgttgaaagacaatgcccttgttttctctccggttgtccttaacactccatcctgttcacccacttgcataattatggttacca

SEQ ID NO: 1712 - DNA, 518 bp, Gossypium hirsutum
  unsure (1)..(518): unsure at all n locations
  Clone ID: uC-gsronu33B061g03b1
gtttctgttgaagaagttggaggaaaaaaatagttctaatgatccacagggagaaggagtaggtgtctttgttacaggtgttaattgtatcttttttttaccttttngccgggttttcttggacaatcatattctgctttgtaatttcacttggataagctcctttgtatttcatcttgtcttttccttttccttttttcgccggcattgtttgaacatggggttgtgcgcccttcatttccagtttattattgtgacttttgtttttcaagttcctatcttttttatttttatttttttaaacgcttattgccattatcgattctttcagatttccacattatatattaatatccttgagttttttcttccttcatgctttcttctcttttcattcctttcttttctcttcttttggtcgtcctctttattattttctgtcttcctctcccttccttcttcattttttttttttttttgttttccccttattcaatttcttttcccttcttttccat

SEQ ID NO: 1713 - DNA, 377 bp, Gossypium hirsutum
  Clone ID: uC-gsronu33B061g04b1
cccacgcgtccgcccacgcgtccgatttttcttctgcttttctctcccgctctttgaatttccaaacttaaaaagctatgtctcagactgttgttctcaaggttggtatgtcatgtgagggctgcgttggagccgcgaagagagttttggggaaaatgcaaggtgtggaatcatatgaagtagattcgaaggagcagaaagtgacagtgaagggcaacgttcaacccgatgcggttctgcaaactgtgtcaaagactggaaagaagactgccttctgggaaggagaagctccggcagaagccgagacaaagccggtcaacggcttaaaatgtcttaagcccttattgattgattgattgattgatcgggtgtgctta

SEQ ID NO: 1714 - DNA, 70 bp, Gossypium hirsutum
  Clone ID: uC-gsronu33B061g06b1
ccagtacgtgcaaccactcgaacgcgcactcaatggcaagaatttctttggtggagaaaccattggaatg

SEQ ID NO: 1715 - DNA, 390 bp, Gossypium hirsutum
  Clone ID: uC-gsronu33B061g07b1
ttgctacaacctgccgccgcaacaatgaagtgcaacccgcgtgtctcctcctctcgccgcaagagccgaaaggcccatttcacagcaccttcttccgtccgccgcgtcttaatgagcgcacccctctcatccgatctgaagtccaagtacaacgtccggtctatgccggtgcgcaaggatgacgaggtccaagtgattcgtgggacctacaagggacgggaagggaaagtggttcaagtgcaccgccgcaaatgggtgatccacatcgagcgcatcacgcgcgagaaagtgaacggttccaccgtcaacgttgggatcaacccatccaaggttgccattaccaagctgaggctggacaaggtcgggaagtctttgctgtatcgtaaggct

SEQ ID NO: 1716 - DNA, 268 bp, Gossypium hirsutum
  Clone ID: uC-gsronu33B061g08b1
tcggctactcgtgcgctcactcgtaggaaaagggggccgccaagaccaagatctgtgtccactgggtacgatcgagaggagtcgaaacgcaatctcttaaagatggatcgacggagattcgtaatcgacgccgtcggagccgagcaaatggccaatcaatcaggcaagacggtgctccaactccttccttctttggtcaaatgagcccagaccgttgcctgcccgacgatctcgaagaaccaagttggggcagtctggatttgtttca

SEQ ID NO: 1717 - DNA, 496 bp, Gossypium hirsutum
  Clone ID: uC-gsronu33B061g09b1
cttcggttctgctcttgttacctccacgacagctatggtgggagacatgctgggatcctacaaaccatcagcaggtaaactggcgtcgatgtactcgccttttataggatttgggttcctagccatactgcgagggctgctttcggaatcccccaacgcttccaaaaccatggccaacggaccaacgtcggctttgaaaaagaaagcctgaagttgacacatgaattataaaacatcatcttcttccttgaaatgcgatatccatgttacaacaataaggatcaaaattcaaagtacaaaaaattacaaatactactagcaatctaatagtactggaagttgcttctttgccatgttcagaaagttcttatttaaaaggtgtgattatgtagccataatttttaatgctttgcattttcttccttccacttctactttacctccttttctctttctctcctctcccctgggtccttctttttttaggttccacttt

SEQ ID NO: 1718 - DNA, 247 bp, Gossypium hirsutum
  Clone ID: uC-gsronu33B061g10b1
ctaagaactagagttctacatgaagaagatccagagaaggaagggaaagggagctgcctaaagttttgttacttgagatatcatatttcagaccaaatgtcccttttttaacctttctttcatcattttcagtagattttgagattgtgatagtggttacacatttagtatgaattttcaagtagtgaagttgtgtcgtaattcaacagtattatcatatcaacaaaagaaaacaatcaacatattg

SEQ ID NO: 1719 - DNA, 321 bp, Gossypium hirsutum
  Clone ID: uC-gsronu33B061g11b1
gagctttcgtgtttgtctattgaattctttgggtcactttctcgaaaaaaaaaatgtcttcaggctgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggacgcatgtgtggatcaaactgctcttgtgattccatgcaattgttgaaaagcttgttgaatgccatagattctgataaacagatag

SEQ ID NO: 1720 - DNA, 90 bp, Gossypium hirsutum
  Clone ID: uC-gsronu33B061g12b1
tcgtgtgcaccatacttgttatgacaagattcatggatgcgatttacatgaaggtgaatgggggaaagtctatacctttgatgatctgag

SEQ ID NO: 1721 - DNA, 316 bp, Gossypium hirsutum
  Clone ID: uC-gsronu33B061h01b1
ctttaacacaagttacaaactcaaaaaccccaagttgtcactttcaaaaaacttcccacattcaccatgtctgacaggtgcggcaactgtgactgcgctgaccgcagccaatgcacgaagggaaacagcaacaccatgatcattgagactgagaagagctacatcaacactgctgtgatggatgctccagctgagaacgatggcaagtgcaagtgcggtactggctgcagctgcacagactgcacctgtggccactaagccaacatacaatggtcatgcttcaggtcatggcataatcagggatctaaataatgaa

SEQ ID NO: 1722 - DNA, 202 bp, Gossypium hirsutum
  Clone ID: uC-gsronu33B061h02b1
cgtactcgtccgcccacgcgtcacaaagcgtggggggttatttatagaataataggcacatattaccatgcagagttggggcagcaactgagacctgtcttccctgtagtctatgtacgaagggaaacagcgagaccatgatcattgagactgagaagagctacatcaacactgctgtgatggatgcttcacctgagaacga

SEQ ID NO: 1723 - DNA, 190 bp, Gossypium hirsutum
  Clone ID: uC-gsronu33B061h06b1
cgggacggaactgccgggaccgacccacgccggtcatcaatccagaccatactaatggtgacattgggtttgtattatgcacgtacggctgtctgactgccacggaatgtgacggccagggaacattctagcgtaatctgtgatcacatgagggctatctggtattggcaggtacccctcttgcctggcg

SEQ ID NO: 1724 - DNA, 148 bp, Gossypium hirsutum
  Clone ID: uC-gsronu33B061h08b1
tcgtcacgcgtccgcgatttcatattcctcacttttgcaacaaagtccacgaagagactacaccaacaaatggaggcattgtggatgagactatttttggctatgatggtggtgttgatggactttgagatgttttgatgtacacaac

SEQ ID NO: 1725 - DNA, 239 bp, Gossypium hirsutum
  Clone ID: uC-gsronu33B061h10b1
tcggtaaatctttatcattggattctctgaacttggttaacgttgggactcaattgaatattagcagctaaaatgttagattttctgtactccaatggcaaaactggcagtggacactgaatttgcggttttgtccaaagaacacaacagttgagggggagaccactcacacactagatgaatggctgtaacatttcaccagcctcaaaggattaacagtaggcgattgcagggcggct

SEQ ID NO: 1726 - DNA, 59 bp, Gossypium hirsutum
  Clone ID: uC-gsronu33B062a01b1
ctttctataggctgccagttagtttaacgaggggggggttattacatactatgtgcctt

SEQ ID NO: 1727 - DNA, 91 bp, Gossypium hirsutum
  Clone ID: uC-gsronu33B062a05b1
ctcactcttccgtagtgctgtggtgatgagaggacggagtttttaaacccatgggggggggttttgcacactccgagaacgcatacgatgc

SEQ ID NO: 1728 - DNA, 208 bp, Gossypium hirsutum
  Clone ID: uC-gsronu33B062a06b1
tttttctctttcttttttgttctacgcgtccgcttcaatagagcagtttgttggtctaagcttggactctgggaaaaatctgtagaggactgcaaccaggctcttaggatccaaccaaattacctaaaagccttacttcgaagggctgcctcgaacgcaaagcttggacggtggccagatgctgtgagagaatattagcccttaaaaa

SEQ ID NO: 1729 - DNA, 172 bp, Gossypium hirsutum
  Clone ID: uC-gsronu33B062a07b1
tcgttctgtcgttcttggtggtggaagttaaagaggaccatggcgacaccttggaggactttcagttttgcagtaaagagctccggccggcgctcaaagacatcctatggacgttgccgcccgagaattcgactgtggcttgatttatgcgaggtgttccatttcttccttc

SEQ ID NO: 1730 - DNA, 258 bp, Gossypium hirsutum
  Clone ID: uC-gsronu33B062a08b1
cttccgcgtccgctcatttcaaagtgttggtgggcctagtttattccacaggagactgtcttgctcaagtgtgggaatggtctgtcttgggctagttctatgcatggtggtcgcgccaagcttggccacggtttacaatgttggtgacgcctctggctgggcaaccggtgccgattctagtagttgggctagcgacaagacctttaaagttggagatcccctcgttcttaattacccatcaagccatacggtggagga

SEQ ID NO: 1731 - DNA, 186 bp, Gossypium hirsutum
  Clone ID: uC-gsronu33B062b02b1
cccactgtcgtccgaaaaaaaaaaaaaaaaaaagagaaggctttattaaaaaaaggggtccactttctttaaaaaaaaaaaaaataaaacacaatatatatatatatctttttactttccggccttcctttttatgttctccccaccttctttcttttttttctcctcctcttttctctttttttt

SEQ ID NO: 1732 - DNA, 400 bp, Gossypium hirsutum
  Clone ID: uC-gsronu33B062b03b1
cccacttcgtccggttgtttgctttctctcccgggggggttctcttagcctcccccatggccaaccatggaatcctcggcgattgtccgtgcccacgtcacgaacggcggtcagtattgggcgaaacggatccttttggtcctcctccgaacggggtcgaagacggagccttcacagcccaccatgatagaagagaaaagggaaggcccctttctgttcgtcgttcccttccacggcccttggctgaacccccaggggttcaacgaccttcaaatcggagagggaacgccggagcttccccaaacagtgaatcggaggtgtcgcgtgacgcgcggaagaggcgccgaccaggggtgtggtggccaaggcatgcggcggctgaagcttgtaaagggctaag

SEQ ID NO: 1733 - DNA, 377 bp, Gossypium hirsutum
  Clone ID: uC-gsronu33B062b06b1
tttcattttttcgcccacgcgtccggaaaagctagagaggctatttgaagtagtggaagcagtataccctgataagaatttggtcactttcagagagatcgaaggagacctaacggaagagtataagagctttgtaatcacgattcaagtttcgcccaagagcgagggtagtggcagcttagtgcactggactttggaatacgagaagctgcacgatgggattgcgcatcccgagactctgctgcaatttcgtcaagatgtctttaaagacattgacgcccacctcacccaagcaagctaaacagtatcacatgttgctattggtaccgctactttaagcactattcatctattcaatgaataaagtgacaactttc

SEQ ID NO: 1734 - DNA, 403 bp, Gossypium hirsutum
  Clone ID: uC-gsronu33B062b08b1
tgtttaagacaacaggcgtgctcttcgtggggtggtattctcaactcctggggctctttatttcctcagtggcgttattctctttgaggaaaccctttatcaaaaaaccgttttgggcaagcccttctttgatgttttgaaggaaggtggtgtcctccctggcatcaaggctgacaagggtacggttgagcttaatggaacccatggcgaaactttcacccagggtctagatggccttgcacagcgatgccagaagtactatgaagctggtgcccgctttgctaaatggcgtgctgtccttaagatcagtgctaatgaaccaaccgagcttgtaatccaagaaaatgccaacgggctagctatgtatgctgccatctgccagcaatgtggccttgtccccatt

SEQ ID NO: 1735 - DNA, 463 bp, Gossypium hirsutum
  Clone ID: uC-gsronu33B062c01b1
tttgaattcctcataaatgctttgaaaggaatgcagatgctgtcaggttcgatctctatcacacatgtggaagacgaatgccgagcccatgtttttctggctgaaaaagaatctgcatcgggtcgatatatatgcagcgctgtcaataccagtgtgccagaactagcaaagttcctcaacaaaagataccctgacttcaaagtccctaccgattttggagatttcccctccaaacccaagttgatcatttcctcagagaagcttattagcgaaggattcagctttaagtatgggatcgaggaaatctacgaccaaaccgtggaatatttgaagtctaaggggctgctcaagtgaagcgctttgacgcttccccaatgattatggtgtttgactgttgagctattgtgataatattcgaataacttcatgctctacaaatgaaggcaaaaccctgtggcgtttg

SEQ ID NO: 1736 - DNA, 330 bp, Gossypium hirsutum
  Clone ID: uC-gsronu33B062c02b1
ctcgaaaaaaaaaggggggttcaggttgcaattgcggatctaacttcagctgcggtgacaactgctcatgcagcaggaaccttaaccttggatattctgagaagacaaccatcactcagaccatcatctccggagttgcgccagtgaagatgacctttgagggaccagagatgagcactactgaattaggacatggacgcaagtgtggatcaaactgctcttgtgatccatgcaactgttgaaaagcttgatgaaagccatagattatgaaaaaaagaaagcagcaaaaataacaggcctttgtaatgattatattgtcaaggatggatg

SEQ ID NO: 1737 - DNA, 100 bp, Gossypium hirsutum
  Clone ID: uC-gsronu33B062c05b1
ctcactcttccggctggtcaagagacccagcacaggtgtcaataatggctgcaaggaggtaagaaccttaccaagctctgcacggtgggatatatagatc

SEQ ID NO: 1738 - DNA, 416 bp, Gossypium hirsutum
  Clone ID: uC-gsronu33B062c10b1
tcgtctactcatccgcccactcgttcgtcgagggggggatccatcaatcactcttgcggttcattgcatcaaacaaactcatgaaagtctatcctttctttctttagattcctactactctttcctgtctgtagacaccatctgcctaatctaggaaagatgctagagagtcctggcaagcctgtcactaaagatcctcctatgcctgaagcactccaagagctcacccgaattgaggctgccgatgccaaccccgatgagaaaaccaagtgccattacatcaggtcacatttgaccttaaggaagagaagactattgttaacgaggagtttgaaccaaggccaaacattttagctcacggtgatgacgctcatctaaaaggagataaatcatcatctcttgcagaagatttgaac

SEQ ID NO: 1739 - DNA, 286 bp, Gossypium hirsutum
  Clone ID: uC-gsronu33B062c11b1
gtatcttgatgagatagcaagcaagttgtcacgaaattgcagtggaagtgagactatccgcatggcacgatcacttataaccgcacgccatgctggtgagcggctcctcagatgctggggaggtggaactggctgggctgtagaagatgcaaaggacaagataatgaagctccttgaggaatacgaaagtggaggtgttgtagctgaagcttgccaatgtatccgtgaccttggaatgccattctttaaccacgaagtggttaaaaatgcacttgtgacggccatg

SEQ ID NO: 1740 - DNA, 363 bp, Gossypium hirsutum
  Clone ID: uC-gsronu33B062d01b1
ttattttcgctcttgagctcaagaagctgcggatagacaacagccttttggatgtctcacagtctgatttggaagttaatctttttaagctaatggagcgccgtggctctggggaagcggtcttggaccgtcccatggttgtagcctgacattcaccatcaaaaggtccctttggcgacacttgttgaacacacgccctgtgttgctactgatactcttccttctcatctcgcccagtggctgaaccttgcctaatgtcttacagacagatatggtttatgaatcgctgcgcacagcaacggatgcaccattggcatccactcctgtatgggaacgggatttcagctcctcccaggagtttgg

SEQ ID NO: 1741 - DNA, 324 bp, Gossypium hirsutum
  Clone ID: uC-gsronu33B062d10b1
ttgctcacgcgtccgcccacgcgttcggtcgatgggttctgtatgaggtgcgggactcacgggtcgaaccgggttggtcgggttcgaggtacttttatctgggttggaaactcggagactcaatgtcctggtcaatgcgcctggccatttcaccagcctatttatggtccccaaactccaccgttggtggctcccaatggagacgttgggattgacggaatgatcatcaccttggccaccctctttggctaacactgttaccaacccgtttaacaacgggtatttccaggggcccgccgacgcgccgttggaggcggtttcagt

SEQ ID NO: 1742 - DNA, 440 bp, Gossypium hirsutum
  Clone ID: uC-gsronu33B062d12b1
gttcaaggaagaggctgaaaaggagattgcagaatatcgagctcaagtggagaaggagtttcagaggaaacttgccgagagcagcggggattcaggtgctaatgtgaaacgccttgagaaagagactgaagcaaagattgaccacctgaaaaatgaggctgcaagaatatcagatgatgttgtccaaatgcttctcaagcatgtaacaactgtaaagaattaggccccttgagatggcaaacattcaatatatgttactgttgttcccctgcatgatgtaatatttgcgttgttgccctcacctggtttagactctggtgagtaaattagaccctttttatcagatacatcagtttgagaacatgtaggacaaattgtgtgcctatctatttatgctggggaaaagagcaataaagttttaataatgtcaatatttttgc

SEQ ID NO: 1743 - DNA, 214 bp, Gossypium hirsutum
  Clone ID: uC-gsronu33B062e08b1
tcttttacgcgtccgtccacgcgtccgcttatctggataatgcagttgtcttcattggttcatgttatggtgattcacagctgataaagttaaatctacaacctgacgcaaaaggttcttatgtggaagttttggaatggttcgccattctcaggtcctattgttgtctttttgcgtggtttcatccctattcttacgctttttctctttcttc

SEQ ID NO: 1744 - DNA, 129 bp, Gossypium hirsutum
  Clone ID: uC-gsronu33B062e09b1
atatggtgcattaatctggagcacacagggggggggagagtcccagaccagagcggtttcggttaggggtaataccaagaaacccaaattttacccaatagaatgggctcaaggaaccacccagggagg

SEQ ID NO: 1745 - DNA, 267 bp, Gossypium hirsutum
  Clone ID: uC-gsronu33B062e10b1
tcgctcatcagctgcggatccattgcttccctgggggctgtttgcaaaaaagagagaaaatgaaggctgttgctgcttatctgctggctgtacttggaggcaatgccttttcttcagctgatgatcctaagaacattcttgccagcgttggagctgacccctaagaggaaaggctccagcttcttttatctgaagcgaagggaaaagatataaccgagcttattgcatctgggagggaaaagcttgcctctgttcccagcggcgttg

SEQ ID NO: 1746 - DNA, 446 bp, Gossypium hirsutum
  Clone ID: uC-gsronu33B062e11b1
ctcacgcgtccgctcacaggctcgatccaaaggggaagctgcaagagtgaaggctgtccatgaagcatacaaagaacttcaaaatgcaaggcaagaagcattgcagagaaagaaagcagagaagaaaaatatgttagaagaggcagaggcaaagctcagtgcagaagcggctcgcaagagagaagcaaaagatcgtgctcggcagatgaagaaggcaatgccaagaatgaagatgacccgcgcacattagatggctgtggacattagtagtatgaatgcttactcatctgcagattgcaggttattagttccctggtttctgtatgtcactgggaatgtatttttagttgtcaactaccgattcggaatgtccctgaagatactgctccaggaacttgataaagtttctttcatggatgacattttaaacgcatttcccaagtaat

SEQ ID NO: 1747 - DNA, 254 bp, Gossypium hirsutum
  Clone ID: uC-gsronu33B062f01b1
atattcaaaaaaaaaaaaaaaaaaaaaaaagggaaattttaaaaaaaaaaaggggagaatttataaaaaaaaaaaacacacaaatattactaaatataatatattttattggggggggcctttcttgctgccctttttttccctccctctctcttcgctgttttttttttttttcgctttctcttctcctcccttcttttggccgtctttttcccctcttttttttttttactctctgcctctccccttctttt

SEQ ID NO: 1748 - DNA, 183 bp, Gossypium hirsutum
  Clone ID: uC-gsronu33B062f03b1
attgtatatccagtgagataaagcaatcaagttatatgcacaagatgttattcttctctcaacatgatttatttgatgtcgacactggtatccgattccttcaatatgcaggccttgcgtggtccgtggtagatcttgtcccctccctcttctgtcacctgaggttgtgatgcttctccttgg

SEQ ID NO: 1749 - DNA, 64 bp, Gossypium hirsutum
  Clone ID: uC-gsronu33B062f04b1
cactatattgatagctggtaccccctgcaggtaccctttctctgaatttcccgggttcgaccca

SEQ ID NO: 1750 - DNA, 307 bp, Gossypium hirsutum
  Clone ID: uC-gsronu33B062f09b1
ttcacgctagccaacgaacgtttttctatctggtcctgcttggtatacctaccgtgtccaaccacaacggcctgagggccttagaaacaccttgaggatggctgatgtatcttaggcttaggatgcttgacaagctgtggtggtgcttttgcacacaaatcatgatgtggaccccagaaaggctggaatagctcgtcacttactttcattttgggatcatgatggtcttttgatcatccgctcaggaaagttataggtattgtcacgcataggcatatcatggaaagagggaaggtccatgccgaca

SEQ ID NO: 1751 - DNA, 440 bp, Gossypium hirsutum
  Clone ID: uC-gsronu33B062f12b1
tttacgcgtccggaaagtagcagaccttccttttcttcaataaccaaaactgctggttttcttgacaaggagcttgctgcaagtggatttacgagaaaagatgaggatgacattcagaaattcattgaaggtgatgttgaagaggatgatgtttctgatggtgaacatgattctgagttatgtcaaacaaatataaagggctttgattcattgcacttagatcaggaagagtcaacttcaagatgtaacgaggaaggtcaagtagttgaaaacctccaaagccctgaagtaggccagaggggtgatcctgaaagtcaaaacttgagcagcaatgagggtgacgaaaatgatgacactgaactcgtgaagagcttggcgaagcatagacgacgggcgatggcagcagcacgcaaagggcatcataagaatagcacatctag

SEQ ID NO: 1752 - DNA, 439 bp, Gossypium hirsutum
  Clone ID: uC-gsronu33B062g07b1
tttcaagtctcaggcttctgccttggaacaggatgcagctcctaactgcaaggttttggttgttgctaaccctgccaacaccaatgcattgatcctgaaggaatttgcaccttcaatccctgcaaagaacattacctgtttgacaaggttggatcatatcagggcactaggtcaaatctcagagaaactaaatgtccaagtttctgatgttaagaatgtgattatttggggtaatcattcatcaactcaatatcctgatgtcaatcacgcaactgttatgactccatctggagaaaagccggttcgcgagcttgttaaggatgatgcatggctgaatggagaattcataaccactgcccaacaacgtggtgctgctatcatcaaagctaggaacctcttatgtgcactatcttctgcctgtgctgcttgtgatctcatt

SEQ ID NO: 1753 - DNA, 66 bp, Gossypium hirsutum
  Clone ID: uC-gsronu33B062g08b1
cttacgcgtccgcccacgcgtccgaatctttgtagtaacttccttattgaaggtattaataactac

SEQ ID NO: 1754 - DNA, 139 bp, Gossypium hirsutum
  Clone ID: uC-gsronu33B062g10b1
ttctgttacgcgtccgctttccttctcttcaacgggagctgctaaaatgcaccaatttccggtgcttcctagcctcatcgcagtgtctgtactgctgatggtaactacagtttattgtgttctgttcatggcctcactt

SEQ ID NO: 1755 - DNA, 283 bp, Gossypium hirsutum
  Clone ID: uC-gsronu33B062g12b1
tttatatggtcattgctaaacctggaagcgtgaggacatacaaaaggtttgaggcagagatatatgtcctcacaaaagatgaaggtggacgtcataccgcctttgaatcaaattacaggccccagttttatctgaggacagcagatgtgactggaaaagtggaattacccgaaagtgttaagatggttctgccaggggacaatgttactgcaacttttgagctcatctcacctgtgcctcttgaagcaggacatagatttgccttgagggatggaggtagaac

SEQ ID NO: 1756 - DNA, 138 bp, Gossypium hirsutum
  Clone ID: uC-gsronu33B062h01b1
ttttattgcagtcaaaacaaaagatggctattcgcactttcttatttgccttcctgcttctgcttctcccattggaattcattgctgttatgggggttactcctcctcttcctcttcctgagtgcagacccatcgcgg

SEQ ID NO: 1757 - DNA, 444 bp, Gossypium hirsutum
  Clone ID: uC-gsronu33B062h06b1
ctttcttctcttctttcaactcaaaaactgcggagttatattagaatcatgggtgttgtcacttataactatgagtctacctctccagtcgcccctgccaggcttttcaaggctttttctcttgaagctgacaaggtttggcccaaggctgctcctcaggcagtcaagagtgtcgaggttgaagctaatcctggccctggaagtatcgtaaagatcaactttgctgaaggccttccattccaatatatgaagcaccagattggaggacatgacgacaagaatttgtcatacagttatagcttgatcgaaggtggacctttgggggacaagcttgagaaaatcagctatgacaacaagtttgaggcagctgctggtggaggatgcctttgcaagagctcgatgaaattttacactgttggcgactatgtgatcactgaaagatga

SEQ ID NO: 1758 - DNA, 299 bp, Gossypium hirsutum
  Clone ID: uC-gsronu33B062h12b1
gtcccgttctgaattgcccgatccacccaaccgtttttttctttcggtcaggcaaccgttcctgcgggcgggagttctttgggaatttggggcccatatcctgttcaagagctttgcaatctcatcgagctacataaaagaaatatggctcttataaatatgggcttccgattttcagctccagaatactttccaacacatgatggatctttccgacaatacgtgagtagaccctgaacgcaccatcaacggtttacatgcggtatgccaaattcttggctgcaacatcagcggccatt

SEQ ID NO: 1759 - DNA, 272 bp, Gossypium hirsutum
  Clone ID: uC-gsronu33B072a03b1
atacaatctacctgcttctagctctccttttgaatcaatctccatttttagttttcgtaaagcgaaaggatgttaggcattttcaagaaagaattaatgaatccaccaaaggagctgcatagcccagcttcactcacttcatcaaacaagaccaagcttcccaatcaaatcatcaaccatttcctttcttcaaatcccaacaatgctttctcaatggggttcggattcttacctttgctttgctaatgcttctacagagaatcttttttttc

SEQ ID NO: 1760 - DNA, 130 bp, Gossypium hirsutum
  Clone ID: uC-gsronu33B072a05b1
actacgcttccggtctcactcaaaaggtgcttcactctggttctttggtgccctcttcgcagaaaaaaagcgagagatcctacagattcaaggtggccaatgcggtaaccaaatcggagccaggctctgg

SEQ ID NO: 1761 - DNA, 172 bp, Gossypium hirsutum
  Clone ID: uC-gsronu33B072a08b1
tgttcgatcactcaacactacatcaacatggaagctgagaactcgtttttgagagctcagatgattgaactgagtcaaagactggagtcactcaatgaaattctttcattatcttaatagtgtttccaatagcaacaccagcaactatgggttctatactagttttggtatt

SEQ ID NO: 1762 - DNA, 110 bp, Gossypium hirsutum
  Clone ID: uC-gsronu33B072a09b1
tgttcgatccattaccaattcccttcaatttctgcattttctctgaaatccaatggatccagtaagcacccggcgcaatatccttcctcgactccgttgaccccaatatc

SEQ ID NO: 1763 - DNA, 228 bp, Gossypium hirsutum
  Clone ID: uC-gsronu33B072a10b1
ctgattctcggattctctcttcatctcccaattctcaaaaccctaattatatttttttatttccctttttgattcagcaatcggggcttgccaatggccaacagtaatctccctcgaagaatcatcaaggaaactcaacgtctcctcagtgaacctgctccgggaattagtgcttcaccatcagaggataatatgcgacttttcaatgtgatgatccttggttccaca

SEQ ID NO: 1764 - DNA, 79 bp, Gossypium hirsutum
  Clone ID: uC-gsronu33B072b05b1
ctttcgtggaaagaagcaaccaaaggctgacgcgtagggtcttttacaacattcactcctttcagaacacaaaagaaac

SEQ ID NO: 1765 - DNA, 74 bp, Gossypium hirsutum
  Clone ID: uC-gsronu33B072b06b1
ctcacgtgtacgcccacgcgtccgaagtctaagaaaagatttttttagagcataaaagatttgttacaaacacg

SEQ ID NO: 1766 - DNA, 159 bp, Gossypium hirsutum
  Clone ID: uC-gsronu33B072b10b1
tcgatgatgatgatgagcagctcctcaagacataatgaaaaagaccaactttttcatattcttcataaagttcctcaaggtgatactccttatgttaaagccaaacatgctcagctggtagaaaaggaaccagaagcagcactagtactatttttggaa

SEQ ID NO: 1767 - DNA, 187 bp, Gossypium hirsutum
  Clone ID: uC-gsronu33B072c12b1
tcggtaactttggcgacccaactttacactgctcttggtcacccttggtgaaaagggtagccgatactacaccaagaatttccgtggggcagtcgatgctttccatgtcaataccgcggacacaactggcgccggtgactcctttgttggtgcattgctatgcacgattgtttaactcccaaccatt

SEQ ID NO: 1768 - DNA, 105 bp, Gossypium hirsutum
  Clone ID: uC-gsronu33B072d01b1
ctgtgtatgagtccgagttacagaatttaccggcagaagaattgttgtgtcgcctcttttaccgaggttgaaagccgataggttagttaatttaggggttgaggc

SEQ ID NO: 1769 - DNA, 93 bp, Gossypium hirsutum
  Clone ID: uC-gsronu33B072d05b1
gtcggctatgattctactacagagcagtcctgttacgttagcaccatggcatagtctaagtgctcgtgtccttgacagtgggaattcaccttt

SEQ ID NO: 1770 - DNA, 175 bp, Gossypium hirsutum
  Clone ID: uC-gsronu33B072d10b1
ctcacgcgtccggcctagcaaaaggaattgataagaaaagattgattgatgatgttaggcaagctttatatgcgtccaagatatgcagttatgctcaagggatgaatttgttgcgagccattagtgcttcatcctggcttgttcttccctcttatttcttctcctcttttttttt

SEQ ID NO: 1771 - DNA, 108 bp, Gossypium hirsutum
  Clone ID: uC-gsronu33B072e01b1
ccggaacgcccttcccgacccaccccacccgtttcttaatacacaccaaaaaaacaaaagtataaaatagttttaaaaaaaaataccaccccttccacaccaaaaagg

SEQ ID NO: 1772 - DNA, 108 bp, Gossypium hirsutum
  Clone ID: uC-gsronu33B072f05b1
attctatcctatcaatatttatgtacttcttctttctggtttttttacatgcacccaatgtagaaaacccaaaaaccgagagttcttgccctcaaaggacctaaatga

SEQ ID NO: 1773 - DNA, 483 bp, Gossypium hirsutum
  Clone ID: uC-gsronu33B072f07b1
tttttatttatgagaaggaaaagaaaaagaaaaagggtggttttaattaaaaaaaacccaaaaaaacccttaaaaaacaagaaaaaaaataagaataataaaaaacaaatatacaaaataaaaaataattaaatataaaaaataagcaaaaaaagtaataaaaaaaaaataaagagaaaaaaaaagaaaaaaaaaaacgtataaaacaacaataaataaaaacaaaaaaaaaaagataagatataactaaaataaaagaaaaagcataaaaataaaggaaagaaaaaaaagtaaaaataaaaaaaaaaacctaattaataaaaaaaaaaaaaataaaataaaaaacaataaataaaaagaaataaataaaaggaaaaaagaataaaaaaaaaaaaaacaaaatataaatactaaaaacaaaatacaaaaataaaatgcatagttcgtaaaaaagatagaataaagtatggtaaccgatagaac

SEQ ID NO: 1774 - DNA, 193 bp, Gossypium hirsutum
  Clone ID: uC-gsronu33B072f08b1
atcggtacttttcgcagtctctctggtacttaaaagggaattcaaattccaaagagaaaagtgcgagaaatttcatatatttatctacacagcaaaaagaagagaaaaaagggaattcaaatttcgaaagagaagaaaaaaattgatggttatggatcattgttcttcttcttttatatattttccttttttt

SEQ ID NO: 1775 - DNA, 53 bp, Gossypium hirsutum
  Clone ID: uC-gsronu33B072f10b1
tctcactcgtccgcccacgcgtccgcacttgttcattttgtcatatgtggaag

SEQ ID NO: 1776 - DNA, 69 bp, Gossypium hirsutum
  Clone ID: uC-gsronu33B072f11b1
ctcattagagtatttcttcaaaaaacagcatcggtgttgccccatgcatacaaggcatccaaacacggc

SEQ ID NO: 1777 - DNA, 57 bp, Gossypium hirsutum
  Clone ID: uC-gsronu33B072g01b1
cgcgttacgtagttcgaataatattgcattcgtccttttggtttaattttaacaccc

SEQ ID NO: 1778 - DNA, 89 bp, Gossypium hirsutum
  Clone ID: uC-gsronu33B072g06b1
acgcacccggtccgttttttaggcaaccacacaaccaaaaggagaggtttcaatttgcacgcccgtgctttccaactaaaaaaaaataa

SEQ ID NO: 1779 - DNA, 107 bp, Gossypium hirsutum
  Clone ID: uC-gsronu33B072g09b1
atcggtacaaccatgacgtcccagcagctcgtggcagtgttagttatttcgtcaacagacctctactcgacaacaacaataacattggggcaatgacacttaggcca

SEQ ID NO: 1780 - DNA, 93 bp, Gossypium hirsutum
  Clone ID: uC-gsronu33B072g12b1
ctcacgcgtccgaaaaaaaaaaaaaaaaaaaagttttaataaaaaaaaacaaaaaataaaaaacaccataaaaaaaaaaataacacaaattag

SEQ ID NO: 1781 - DNA, 165 bp, Gossypium hirsutum
  Clone ID: uC-gsronu33B072h03b1
ctcacttgtccgggagacctttctatccacatgagagtctgttaacgagggacaccccgacaagctttgcgaccaggtctctgatgctgtgctcgatgcctgccttgcccaggaccctgacagcacggttgcctgtgaaacatgcaccaagactaacatggtcat

SEQ ID NO: 1782 - DNA, 67 bp, Gossypium hirsutum
  Clone ID: uC-gsronu33B072h06b1
ctacgatgcaacaatatgtcttcactactctcacgttgctcatcctgatttccctcggatgtccaac

SEQ ID NO: 1783 - DNA, 54 bp, Gossypium hirsutum
  Clone ID: uC-gsronu33B072h07b1
atcggtacggggcttccttatgctaagtcgctcaggggtcttttttccaagacg

SEQ ID NO: 1784 - DNA, 126 bp, Gossypium hirsutum
  Clone ID: uC-gsronu33B072h08b1
atcgctcacgcgtccgaaaagttcctcgagaaacatgggagattgaagctgtcatggcagggggaccatggacactcaacactgatgcttggtttagatgcactgccttggccaggaccctgacag

SEQ ID NO: 1785 - DNA, 106 bp, Gossypium hirsutum
  Clone ID: uC-gsronu33B073e07b1
catttcaggctgtttcagcgctgcaaatcacagaggacgcataagtagtagacaccatcgagcttgacagaatgttgagaggctagtctagtatttttctgttgta

SEQ ID NO: 1786 - DNA, 180 bp, Gossypium hirsutum
  Clone ID: uC-gsronu33B073f01b1
tccacagcagtccgtctttctactctactacaatagatatcgtaaacgatccgtaatagttaacatttaaatgacacctgacatgattctcacctcttattttgtccttataatccttaatcggttaaatgatatgttgatgtgacataattcaaaatgaaaaaaaaaaaaaaatagaat

SEQ ID NO: 1787 - DNA, 93 bp, Gossypium hirsutum
  Clone ID: uC-gsronu33B073f02b1
tccactagtggtagatgtgaccccgcaggtgccagcgcgccgcaggttccggggggagccccacgcgcccgctctctgtgttcggtttaaaat

SEQ ID NO: 1788 - DNA, 96 bp, Gossypium hirsutum
  Clone ID: uC-gsronu33B073g09b1
agtttccctaatcgtgttaaaaatcatactaactcaataaatgaaaaaatttaaaattattgaactttgctgatataacatagtgcattaatttta

SEQ ID NO: 1789 - DNA, 79 bp, Gossypium hirsutum
  Clone ID: uC-gsronu33B073h01b1
ctcaatcaagagagtttttagtgatctttccattttttttttattcctttgttcatcggagtgaagaaaacattggggt

SEQ ID NO: 1790 - DNA, 66 bp, Gossypium hirsutum
  Clone ID: uC-gsronu33B074a01b1
agaatagatcgtttattttttgctttcttatcgacgccatggcacctaacggggtcgtttccgaca

SEQ ID NO: 1791 - DNA, 68 bp, Gossypium hirsutum
  Clone ID: uC-gsronu33B074b03b1
ttcctcgttagctggtttatggtacgatggtatatgtccgacaaaaaattgtagccgatgcttcttgt

SEQ ID NO: 1792 - DNA, 63 bp, Gossypium hirsutum
  Clone ID: uC-gsronu33B074b04b1
gactagttcattttcaagtttttttttttttgtttaatttcattgaatattgacccttgtttg

SEQ ID NO: 1793 - DNA, 97 bp, Gossypium hirsutum
  Clone ID: uC-gsronu33B074b07b1
aaccaatcctttgtatatatacaaacatcctaatagtcttcccttgctgcaacaaaaatcgtatttgtatttgtactattttccaaaacaatccctg

SEQ ID NO: 1794 - DNA, 216 bp, Gossypium hirsutum
  Clone ID: uC-gsronu33B074b09b1
cttattctcgtgatcggaggcggggcacggcccctctttttggacccttcattggagctgcacttgctgcagtttaccaccagataatcattagagctattccattcaagaccagagattgaaatgattaaatctgtgtgtgtgtgagtttcgttttatttctctttatatcctttaatattttttttttatatattttacttattttttattatt

SEQ ID NO: 1795 - DNA, 80 bp, Gossypium hirsutum
  Clone ID: uC-gsronu33B074b12b1
tccacgcatgcgcccacgcgtccgcccacgcgtccggtttgtatcaaatcattgtctgaaaatatatggcatcttttatt

SEQ ID NO: 1796 - DNA, 59 bp, Gossypium hirsutum
  Clone ID: uC-gsronu33B074c02b1
cccacgcgtccgcttccttactggttccttagataaatctgccaagctatgggacacaa

SEQ ID NO: 1797 - DNA, 211 bp, Gossypium hirsutum
  unsure (1)..(211): unsure at all n locations
  Clone ID: uC-gsronu33B074c06b1
attttgcaggcattcgcaaattcaagaaaaaaagtttgaaattctgatgcccggaagtgaaatcccagaatggtttagccaacaaagaagtgactcttcaattaagatacccgtctcgaaagatagtcaatggattggagttgcttgttgctgcatttttgtcaataatgatgcttcaagggatgacgagtctatcggttgnggagcattt

SEQ ID NO: 1798 - DNA, 143 bp, Gossypium hirsutum
  unsure (1)..(143): unsure at all n locations
  Clone ID: uC-gsronu33B074c11b1
tccacgcgtccgcttctttagaattctggtcagctaagcactctcgcaactaaagactcagatccgntcggcattatctttccaggcttagaatggagacctttctattcacatctgagtcagtaaacgagggtcaccctgac

SEQ ID NO: 1799 - DNA, 51 bp, Gossypium hirsutum
  Clone ID: uC-gsronu33B074d06b1
cccattcgtccgaccagcacccttgtttgagcctagtgagttgacctcatg

SEQ ID NO: 1800 - DNA, 278 bp, Gossypium hirsutum
  Clone ID: uC-gsronu33B074e06b1
atcagtttaatatgaagtgttatctgcaggttcagctgaaccaggggatgacattgttgaagaatggatttctgcaagtccggctaacacattcctggatagagggaaatcagatgttgtactctccattcttctttcatattcttttcttcctctatctctcttttttcctatctctctctttttcttttttcctcactctaccctctttttatttcttcttctctctctctcttttctcttccccttctccatcctccttttattttatcttatct

SEQ ID NO: 1801 - DNA, 51 bp, Gossypium hirsutum
  Clone ID: uC-gsronu33B074e10b1
atcaatagggcatctatgtttttatgttactaccttttgttggattgttga

SEQ ID NO: 1802 - DNA, 108 bp, Gossypium hirsutum
  Clone ID: uC-gsronu33B074e12b1
cccacgcgtccgcagaaacactccctcttttccccttttgtgcgagccctaagtagaccaaaccctagccgccatgtagccaccgcaaacggtggtcgacggagggtg

SEQ ID NO: 1803 - DNA, 166 bp, Gossypium hirsutum
  Clone ID: uC-gsronu33B074f02b1
gtcctcgtttactgctccaaataccggaaaagagaaatcgtctggcgagaaagacagggaagctatgcaggttgatggtcctccggagaagaaaaccgagcctgagccatcatttgagattttgaccaacccagcaagagtggttccagctcaagagaagttcatc

SEQ ID NO: 1804 - DNA, 602 bp, Gossypium hirsutum
  Clone ID: uC-gsronu33B074g10b1
gaggtcattgcttactgatagaactttatcatattgaaggaaggcagtagtcgctcaaattacccaatcctgacacggggaggtagtgacaataaataacaatactctttctctatgagtggtggtgattgtaattatgttcaatttatatcccttaatttggatttctttttttatttagttttttatctgttaatttttataattatttatatatttattttatatttaattatattcttattttttattcatctatttttttttattattttttttttattattattttattatttattttatttttttttttttttttttttatttttttattatttatatattatttcatattctacttattttcataattattatttattaattattattataatttctattaaattaatattctatatttttattttatatttttatttaccactttatacttattcaaactttatatttttatattattttttatttataattatctttaacttatttattattatctttatattatcttatatattattcttaattattaatatttattaattttttatttatcttattttttacttatataa

SEQ ID NO: 1805 - DNA, 247 bp, Gossypium hirsutum
  Clone ID: uC-gsronu33B074h06b1
ttctatacttattttatatatattttctatatttattttacatatcttcatttttatttataattttataactattctttcttattttttaccttcttcatattatttatctattctatattttattttcttatctctctctctaatttttttctctttttcattctatttctattatatttatttacttcttattcttcttttttctattctttcatattttttattcttgacttaattattctaa

SEQ ID NO: 1806 - DNA, 174 bp, Gossypium hirsutum
  Clone ID: uC-gsronu33B074h08b1
gaggttctcactttcaacgacactaatctttccgataacctcgtcccggccatgcaaagcgttcatacggcacttgtaaacctcgggctcgacaaacaggtgacagtaaccacagcgcattctttaggcatactacaaacctcttttccgccgtcagccggagctttccgtgag

SEQ ID NO: 1807 - DNA, 509 bp, Gossypium hirsutum
  unsure (1)..(509): unsure at all n locations
  Clone ID: uC-gsronu33B076a02b1
gaaaatttagtttatgaaaatcaaactaacgaaatacacactctttctcagtctttaattaattcctcttccgcctgactcagatcagatccgttttctatccacaaacaaagaagcaaattcgtttctttgtttcaagaaaacaaagaaatgtcaaattcgcatagcgatacgatacctcttcacccctcgtcccaatcggacatcgacgagatcgagaatctaatcaatgccagcgtccaatccggtccagccactgtactcccggcccgccctccaagcccacctcgggcctccatcccggtctcttcttcccccttcatccagtccaaaatccctcctccgcctccgcagtcttcatcatcgtccaatcataaggtgccgtctgtccctgctgcccctcctnctnctccccccgtcggtaactctagcagcatcgtggccaccgggttcggtcctccgtctaacaccctaacggagcctgtttgggacaccgtgaaaagagatct

SEQ ID NO: 1808 - DNA, 79 bp, Gossypium hirsutum
  Clone ID: uC-gsronu33B076a05b1
aggttcgcctacgcgtacgcccacgtgtatttttcgagattacccattaccccaatggtacagatcaagattgaatgtt

SEQ ID NO: 1809 - DNA, 335 bp, Gossypium hirsutum
  unsure (1)..(335): unsure at all n locations
  Clone ID: uC-gsronu33B076a07b1
ttatctttcagcattatactgtttagaacactggaaaccgacgccggaaaaacgaaaggatggcagttcattgacatttacagatgatgaagagaaaaaaagtaatttagttttcaaaaaagaacattttaacatgtctatggtttaatttgccaatcatgtaatgttctgtgttttacagtttcttgcttttcaatcgagcactcaagcttggtgtcttttcccattttcaaattgggttaaatttagggactggattggatatttgcctatatatatatttatatattcgaatttatatatttttatatgctttaatctttgaattcnnaana

SEQ ID NO: 1810 - DNA, 432 bp, Gossypium hirsutum
  Clone ID: uC-gsronu33B076a09b1
acgctcacgtttccgctttattttctcgcctgtgacgagaagccgacgctaccatggttgacgtcagtttctaccgcaactatgggaagacctttaagaagccacgacgtccgtatgagaaggaacgattggatgctgagttgaggcttgtaggagagtggtctccgatgtaagagggagctgtggagggttcagtatgctttgagccgcatacgtaatgctgctagggaccttcttactcttgatgagaagaaccctcgtcgtatttttgaaggtgaagcccttcttcgtaggatgaacagatatggacttttggatgagagccagaacaagctcgattatgtgttggctgtgactgttgaaaacttgcttgtacgtaggttgcaaacgctcgtgttcaagactggtatggccaagtcaattcaccatgca

SEQ ID NO: 1811 - DNA, 468 bp, Gossypium hirsutum
  Clone ID: uC-gsronu33B076b01b1
cccacgtttcctcccacgcgtccgatcaaatcctggctcgcattcgctgcccagaaagttgttgaagtcaatgcacttgccaaggcattggctggtcagaaggatgaggccttcttcgctgccaatgctgccgctcaggcttctaggaaatcctccccgagagtgaccaatgaggctgttcaaaaggctgctgctgctttgaagggctctgaccaccgccgtgcaacaaatgttagtgctagactcgatgcccagcagaaaaagcttaacttaccggtccttcccaccacaaccattggatccttccctcaaaccttggaactcaggagagttcgtcgtgaattcaaggctaacaagatctctgaggacaattacattaaagccattaaggaggaaattaagaaggttgttgaccttcaagaagagctcgacattgatgtcctggttcacggagagcctgagagaaac

SEQ ID NO: 1812 - DNA, 336 bp, Gossypium hirsutum
  Clone ID: uC-gsronu33B076b04b1
gaagcttatatccgagacggagcagaagccacagcccaggagaagctggaagcccaatcagaagcagaagccgtagccggagtccataccatgaggaatacaagagggaactcaatggagaaaggtctcccagtcaatgatattgtgctgccatcttttgtattgtttggtgtatttgatgatggatgctggtgtttgaacttaaaatttggatattttcaaggttttagagtccaactggttatgtcgtaaaaagagttattgcagctgagattctttcttaaggccgtctgttaactagtaatcaagtactgaaattgaggaaccgttttgccc

SEQ ID NO: 1813 - DNA, 209 bp, Gossypium hirsutum
  Clone ID: uC-gsronu33B076b05b1
acgatcaattttggttgcattgacaccgaagaagattacccttacactggtcatgtcggtacatgtgttccataccggaaaaatgctaaagttgattcgatctattgttttgaggatgtaatgccatgtacccacctggtggttcaagtcttggacagcaaatattctatgggcaagcaccttcgatttttcccccttagtctggattt

SEQ ID NO: 1814 - DNA, 470 bp, Gossypium hirsutum
  Clone ID: uC-gsronu33B076b07b1
acgtttacgtttccgggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgtggagaagtatacatggaagatttactcggagagactattgaccctgacccgagtgtatggattctggaagcatg

SEQ ID NO: 1815 - DNA, 463 bp, Gossypium hirsutum
  Clone ID: uC-gsronu33B076b08b1
tttacgtttccgcccacgcgtacggcaaatcaagttcacagcaattggggtttaccttgaacctgaagttgtagggcatttacaacaatggaagggtaagcctgggaacgtgctagctgaagatgataacttcttcgaggctcttattaatgctccagtggagaagtttctgagagttgtggtgattaaggagatcaaaggttcccaatatggactgcagctagagagtgctgtgagggaccgattggcagctgacgacaaataccaagaggaagaggaagaagccttggaaaaagatgttgaattattccagtctaaatatttcaagaaggattcagtcatcacttaccattttccagcaaattcagccactgctgagattgcattcacgacggagggaaaggagggagcataaatcaaagtttagaatgctaatgtggtcgagatgatccagaaatggttc

SEQ ID NO: 1816 - DNA, 282 bp, Gossypium hirsutum
  Clone ID: uC-gsronu33B076b09b1
atagagtcaagaacggagcttaaatcagaaacattgctgacaaatttgttgagagaaaagctgtattctaaagagcttgaagtcgaacagttgcaagccgaggtggcagcaggtgtgagaggtaacgatatcctactatgtgaatcacagaatgaactggaccaccttttctgcctcaaccacagattgaaggatctagtacatgcaccacgctccagaatgcactcctccttcgccgactccccccccagtagatgcccacacaccaagttcttctccccc

SEQ ID NO: 1817 - DNA, 475 bp, Gossypium hirsutum
  Clone ID: uC-gsronu33B076b10b1
tttacgtttccggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaagtatggtaaagatgattcccaccaaacccatggttggtgagactttctctgaataccc

SEQ ID NO: 1818 - DNA, 464 bp, Gossypium hirsutum
  Clone ID: uC-gsronu33B076c01b1
cagaatttaatttaaaagccaaaggaagatgaagaggtggttcgatccatggcccgtgttcttcaagagagagttcaatcgcacttggcctttcctcgttggtttcgccgtcaccgggaccatcatcacaaagttctcccttggtctaaccgaggaagatgctaagaactctccctttgctcagaagcacaagaggtgatccaactgatttcaaaagcctatatggttgcagtcccttggtatgagaggctcagttgttttcctttttccttttcccaatgaacaatgaaaataacagaagacatcagttctgagtacactttattttgtgaattatgattttgtcatcaattaatgattttgctttgaataaggttaaaacacccttccagttagtgattatgtttgacgcccttgattctgggtttatgatattgaggatcaaaacatgaaaattttgtgcc

SEQ ID NO: 1819 - DNA, 224 bp, Gossypium hirsutum
  Clone ID: uC-gsronu33B076c02b1
gattattatatatatgcagatatgaaggaagatgtggtttgccaactaactttgatgcctcctattgctatgctttgggctacggcgccgcagctctcctccacagtggaaaaactgggttgatatcatcggttcgtttccgcttcttaactattgtccttctgcgttgatatcgttattcaattgtgtttttaaacttgggaaccaagtatttggattttcta

SEQ ID NO: 1820 - DNA, 307 bp, Gossypium hirsutum
  Clone ID: uC-gsronu33B076c03b1
cttgatatggtttagattgtaatggggcttgaggaagagtttggaatcactgtggaagaggacaatgcccaaagcatatcaactgttcacgatgcagccgagcttatcgacaagctctgcggcgagaaaagtgcctagaaacaaaccaaggacctaagtttgggattcatttgccaatttatttgtgaactcatcatgcctatttatttgttcaaatctagtaaaactcataaagtggttggtattttagttaaattatggatttaacgcttttgtgttgtaagtcaagaaaatactatttgatctt

SEQ ID NO: 1821 - DNA, 292 bp, Gossypium hirsutum
  Clone ID: uC-gsronu33B076c07b1
tctacgtgtacgagaagctatagagactcagagggcaaagtaagggaggatctctgacaacctaaacttgagttgttctgagtgtaacgtcgaaggtttaggcgttgccgcaaccagcatgacaaggttctgcgttggtctaaccgaggaagatgctaacaactgtccctttgctcagaagcacaagaggtgatccaactgatttcaaaagcctatatggttgcagtcccttggtatgagaggctcagctggtttccttcttgcttttcccaatgaacgatgaaaataacag

SEQ ID NO: 1822 - DNA, 462 bp, Gossypium hirsutum
  Clone ID: uC-gsronu33B076c09b1
ttcacgtttccgcctgtgtcaaaatctcaactgatgcctctatcaaggagatgatccctcctggtgcccttgttatgcttactcccctcattgttggaactttctttggtgttgagactctttctggtgtccttgctggggctcttgtttccggtgttcagattgcaatatctgcatccaatactggtggggcatgggacaatgccaagaagtacattgaggccggtgcgtccgagcatgcaaggaccctcggtccaaaaggatccgatcctcacaaggcagctgtcattggtgacactgttggagaccctctcaaggatacctgcggtccatcacttaacattcttatcaagcttatggcagtcgagtcacttgtgtttgctcccttcttcgccacacacggtggtctactcttcaagatcttttagggaatggattgctggaaatgcacccgggaggctg

SEQ ID NO: 1823 - DNA, 354 bp, Gossypium hirsutum
  Clone ID: uC-gsronu33B076c10b1
tttgttcaaaactggtggtggttcgtctgtcagattggggagtcagacaagcattcaaacattgataatttgtatatgaagtctatttggattttgtggtatacagacagacggagtgcatgtatgatattaatgttgtattatttgaaacacaccaatatccattgacaataaatttgtgtttaattgttgcagaaatctggcctttgctattacctctttcatggctttccttatttctttgttctttcatgggttttgctttttatagcaaagaaagtagagttagagttgtaaatgtttgttctccgcttgaattttaaatgtaaatgatgagttatttgatttaatgtg

SEQ ID NO: 1824 - DNA, 429 bp, Gossypium hirsutum
  Clone ID: uC-gsronu33B076c11b1
ccccaattaactcacacccagtttcatagattttctgtactaccccaacattactctctccagattcttacattttgagcttcagtcagcggaatcaggaaatggttaaaaggtatggagtgttttgacgtgtggaagatatcatgttgcagtgcgtagctggtgtgaagcgtttatttgcttctgtactgcaatgttgtgatattgatttgtacaaacaatctagaggtctcaatgatcctgaacttcttgcacgagagactgtgtttagtgtaagtgaaatagaagctctttatgagctcttcaagaagataagtagtgcggtgatagatgatgggctgattaacaaggaggagtttcaattggcattattcaaaacaaacaaaatggagagcttgtttgcagatcgggtatttgacttggttgata

SEQ ID NO: 1825 - DNA, 499 bp, Gossypium hirsutum
  Clone ID: uC-gsronu33B076d01b1
ctcattttaattgcagccgtccacaacatcttcctccttaccctttctttcatcatggccctgggttgcctcgtttccatcttctcccaggtgcctaacttcaacaccctcgtttgcttccccaggggtacatccccatcgggccctctctttttctgggcatacatcttctacctctccaagattgttgaattcatggacacccttttgatcatcctcagcggatccatgaagaggctatccttccttcacgtttaccatcactccatggtggtcatcatgtgttatatttgcttagacagtgctcagtcctccgtacccatggtgctggtcaccaactgcgtggtgcatgtcgtaatgtacacctattacctgttgtgcaccctggggatgcaccctaagtggaaaaaaatggtgacggattttcaactagtgcagttctggttaagctttttgatcatggccatgcttgtgttctaccacttcacagcttctggct

SEQ ID NO: 1826 - DNA, 380 bp, Gossypium hirsutum
  Clone ID: uC-gsronu33B076d03b1
cggacgcgtccttccacgcgtccgatgagatcgttttggatggtaatgatattgaactcgtgtctcgttcagcagctttgataaaccagaaatgtcatgtgaagaacaaggatattagaaagtttctcgacggtatctatgttagcgaaaagggcaggatcgccgaagaggaatgattgttatctcaagtcatagttatgggtgccatgttatttttctgttatggtaatttctttggtagcatggttttttgttgttttacctctttatttggattacagctgctgagtagaaggatgtttatctttatttgttgttttggaaaattttgacttgctgtttgaactttagtactaaatgaaacgggtgaagtttacaat

SEQ ID NO: 1827 - DNA, 402 bp, Gossypium hirsutum
  Clone ID: uC-gsronu33B076d08b1
tccacttgtccgcttcttcttcggtgggatgcctccggcgacgacccaatttcgaagtttcaattttgggcctggaatgggagctagaatgggggatcaaggctccactggattcaacatccgaatgttgattcagttgttgccggttcttttaatcctcttgtttagctttttaccatcatctgagcctgttttttcactgtccaggtcgtatccttatgagtacaagttcacaacaaagaatggtgtgaactattatgtgaggtccacaaaatttgagcaggattatccgactaatagtgtcgagcgtgtaaggatcgaggagcgtgttgagagagattattactctgttttggctcacaattgttagattgagcttaatcggtagcactggtgatttat

SEQ ID NO: 1828 - DNA, 481 bp, Gossypium hirsutum
  Clone ID: uC-gsronu33B076d09b1
ttgtacttttgggccgaacgcagtgtgaggaggtggggggatctaagggccgttttggtcaagagagagttcaatcgtacttggactgagatcgttggttgcgccgtcaccgggaccatcatcacaaagatctcccttggtctaaccgaggaagatgctaagaactttgcctttgctcagaagcacaagaggtgatccaactgatttcaaaagcctatatggttgcagtcccttggtatgagaggctcaggtgttttcctttttcctttttccaatgaacaatgaaaataacagaagacatcagttctgagtacactttattttgtgaattatgattttgtcatcaattaatgattatgctttgaataaggttaaaacacccttccagttagtgattatgtttgacgcccttgattctgggtttatgatattgagaatcaaaacatggaaatttgggcccaaaaaaaaaataaagggcggc

SEQ ID NO: 1829 - DNA, 448 bp, Gossypium hirsutum
  Clone ID: uC-gsronu33B076d10b1
tttcgtgtttctttattcctaactctctctaccacctaaacctcattctattctttttttcgttttaatggatgagttaaacagcaagaagcgggctagggacgactccaacgagtcgggcctggactcgcccgacgtgaagagactcagagatgatttatttcttgatgattcagattccttgcctcttaatcaagaccttgcatccgtaatgaagagttttgaagaggaaatagcagctgtcccatctacttcaacgggatctatgccagttgtggatctcacttctgattctagtgactcgcaacctgatcttggttacctttttgaggcttccgatgatgaacttggtctccctccccctacggcttccacaactgatactgaaggaaggtccgaagcgactgatttggtgcgagctgacttaaactcctcaagaattgatgat

SEQ ID NO: 1830 - DNA, 386 bp, Gossypium hirsutum
  Clone ID: uC-gsronu33B076d12b1
ttttctattgaattctttccttcactttctcgagaaaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtc

SEQ ID NO: 1831 - DNA, 383 bp, Gossypium hirsutum
  Clone ID: uC-gsronu33B076e01b1
ctcttttgtcaatttcttcctggtggtggaagtggtgaacactgacggctaagtaacaagttagcaaaatgggacctggtggaccgggaggagggccgggaggaccaggtggaccgggaggatggggaggaggacctggtggttggggtcctggccctggaggacctggcggatttgggcccggaggtcctggttggggtccgggacctggaggtccctggggccctggatttggaggtcctggtttttggtctggtgggttctttggcggctttgcagatggtttgtgcaataagatatcttcctggttctactgtctttgctgttgttggctacttcaagactgctttggtcgacaccctgcttatggtcttccccttttt

SEQ ID NO: 1832 - DNA, 385 bp, Gossypium hirsutum
  Clone ID: uC-gsronu33B076e03b1
gtcaatgtaaggttgcaaagcttttgcagatttgctgatcgcttcaggagctgatgcaacatttaacgaaaacatcgatgggggtttaacggtgttttgccccaccgaccctgttattaaggatttcatgcccaaatacaagaacttgacagcatccaagaaagtgtccctgctgttgtaccacggcgttcccgtgtatcagtccatgcaaatgctgaaatccaacaatgggattatgaacacattggcaactgatggagcaaacaagtatgatttcaccattcaaaacgacggcgaggtggtgacattggagactaaagttatgactgcaaagattacagggactttgaaggatgaagagcctttgattgtttacaaaattaac

SEQ ID NO: 1833 - DNA, 308 bp, Gossypium hirsutum
  Clone ID: uC-gsronu33B076e04b1
aaacggcatattatcgcaattggaactaccaccttggcacattcctggcatggtccctcctagcgtaccaactctttgattgaaacctacatcataaacaaacacttgtaagttcaaccgaacttattgaatattacccagattaccttggcgtatttattgttgaatttcttaactttaagattcttaattacttttcagtcttcggtagattcttttctaatatcgacgcatacatataagccaattttcaatttttttaactatggcttcaaatcccaaggttttctttgacatgacgatcggag

SEQ ID NO: 1834 - DNA, 443 bp, Gossypium hirsutum
  Clone ID: uC-gsronu33B076e05b1
cccacttgtccgttaaattttcagacccaaaatggctcacttcattacttttctactggtactgtcactttctcttaccttctccttgctccctgaaacagcttcagctcaactaagacaaaattactacgctaaaacctgtcccaatgtagaatccattgtaagaaacgccgatactcagaaattcagacaaacttttgtcactgtccccgcaactatccgcctcttcttccatgattgctttgtccagggttgtgatgcttcagtaattattcaatccaccggcagcaacaaagccgaaaaggaccaccccgacaacttgtcgttagccggtgacggtttcgacaccgtcatcaaggcgaaacaagcggtcgatgcggttccgagttgtagaaacaaggtttcatgtgctgatattttggcaatggcgactcgtgatgtca

SEQ ID NO: 1835 - DNA, 193 bp, Gossypium hirsutum
  Clone ID: uC-gsronu33B076e10b1
tttgatccccttatccctctttcattagctgttgatattttttatatcaatgatgatgttttccttacaactgtacattgtcatccagtattgacatagttgcttttgattgtttttgggttttttatcggctccttactttagcttcatgcttgtgctttgaactctatattgggttttaagaactgttgat

SEQ ID NO: 1836 - DNA, 436 bp, Gossypium hirsutum
  Clone ID: uC-gsronu33B076e11b1
tgcattatcttccagtctcttgatctagcatggactttgcttcgtatcttccctcgtgaacttctccatcgtatacctgcaaagacacttgaccagtactacagtcgcgaatcgtgaaagcaacaagctgagctggtaaagcatttgcatttgctgcatggccttaacccagtaatccgtcttggtgaatggcttcattgcggtgtgctacatttgtttcatttccttttcagatacagttccaatcaagttcatgctctgtgattataatttattttagctgttgagtattctttgttttgagaacccaacccataagctttttcgagaacattattttcagcttgttattctcattcaaacctgttgttaagacttggattgccaaggaaaagactggttctgttttaagttaagatctggcaatgttggatgc

SEQ ID NO: 1837 - DNA, 422 bp, Gossypium hirsutum
  Clone ID: uC-gsronu33B076e12b1
tccaattattgaaatcaaaagaaaaagcaaaggggagggcctgttttcttcacaaccaccatgagctgcgagtcttcaataaccaagaggctggatggcaaggtggcactgataactggtggtgccagtggcttaggaaagtgcacagccacactatttgtcaaacatggagccaaggttctcattgctgatattcaagacgaattgggcgactctgtttgccaagagcttggaactgaaaacatcagctatgtccactgcgatataacgtgcgaatccgatgttgaaaatgccgtaaacttggctgtctcaagtacggaaagctcgatatcatgttcaacaatgccggcactcttggtgacaacgaagcaagagtgacacacgccagcacggaggacttcaagagagtgttcgatatcaat

SEQ ID NO: 1838 - DNA, 431 bp, Gossypium hirsutum
  Clone ID: uC-gsronu33B076f01b1
aaatttttctacttaaatccaaataaacccaccaaaatgcaaatttctgccaagtttgatttagaccttttcttctttcattcttttttttttcccaattttcattcaattatcttgttttgtttcctttaaagtcattcctcattaaagtagagtctttgatcattattactaagtaattgcgtcatagatttttttttcttacgaccttaatttccaggaaggttttattattttgaaggagatgaacccatcaaacgcactacctcagacatcacctccatcagatgcggtggacacgtcacccctcctgacccattccatatccgaccaccttctccgcagccgccgcatcctccgtcgtcgacctccacctttgcctggcacagccgctaggctcctccgacgcgtcagcagtcgtcgtttgatgc

SEQ ID NO: 1839 - DNA, 345 bp, Gossypium hirsutum
  Clone ID: uC-gsronu33B076f02b1
cccacgtgtccgttccgatgatggtggcttgtcacaccgggccttacccttatgctgtcctgtattgccatagccaagtgactgaaaacagggtgtttaaggtatcattggacggtgagaacggagataaggtgaccgcggtggctgtttgtcacaaggatactacgcaatggaaccgtaaccacgtgtcgtttcgtgtgttggggattgagccaggaacgcccggtgtctgccatttcttcccggcggataacttcgttctggttccagacccttgaatttgtagtaattgtctttcctaggatacgagacttgggttgtcataaataataatactcgattcct

SEQ ID NO: 1840 - DNA, 458 bp, Gossypium hirsutum
  Clone ID: uC-gsronu33B076f03b1
ggacttgtcgagtggtacggcaagaacgcacagttgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatcttactgggataagat

SEQ ID NO: 1841 - DNA, 541 bp, Gossypium hirsutum
  Clone ID: uC-gsronu33B076f05b1
cccacttgtccttataaaaaagaaaatgggttgggtgtggaaagatgaaccaaatgacgccgtttaatccactgctcgcgacggtgatcattgctctaccagaaaggtgatccaatcgaagtgcaagaccgaagaagtcgagcccggaaagttcgttcgaaagtgcgagaaaactgaagaagttcttagagaatgctttggaaggccggtcgaagtgctgcaatcaaccaaagagtatactgaagacgatgtcacagaacaaatgctaaaagggagtttctcatctggatcacacgtagaaggttcgtttgattttcccgggctacgtagtgacatggaggcaattgaacgccagttctttggtgggataaaccgtttctttgatgctgctgaggagatgaaaaataatttcttcgacataattggagatgcttatggcagaggatcttcatcagcaccatctataaggcgaggaatacccattgaagatcacatacaggaggaagaatcttctaaaccaactgaatttgggcatattgat

SEQ ID NO: 1842 - DNA, 408 bp, Gossypium hirsutum
  Clone ID: uC-gsronu33B076f09b1
tctcacttttccggttggacttgggtgggattgccaacccaatgtttagaggaaagggaccagaaatggttaaagacaattattcccctgcatttcctttgaaacatcagcagaaagatatgaggttggctcttgcccttggggatcaaaatgcagtatcaatgccagtagctgctgcagctaatgaggctttcaagaaggccagaagcatgggattgggagaccttgacttttcagctgtttacgagaccgtgaagcttcttaaacattcatcttgataccatatactacctttcatattgttaggctgatgaagccatattcagtgttggtttgaacctgaatttttatatatccattttgtagttcctactattttgaaagttgatactattatgtttttaagaa

SEQ ID NO: 1843 - DNA, 392 bp, Gossypium hirsutum
  Clone ID: uC-gsronu33B076f11b1
tctcttcctttgtcaaggcctttccttcttcaatgagtccaacataccggctaataaccagattttaccacaaggggaagctcaattcgaccggttgaagacctcgaattctccattcgagaccacctacaacaacaacaacagtttcaaactgatgttcggctctccattcgatttgtcttcatttgattacaatgatgatctccaagctgttggagtggacaccatgccaaaacaagatgtctcaatctggttctagtaacaatctcaaggctgaaactgaaaccgtacccgactcaaccctactgagccccgtatcgtgtgtttcatcgttatcgtattttttcaagcttgtccgtgtagtaatagaagttttaacacgttttagcagg

SEQ ID NO: 1844 - DNA, 259 bp, Gossypium hirsutum
  Clone ID: uC-gsronu33B076g01b1
acggggttgtttagatatccactggctgcagtaatactcacgaatgcgagagcggtgtaagagcactatctatcttcgacggacatgaaccattcgccgtctgtaaatgtacaattgtcgctcgagtgtatcgtatcatctcccgatgtaatgactattcctactgttggtgctgatgaaaccaggcaggattacgaaacggtggagctcgaaaagatcgagttgcgggatccgaaaatagttaacgggaaccaaatga

SEQ ID NO: 1845 - DNA, 545 bp, Gossypium hirsutum
  Clone ID: uC-gsronu33B076g03b1
cccacgtttccgttcacgcgtccgcccacgcgtccggctttgataaaggttcagattattgctcgggacaaaataccgcagacttccgaaaatatatgttatttatgcaaacatttcttagtaagatgagattaaaattttggagtgtcaaacaaataatactgtttgaaaagttcagaattggaatagactgctgctttaaagtatctgtatggatggttacgtcatcacacaaagtatggtactctttcgccacccgagcttgctaattctttgtattatgcatatgtaagtacactagggtataattctttgtttttttggttagtttttttcttttggaacaatgccttgatattgcaatcttggtttgagtgtaagtcgcttcctctaatgttactgtgggatagtttgcttatgttgtgaatgttgtgattacaagagtgtccttttgcatatgatttccatgactgcagtgattatattttggacttagaagtttacatatggtgacaggatataattttccttaagattactagaag

SEQ ID NO: 1846 - DNA, 329 bp, Gossypium hirsutum
  Clone ID: uC-gsronu33B076g04b1
cgacgatgatgtttccaggcagatccagcagatggtgagattcatccgccaggaaagcagaggagaaggctaacgagatctctgtttcagcggaagaggaattcaacatcgagaagctccagttggtggaggcagagaagaagaagatcaggcaggagtacgagaaaacggagaagcacgatcgagttcgaaagaaaattgagtgttccatgcagctaaatgcatctaggattaaggtccttcaagctcaagatgatgtggttaatgaaatgaaagaaatcgcagccaaggaacttttgaacgtgagccgtgatcaccaagtgtacaga

SEQ ID NO: 1847 - DNA, 537 bp, Gossypium hirsutum
  unsure (1)..(537): unsure at all n locations
  Clone ID: uC-gsronu33B076g05b1
agcaagaagagatctgcagagtcagctacaaagacccctgcaccagaaaagaaggcaaagctagtcactccccaaaagacagatggcaagaaagtgggtggacatacagcaactcctcatccttcaaaggaagccagaaaggcatcggctaccaccggtcaagtgaatcagagcgcaaagccaggcggttcatcattcccttgcaagtcttgcggcaggtcatttggctctgaaatggccttgcaatctcattccaaggcaaaacatggaactgcagtgtaaaaatcaatcagtctaacaagtaatatctttgcttaactattaccattcctggaatgggcaaattgaacataattagttaaatgttttaggtgactataattgatgatttatgtgtttaatgagtagtatttgcacattattaggttatcttacatgaaattgtgttctgcctatagcananaattatgtcataatggtatcattttctcatgttatgattgtgtttaaagtattatatatattctttaactttta

SEQ ID NO: 1848 - DNA, 176 bp, Gossypium hirsutum
  Clone ID: uC-gsronu33B076g07b1
ttaaaatcttattgcttgcggaaagaacaaagatacgaagtagattgagcttcagagtgatgcgcttagagaagctatttcaaccattgtagctcagtcacaggagaaacagcgcaaatttactgagaccatcgaactccagactggtctgaatgtctgtgatgctgaaaccgaca

SEQ ID NO: 1849 - DNA, 449 bp, Gossypium hirsutum
  Clone ID: uC-gsronu33B076g09b1
ttgcagtttctcatttccctcgcttcacttattttgatcacatatggacggactgatcaagggtttactggacgtcgctattggccacgagggagataatgagtctcaagatgaacgctccagatccagttcggcgcaggcggtgtcaggggatcaggaacaccaacgagatgaacgctccagatccagttgggcgcaggtggtgtcaggggatcagtatcacgaaaaacaggtgcagagccaatggcagggttcgggttcaagaccttcggggaggacccacaagaccgagtatgggggatatgaaaaaaatgaaggtgatgagcgacgacatggttataaccaaaataagtggaacagaaaggagcaagatgaggagcataatgatggctgggaaactgctggcaaaaagcctcgaagacggtcacaaaaggataatatggatcact

SEQ ID NO: 1850 - DNA, 347 bp, Gossypium hirsutum
  Clone ID: uC-gsronu33B076g12b1
ctcttgtgtttgtctattgaattctttccctcactttgtcgaaaaaaaaaatgtctttaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgacccatgcaactgttgtaaagcttgatgaaagccatagattatgaaaaaaagaatgctgcataaataacaggcctctgtaatgata

SEQ ID NO: 1851 - DNA, 350 bp, Gossypium hirsutum
  unsure (1)..(350): unsure at all n locations
  Clone ID: uC-gsronu33B076h01b1
ggatactatagtcagccaaggactacaacaatggtggtgaaggtgtatggcccagcctttgcttctccaaagcgagtgattgcatgtcttattgaaaaggagattgaattcgagactgtccctgttgatttgcttaaaggagagcacaaagaccctgaatttctcaagctccagccttttggaacagttcctgtcactcaagatggagattatgttttatatgaatcccgtgcaatcataagatactatgcagaaaaatacaaatcacaagggactgatctactgggaaagacagtagaggaaaggggtcaagtggaaaattggctagangttgaggcacacaattttca

SEQ ID NO: 1852 - DNA, 281 bp, Gossypium hirsutum
  Clone ID: uC-gsronu33B076h02b1
agaccgggggcaggggaattttacatatcttaggagaaaacgcatgcttcacaactgggaaactatgcggacataccggacaccaaatgaagaggaggtcttgcatatgcacgagttgttattgattgcgccactgcaaaccctgatggtcgtaagagagcccttctcattggaggtggcattgctaacttcactgatgtagctgctactttcaacggaatcattccagcattgagagaaaaggaagccccgttaaaagcagcaagaatgcacatctttgc

SEQ ID NO: 1853 - DNA, 147 bp, Gossypium hirsutum
  Clone ID: uC-gsronu33B076h03b1
cgcgaccgatgaattatcaagactataggtatagaccctgggatgggggaatctgcatctatatatactgaatgcaacggtcccgcgtagaaagaacgcaactaaataaacgaaagacaataaacaaatgaaagaaggggcaaagga

SEQ ID NO: 1854 - DNA, 402 bp, Gossypium hirsutum
  Clone ID: uC-gsronu33B076h07b1
ctacgcatacggtcgtgaggtcgacaatctgtgctagaggtggggctagggggatttatgctgatactgtaggacatagagggtatgctctacaacggggaaacatatgcggagcataccggtgcaccaggtgatggggaggtcttgcaataggcacgagttgttattgattgtgccacgtgataccctgatggtcgtacgagagcctttctcattggaggtggcattgatagctaaactgatgtagctgctactgacaacgaaatcattacagcattgagagaaaaggaagccacgttaaaagcagcacgaatgcacatgtttgctcgaagaggtggtccaaactatcaaaactgtttggcatggatgcgtgctcttggggaggaactaggagtacccctt

SEQ ID NO: 1855 - DNA, 486 bp, Gossypium hirsutum
  Clone ID: uC-gsronu33B076h11b1
tattggatattcagaatactggtgtacctcttgtggatcattgccatggagaatttgatataagcacattgcagatcattaaaaatgaagatctggaagagctaagggagttgggttcgggtacgtttgggactgtctaccacggaaaatggagaggaacagatgttgccatcaagcgaataaaaaaatctgtttcactggtcgttcatctgagcaagagagattgactgtggagttctggcgtgaagctgacatcctttcaaagcttcaccaccccaatgtagtggccttttatggtgtggtgcaagatggacctggaggaacactagccactgtcacagagttcatggtgaatggctctcttagacatgtgttgcttagcaaagacaggcaacttgatcgtcgtaagcgactcattattgccatggatgcagcatttgggatggaatatttacattaaaaaacattgtgcattttgattaaaat

SEQ ID NO: 1856 - DNA, 527 bp, Gossypium hirsutum
  Clone ID: uC-gsronu33B077a01b1
aacctttctgtaaacttggccccaaagatgtatgtacacgagagctccaagaattggcccgtgaagctgcaagacaagggattgtgttgctcaaaaacagccccgggtcgttgcctctatctccgactgcaatcaaaaccttagccgtaattggacccatcgccaatgtcacaaaaaccatgatcggaaactatgaaggcattccatgcaaatatacgacgccattgcagggtttaacgacctcggtggcaacaaactacgtctggctgcaccaatgtggcttgtggcactgcccaagtagacgatgctaaaaaagtagctgcctcagctgatgcaactgtacttgttatgggcatagatcagagtcaagaaagggaaagctttgacagagttagccttcttttaccaggacaacaaccacttttaataactgaagttgcaaaagctgcaaagggacccgtgattctcgtcataatgtccggtggaggctttgacatatcgtttgcgaaaaacgatgataaaatcac

SEQ ID NO: 1857 - DNA, 514 bp, Gossypium hirsutum
  Clone ID: uC-gsronu33B077a03b1
gagctttcttgatgctcaacccgagctgtttatccacatggtcccctataagacaaactatactctatcgatcatcgatagcggtgttggcatgactaaggccgatttggtgaacaatcttggtaccattgctaggtccgggactaaggaattcatggaggcattggctgctggtgctgatgttagcatgattggacaattcggagttggattttactcggcttacttggtcgccgaaagggtggttgttacaacaaaacataatgatgatgagcagtatgtgtgggagtctcaagctggtggatccttcaccgtcacgagggatacttccggggagaagcttggcaggggtactaaaattacccttttcttaaaagaggatcaacttgagtatcttgaggagcggcgtttaaaggacttgattaagaagcactctgagttcattagctatcctatttcactttggattgagaagacaaccgagaaggagatttctgatgatgaggacgaggag

SEQ ID NO: 1858 - DNA, 503 bp, Gossypium hirsutum
  Clone ID: uC-gsronu33B077a04b1
cttgtctctcaaggggttgataaagaaaggatccttgggggtgtcttcaccctttgtctttgccatttttttatttttattttcaatttgccccttaatctgttcttcgttaacatctccagcaatccccaattttcaatttcgttttgttcactgcataagttttttttagaaacctaaatccgatcacatgagaaatctcatggccactactggaaacaagaacatcaatgctaaattagttctacttggggatgtcggagctgggaagtcgagtcttgtattacgctttgttaaagggcaattcgttgaatttcaggaatcgaccatcggtgcggcttttttctcccaaacggtggccgtgaatgatgcgacggtaaagtttgagatttgggataccgctggtcaagagagataccatagcttggcaccaatgtattacagaggagctgcagctgcgatcattgtctatgatataacgaatcaagcatcgtttgagagag

SEQ ID NO: 1859 - DNA, 286 bp, Gossypium hirsutum
  unsure (1)..(286): unsure at all n locations
  Clone ID: uC-gsronu33B077a05b1
gtcancttcctcaaggatatcctcctccttacgcccctggagtatcctgctcagccttctcctcagcaacagcaaagtactggtttcttagaaggctgtttggctgctctgtgctgttgttgcctgctggatgcttgcttttgagaatccaactctgccaaaagcctcaaatgttgaaaaatcaaatgttcttaccgtctcgccttttttttttgtttattttctttaaataattgaattggacctttgtttggaattaaactaaactattgtgctattttatatt

SEQ ID NO: 1860 - DNA, 356 bp, Gossypium hirsutum
  Clone ID: uC-gsronu33B077a07b1
gtctttattctttcgaaataacaaatattttcatgtcttattatatgtttcttttaataatttatggtgttccgctggttgatgaagatcataaagacgtgtctgaggttagatcgttttaatagatgctgatgaatccacgaacggatcaatgtagtacgatgctgtgattttagttagctcataggatcatattaattgtgtgtgtgtgtgttatttttcttatttcaaagctaagcttgttttggagtgaacattgctttatttttattttgtataatttctaaaaaaaaaaaaaaaaaaaaaaaaaaaaattaaagaaaaaaatatgaaaataaaacacaataaaaaatatg

SEQ ID NO: 1861 - DNA, 313 bp, Gossypium hirsutum
  Clone ID: uC-gsronu33B077a08b1
ctcatggaccaaaactttaccatcttgaggttgctgttggcccattcattgctggtgtaaaagataagtgccataatcatgtttgatgttactgcccggttgacatacaagaatgttcctacatggcatcgggatctttgcagagtgtgtgagaatattgctattgtcttatgtggaaacaaggacgatgcaaagaacacgcagagcaaggctaatcacgtcacacttcacaggcagaagagtgggggatactatgaaatttcgggcaagagcaactactgtgttgagaagcctttcttgaaaagaagggaac

SEQ ID NO: 1862 - DNA, 333 bp, Gossypium hirsutum
  Clone ID: uC-gsronu33B077a09b1
cccctcttccgagaggaacgggagaaaagggcttggggcatattctgagaaagtttccaaaggctatgcgaaacgtaaggataggcctcaaaatctcagtttcttggatcatattaggatcttcatttcgtctccttctgattaaatcaataaacataaacagttggagaaaaattttgaatgttgtaatgcttgtaaaatttttctcgagatttcaatgagaaacgagattgaattttctcaataaaaaaaaaaaacataaaaataaaaaaaactaataaaaaaaaaaataaaaaaaaataaaaaatttaacccaaaaaaaaaaattctaag

SEQ ID NO: 1863 - DNA, 275 bp, Gossypium hirsutum
  Clone ID: uC-gsronu33B077a11b1
tgccttggttgcttccattgtccaattattactatgaggacgattaaatgttttatctgttctgcaagaaacttactgtctaatgccaagtaatgggcaataaaaatgtatgtaaagatgtgttatagatgttatgaaaaatggataaagagtgaaatgattagtggttttgtttaaaaaaaaaaaaccaaataaaaaaaaaataaataaaaataaaaaaaaaaatataattaaatataaaaaaaataaaaaaaaaaataaaaaaaaatttactg

SEQ ID NO: 1864 - DNA, 511 bp, Gossypium hirsutum
  Clone ID: uC-gsronu33B077a12b1
aactcttagatgagctcaacaactcaggcaatggttccagtcatagatttctcaaaccaaaacctgaaagcgggcagccccgaatgggatttagtgaaatcccaagttcgggaagcactggaggagtacggttgtttcgaggctttgtttgatccaatcctggagcttcgaaaggcagtgtttggggctttgcaagaggcctttgacttgcctttacaaacaaaaaaactgtttgtttccgacaagccctttcgtggctattcgtgttctccatctgctttgtttcaaagcatggcggtggatgatgctcatattgctgaaaacattgaacaatgcctcaccaccagtttatggcctcaaggaaatataagtttcagcaaaactctggcatccttcggtcaactaacatcagagttagagaagaaaattttgaagatgatcttggagagttttgggctcgagaaatacatggatgggctcactgacaccgcaattatcaactgaggatcat

SEQ ID NO: 1865 - DNA, 73 bp, Gossypium hirsutum
  Clone ID: uC-gsronu33B077b01b1
aaatccctgcgtgtcacaaaaaaaaaaaaaaaaaaaggggggattttttaaaaattttttggggggacccccc

SEQ ID NO: 1866 - DNA, 513 bp, Gossypium hirsutum
  Clone ID: uC-gsronu33B077b02b1
cgcgattatttgtgttggtgacgccatttcagaaagattccaagtccatttcgatgcgaatcatgtggaaaatcatttgaggacagtaaaaaaccagtggcagattatatgcaaaattcgaggtgaaagtggttttggatgggatgataacatgaaaatgatcacatgtgatagagcgatatatgatgcagcagtgatggcacacaagaagtatgaaccatttttgaataaaagcattgatcattatgatgaaatggttgtggttgttggcaaagatatggcaacagagagttttgccagaacatttgctgacatagatttggatgatggtaatgaagattcaatgcctgtagactgtaacaatgaaaaggctgaagaggtaagaacaaatgtatcttcatctggcacatccaaacgtaaaagaaaaagtggtcaagaaagtctcgttgatgaacaaattaaatttgtgggtaaacaacttggcataattgctaatgctttggaaaatttact

SEQ ID NO: 1867 - DNA, 491 bp, Gossypium hirsutum
  Clone ID: uC-gsronu33B077b03b1
gcagattgctgagcccgtgatgaaattgtgcactgaatcgacagatggttctgccattgagactaaagagagctcccttgtgtggaactaccgagatgctgatcctgatttcggattttgccaggctaaggaacttttagatcacctcgaaagcgttcttgctaatgagccagttttggttaagagtggccagcacattgtagaagttaaacctcagggtgtgaacaagggtctggttgcggaacatctcctggtgacaatgaaacaaaagggaatgctacccgattttgttctgtgtattggggatgacaggtctgatgaggacatgtttgaggtgataatgcgagcaacggctggcccctatctctccccagtagcggatgtgtttgcttgcacggttgggcagaaatgtagcaaggccaagtactacgtggaagacagaactgagatattgagaatgtttcaggttctagccaatgcttctgaacatg

SEQ ID NO: 1868 - DNA, 423 bp, Gossypium hirsutum
  Clone ID: uC-gsronu33B077b04b1
gaggtgtttgcaggattaaagggtcaccattgtttccaacatgatgcttaataacaagtttttgttcctatgcttagccttattattgggtttgatgcaaaatcatccacagctatttcgaaatgtatgatcatgggtgcagcagcttcaactgtttactacaaccttaagctaaggcatcctacactggatatgcctatcattgattatgatttggctcttcttatccagccaatgctcatgatgggaattagcattggagtcacttttaatgtgctctttgcagattggatggtcacagttttacttattattctctttctaggaacatcaacaaaggcattcttcaagggtgtagaaacgtggaaaaaggaaaccatattgaaaaaggaggccgctaggcgctcggaaccaactgaaact

SEQ ID NO: 1869 - DNA, 342 bp, Gossypium hirsutum
  unsure (1)..(342): unsure at all n locations
  Clone ID: uC-gsronu33B077b05b1
attnctgtcttcacaaatgagaaaaggattcaacagagattagctttgtatcaaggagtatgtcccatatatatggagttctcggatgatgctgaagaaacctttaaaactgctttagctttgttgcagaagcaaggaatggcgaaggaaggagaagaggcagctcttgttcagagcgggagacagccgatctggcgattccagtccacacacaatattcaggtacgcaaagtgtagcagttgaagaaagacaaagaggagcccatttgacccagttttatacttcttcccgagagtttctgagaagagtattcaggttaggtttgggatactccctgacgt

SEQ ID NO: 1870 - DNA, 158 bp, Gossypium hirsutum
  Clone ID: uC-gsronu33B077b10b1
tcttcatccaatcactaggcacaatatcccatcacataatatgggtaaacactcataatcttatggcatgtttattatatccaattattctaattaactttaaatttagagattaatgttattaactactatattaagtaaacttaccttttgactaa

SEQ ID NO: 1871 - DNA, 560 bp, Gossypium hirsutum
  Clone ID: uC-gsronu33B077c01b1
cccactcttccgcccacgcgtccgcccacgcgtccgcaaccttccctgatcagtctgcaatggttttcaatccttctggcttgtatttccttgttcagttggaccatttttgcagttagtccagacgctccattgacattggattactacaaatcaacatcccccactgtgtttgagattgcgaggaaagaaatggagtgtgaagtaaactctgatcctcgaaatgcagctttggttcttcggttgcatttccatgactgctttgttcagggttgtgatgggtcagttttgcttgatgatacaatcagtttacaaggagaaaagaaagcttcggcaaatgtgaattctttaaaaggtttcgaaatcattgacaggattaagaacaagcttgaatctgagtgtcctgggactgtttcctgtgctgatatcctcaccgttgctgctagagatgcagtgattctggtgggtggaccttactgggatgtaccagtgggaagaaaggattcaaaaacagccaactatgatctagttagggaaaacattccaacagcatatgaggg

SEQ ID NO: 1872 - DNA, 504 bp, Gossypium hirsutum
  unsure (1)..(504): unsure at all n locations
  Clone ID: uC-gsronu33B077c03b1
ccctcgtgnccggttcttgtgttatatttaccttttcttgttatttttttttttttttttttgggttacccccaccatttctttcttttcttttttgtttacttctttatattcctttttggcttcccttggctcccgctctccttgtgttgcctccttcctttctcgggggcctgtgctttgccctcctttggttgtttttgctttcttgttttctcttttatgggggggggggcctttttggggtccccgtcttcgcccgcccctggggtggccctttcttttctttttttgtcccccttttttttttttttgggggtgctcttctccgcccgcgggggggggccccccggggccgccccttttttttttttttgcgcccgcccccccttttcgctcgtgttttttttgtgggggttccccccccttgccccttccccctttgttggccccctcctttttgtttgggtggcccccctttcggggctcctttttttggggggg

SEQ ID NO: 1873 - DNA, 375 bp, Gossypium hirsutum
  Clone ID: uC-gsronu33B077c04b1
cccactcttccgatggattcgccgatatatctcgtgcaggcagtacaggcgatggaatgcggcacggtgcttcggttgtcccgtgagaaggggcggcggagaccggcaactcatccttggctttaccaataccacttcaattatgtttcatgcatgttgtgtaaaaatgtaatctttttccatgtttactgtattttcttattttacacaactgatccaggaataagggtgttaactgaaaagagtttggcttggaattttattacaatgatccttcatttgtggttctttgttattatgaggtgttatttcatcaattatgtaagatatttttgtaattttaataaatttaaagcaaatatataatttgattaa

SEQ ID NO: 1874 - DNA, 238 bp, Gossypium hirsutum
  Clone ID: uC-gsronu33B077c06b1
gcatatctagcctgtgactggctaaaattgcatttcacaagcaactaaatatccaaaaatctaataattcaattacactagaattgcaaaaaataacaaaaattcttaacaaaattgaaacaaaatgcgaaataagttcaaccccttacaaaatgcaactcagttctggacaaaactgcagtcaacagcaattaaaagggtttatgaaggtctcaaagtaaaaatttagttacatttt

SEQ ID NO: 1875 - DNA, 229 bp, Gossypium hirsutum
  Clone ID: uC-gsronu33B077c07b1
ggtctacactctcgcgcccggtcctaaaagaaaatttctcaacattctctaatctttggtttaccctgaactagggttgggtttccaccatccatccttaggttttgcgtgcatagctgtaccatttctgtattaagtcaagaacgtcgattgtgatacattctctactgacagccatgaaacagtgtgctggaactcgtgaggtaagaaatggagtgtgaagtactcc

SEQ ID NO: 1876 - DNA, 504 bp, Gossypium hirsutum
  Clone ID: uC-gsronu33B077c08b1
gccttttgatacttctgcacactgataccctgcaggctgctctgctgcttgaactgtaatgtgacaataacagtttcagcaagagtctattttacaaaaacaacaatcatccttggaatggtgcaatgagactacctagcagtaagcatcaattttcaggtagttgacactgcccttcatttacttctaatttcagttatcataggcaattaaatgaaagtgggatcttttacatttatgtaaagcgtccatcctattcttggatttgcaatggccaataagccaaacggttttaagtagttggcacttagaacaactcatgcaacatccatgtttaagatgatagagctgtaaggtatttggcattcatatatgtttaaagtcttgcaatagggtattgtaccattggattttagatgaaagtgacgtttttgtatgatgttagtgtgaacaagtaatgtagtagagcacatgtgtgatttttctttctatactatatgaaaa

SEQ ID NO: 1877 - DNA, 455 bp, Gossypium hirsutum
  Clone ID: uC-gsronu33B077c09b1
gtgtgtttagttgaaattgtatacagttttggggttttgtttggtgccgcatgtcaaattcagaggctgctgctaaaaacggagcaacaatggatacccagagacaacaagcgccggggaacggtgcccttgccgtcaagaaacctccctccaaagaccgtcacagtaaagtagacggtcgtggacggaggataaggatgcccatcatttgcgccgctcgtgttttccagttgactcgcgagttgggtcataagtccgacggtcagaccatcgagtggctgttacgccaggccgagccttccatcatagccgctacaggtacggggacgactccagccagcttctccacagtgtcagtttccgtccgcggcggagccaattccacttctttgccgtcaacgacttcttcgtcgttggattataagcctttgttgggttccaccccttttttactc

SEQ ID NO: 1878 - DNA, 541 bp, Gossypium hirsutum
  unsure (1)..(541): unsure at all n locations
  Clone ID: uC-gsronu33B077c10b1
gtctgtttcttccttatcacactcatgttacaactgagcttgttggtactttgggttatattcctccagaatatgggcaagcatgggtagccactttgagaggggatgtatacagttttggggttgtcatgcttgagctgctcactggcaaaaggcctgttgatatgtctaggccaaaaacatcaagagagttggtgtcctgggtgcagagattgaggagcgagggcaagcaagatgaagtcttcgatccactcctgaaaggaaaaggttctgatgaagagatgctgcaggtgttggatgtggcctgcctgtgcatcaaccagaatcctttcaagaggccaactatccaggaagttgttgagtggctcacgggtgttggaacaatcaatagaaaccaaaataaagattcgtgaaaagtgctgttcattgctttttacgaaacagatacgtatacctgcacanaatgtctgaatcagtttatgcatacttttgctttttttatttntaattgggtaaataaaatntacccaatcataatact

SEQ ID NO: 1879 - DNA, 561 bp, Gossypium hirsutum
  unsure (1)..(561): unsure at all n locations
  Clone ID: uC-gsronu33B077c11b1
gctatcatgctgatgagttggctaaaaacgctgcttacattggtacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggcggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccatgaaaatgccaacgggctagctatgtatgctgccatctgccagcaatgtggccttgtccccattgntgagcctgaaattcttgttgcggatcacatga

SEQ ID NO: 1880 - DNA, 534 bp, Gossypium hirsutum
  Clone ID: uC-gsronu33B077d01b1
gaagttacaaaggagtacagcgagaagttgatgggcctagcttgcaagcttcttgaggtgtcgtcagaggccatggggttagagaaggaggctttgactaaggcatgtgcggacatggatcagaaagtggcggttaacttctatcctaaatgccctcaacctgacctcactttaggactcaagcgccacactgacccaggcaccatcacactcttgcttcaagaccaagttggtgggcttcaggccacccggcacattggcaagacgtggatcactgtccaacctgtggaaggagcctttgtggtcaaccttggagaccatggccattatctgagcaacgggaggctcaagaatgctgatcaccaagcagcggtgaactcaaactgaagccgattgtcaatagccacattccaaaatacagcacccgatgccacagtgtatcccttgaagatcagagagggagagataccaatccttgaggagcccatcacatttgctgagatgtataggagggagatgagcaaagatcttgag

SEQ ID NO: 1881 - DNA, 527 bp, Gossypium hirsutum
  Clone ID: uC-gsronu33B077d03b1
ctcttttttaagtggagcaaagaatccttacatcaaacagatggcaaccatggagaaggggttagagtttgagaacaagaatttaggcctgaagcacctaaacttcgtcagggtggctacgatccacgccttggtttgcatctcgaacctttacaattactctaaacagaactcggggccgttgagatccaccgtcgacgccgtcgagcgtgccgttaccaccgccgtcggtcccgtctacgggaaatttaaggatgttcctgatcattttcttggattccttgataacaaggtagctgtggtctcacacttatttgatgagcatgctccagcacctgccaagcatgtggttaaccaagcccacgatttggtccaaatggctcagaaactagtagaggaggctcgcaccaatggagcacgtggggctttgcactacgctgcagctgagtacaagatcttggtgctggtaagctcgaccaagttgtgggttatacttgaccgcaactcgactttcaactcagtgacag

SEQ ID NO: 1882 - DNA, 553 bp, Gossypium hirsutum
  Clone ID: uC-gsronu33B077d04b1
aagttttagcagcatcagcagcagcagcaggcctaaacgatcaaccaaccagaaaagagaaacaagatggtttcagggtcagggatctgcaccaagagagtggttgtggatgcaaggcatcacatgctaggaaggttggcttccattttggccaaggagttgttgaatggccaaaaagtagtggttgttcgatgcgaagagatttgtatgtcgggtggtttagtgaggcagaagatgaagtacatgaggttcttgaggaagcggatgaacactaagccttctcatggccccattcattttcgtgctcctgctaagatcctctggcgtaccattcgtggcatgattccccacaagaccaagcgtggggcagctgctcttgctcgattgaaggcttatgaggggattccagctccttatgataagacaaagaggatggttattcctgatgctctcaaggttttgaggcttcagaaaggacacaagtactgcttgttgggcatgctttcctctgaggctggatggaaccattatgacaccatcatggagcttgaga

SEQ ID NO: 1883 - DNA, 493 bp, Gossypium hirsutum
  Clone ID: uC-gsronu33B077d06b1
aatgttttcctgttaacacaaaggttaattaccgagatggtgttattgcttcctcaaagactctaaagagaggatgctactctcaggttgaagctcatgctgctgctggacagaagcttagagcagtggagagaaatgaaagattgtatcgactggttgctgcaaatccatcggttcttgaacaggtagatgccgttgctttaccaagagatatgttgggtgaaaaatacgtacattcttctcttaatgacaaaactggcttgtctgaagtgcatggagactggagaaaaccaaatggcgctgttggatgttattttgcagaaaccaatgatgctgatagtgttacgtgctctgttggtagttgtagcgtaagtagtaacaatttctgtaggttgcctcattgcgttcccacaggtcctattgaagttgctgatggtcaatgtagtgatgctgaatctttctgtccaaggggagacgagggaggaaattctct

SEQ ID NO: 1884 - DNA, 501 bp, Gossypium hirsutum
  Clone ID: uC-gsronu33B077d08b1
cccacttcgtccgcccacgcgtccgcgagtggtcaaaagcggcatggactcagcggctgaaggaggagtataaggctttgatcgcctacacgcagatgaataagtccaacgacaacgattggttccggatatccgcagccaatccggaagggactcgttggaccggcaagtgttggtacgtccataaccttctcaaatacgaattcgatctccagtttgatatccccgttacttatccggccactgctcccgagctcgagttgcccgaactcgatggcaagactcagaagatgtacagaggagggaagatttgtctgaccgtgcatttcaagccactttgggcaaaaaattgtcctaggtttggaatagcacatgcactgtgtttgggacttgccccatggcttgctgcagagattccgattctcgtcgattccgggatgatcaagcattaggatgatgcagccacatcaaatgagtcttagcatgccgatgccgggatga

SEQ ID NO: 1885 - DNA, 456 bp, Gossypium hirsutum
  Clone ID: uC-gsronu33B077d09b1
ccctctcgtccgcccacgcgtccgggaatccagtgatcaatcttacccttctcaagccacgagatcagcctatcgagttaggatcaatcaaacttcgctttcatagatgaatttctccagttaaaagcgtatgttcctttttggaaatgcatactcatatagggacttttatgtacaaagttcagtttagtaagctttgcatttttctggagtattcttaaaaaaaaaaaagcttgtaggttccatgttatggcgttaaagaatgtactgatcatatcctgctcaatgctataacactaaacattcatttgaaaatatttgaaggtaccaaaactatgtaactctttttattattataaataatgcagccataattttggttcaagctagctatatatgtgaaccagctttgaacaaatatgtaattcaattgttttgctggtttgccattcttct

SEQ ID NO: 1886 - DNA, 550 bp, Gossypium hirsutum
  Clone ID: uC-gsronu33B077d10b1
aacacatattttttaggaaaaagaaaaagcttgagcgaacaagaaaatggccgatcagcttaccgacgatcagatctctgaattcaaggaggcctttagcctgttcgacaaggatggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatttctgcagccgagctgcgccatgtcatgacaaaccttggtgaaaagcttacagatgaggaagtcgacgagatgatccgcgtagccgatgttgatggtgatgggcagatcaactacgaggagttcgtcaaagtcatgatggccaaagtaaggacctctccaactataaccaggattaaaaaaatgggtttaaaaaaaaggaag

SEQ ID NO: 1887 - DNA, 542 bp, Gossypium hirsutum
  Clone ID: uC-gsronu33B077d11b1
ggtttttaagaaggctgatgaccttcaggaagagcttgtcattgatgtcttggttcatggagagcctgagagaaacgatatggttgagtactttggtgagcagctgtctggttttgcattcactgttaatggatgggtgcaatcttacggatctcgatgtgtcaagccaccaatcatctacggtgatgttagccgccccaagccaatgactgttttctggtcatctaccgcacaaagcatgactgcacgcccaatgaagggaatgcttactgggcctgttaccatccttaactggtcctttgtcagaaatgatcagccccggtttgagacttgctaccagattgccttggccatcaaggacgaagtggaggatcttgagaaggccggtatcaatgttatccaaattgacgaggctgctttgagagaggggttgcctcttagaaagtcggagcacgccttctacttgaaatgggctgtccactccttcagattcaccaactgtggtgtacaggacactacccagatccacactcatatgtgct

SEQ ID NO: 1888 - DNA, 567 bp, Gossypium hirsutum
  Clone ID: uC-gsronu33B077d12b1
ggatctctcagctactttttctctcaaaatttctccaattagctctggtttaggcgatggcttcaaagcggatcttgaaggagctcaaggatctacagaaagatcctcctacctcttgcagtgcaggccctgttgctgaagacatgtttcattggcaagcgactattatgggtccacctgacagtccatatgccggtggagtgtttctagtcaccattcatttccctccggactatccatttaagccacccaaggttgcattcaggacaaaggtctttcaccctaatattaacagcaatggcagcatttgcctcgatattttgaaggagcagtggagccctgccctcaccatatccaaggtattgctctcaatctgctcacttttgacggacccaaatcccgatgatcccttggtgccagagattgcccacatgtacaagaccgacagggctaagtacgagacaactgctcggagctggacccagaagtatgctatgggttagtgtgctaatatgcatataataggagggctttattctatgtgggctttgatctcaattaatatga

SEQ ID NO: 1889 - DNA, 374 bp, Gossypium hirsutum
  Clone ID: uC-gsronu33B077e03b1
cccactcttccgcggacgcgtgggcggcgacgcatcgttcaaatttctgccattgattaaaatcatcagggaacttacgattttctctatttgccaatagattttaagaataagtgcaatgtgggctatgcctttattaatatgctgtctccttcacacattataccattttacgaggcatttaatggaaagaagtgggagaagtttaatagcgagaaagttgcttctttggcatatgctcgaatccagggaaaggcagctcttgttgcccacttccagaattcaagtcttgcttttccctggggtatcccaactaaatcgccttgaaaaaaatcccccttttgccagttggagtaaaaacaaaaaaggccggg

SEQ ID NO: 1890 - DNA, 518 bp, Gossypium hirsutum
  unsure (1)..(518): unsure at all n locations
  Clone ID: uC-gsronu33B077e04b1
ggatcttataaccttttctcttgaggccaaacgtgcagcaacttgggatgaggaatttgaccatctgaggttctcttacaatgggaacgtaattgtcgtaccggaaggccatttatcatcatggaaatccccggaaagtgaccttacagtggagagaacatctgacaagaatagtgtcttagtgactttacctgatattgctgagatttcagtaaatgtggtgccggtgaccagggaagatgatcgtattcataactaccaaataccctctgacgactgttttgctcacttagagctgcaattcaagttctacggtttatcttcgaaagttgaaggagtacttggtaggacttatcagccggatttcatgaaccctgcaaaaccaggcacggcaatgccaatagttggaggagaagacaaatatcgaacgtcatcacttctcactgccgattgttatacctgtaaatttcctccagccagagcatcngaccaaagagattcatcgctgatggactaca

SEQ ID NO: 1891 - DNA, 546 bp, Gossypium hirsutum
  Clone ID: uC-gsronu33B077e05b1
ttctctcttccgacaaactcaaaatcagttaatggacgcttttaactccaccttttctcactttaatccgccttctttttctccaaaagggccggtttttgctcgaattgctgattctagcaagacccagattgctttgagtaaaaaaaacggtgatgccatgccggcagagaaattagaagagagattggctggggttccggtctatgccttgagtaactcagaggaggaattcgcgttggtttcgggtgtttcgacgaaaaaatcacttgggttgttgcgtttcaagaaggaggacgctgaggctcttttggaacagatgaagaatatggatcctggcatgcgaaaaggaggctctaaagtggctgctgttgctcttaacaaggttgtccagctgcaggttgctggtgtggcacttaggctggtaccagagtccactcagatcaagaatgcacttagatctaggagcttggtactaagaagtcaaaataagagctatcgaccagttttctttcgaaaggaggatttagagcaatcacttctgag

SEQ ID NO: 1892 - DNA, 468 bp, Gossypium hirsutum
  Clone ID: uC-gsronu33B077e08b1
aattattatgatatcatgtcgatcaatgcaattttagctgatgtgaaacaccttcccatgtatcaagacatggcatccaagcccaaggcagaggatattgctggaggtgctactcaaaattcaatcattgtcgcacagtgggtgcttcacattcctggtgcaactggttacattggctgcattggcaaggacacgtttggggaggaaatgcacaagaactcatatgctgctggggcttatgttcaatatcttgaggatgaaactgcaccaactggtacctgtgctgtctgtgttgctgatggcgtacggtcactcactgcagatccatcatgcgctaactgctacgagtctgaccatttgaagaagcctgagaattgggcctcggttgcggaggccaagtacttctatattgctgaatttttacttactgcatctgcggaatgcatacagcgtgttgctgaacacgct

SEQ ID NO: 1893 - DNA, 66 bp, Gossypium hirsutum
  Clone ID: uC-gsronu33B077e09b1
agtcttctgagaagcacacaccactgcaatacagaccagaaaatacgaagggaaaaagacaccccc

SEQ ID NO: 1894 - DNA, 136 bp, Gossypium hirsutum
  unsure (1)..(136): unsure at all n locations
  Clone ID: uC-gsronu33B077f01b1
aactactantctctggtttatttcttcaggcttgtttggtgatgtttccaagttgtttttgccattgccgctcatctaggctttgtaagatatacatatttggattaaaaaaaattagggcctgttagtttcccac

SEQ ID NO: 1895 - DNA, 436 bp, Gossypium hirsutum
  Clone ID: uC-gsronu33B077f03b1
cgagttgttggagagactcaaggaagaaatccaaagactaggccagatccaatcagatggttcttacaaggtcacattcggggtgctatttaatgatgatcgctgagcaaacatctctgaagcactagttgggacactaagagcagcaaagaaacgaaaagttgttgcatatgatggtgaactactgctgcaaggagttcatgacaatgtggaaatcattctcaaagctacaacaccagcagcagcccagagtagcaactaatgcagttctaaacaaataattgcaattatagttttgcagcaaaagtttgatgatattctatgtaattactcaatgcttatcatgtttgaaagcttcttcagcataagtgcataaccgtatttttgaatactcttttatgaaattttccagagtgtactacacccagatttgtat

SEQ ID NO: 1896 - DNA, 510 bp, Gossypium hirsutum
  Clone ID: uC-gsronu33B077f04b1
ggggtgtagtatttgatggtgctgaggcagttcgtaaagtggagctttggctgatcattaaccatagttttcagccacagtatgcagtgtcggagctgaacgagaaggatttctggaggatgttcgatgctgacctgtatgagcatgtgcgtaggaagtacggagctgtgggaacattcatgagtgtgtactacaaatccaagaaaggaaggaagaccgaaaaagaggtccaagaagcggagcaagcccaccttgaaactgcctatgcagaggctgattagtgagcatgggggagtttggtagattttatgtgagaggaatctttgcattctctttgttgtctctttaatttagtatttgctttcagcgatggtattatggggggtcggaactgatgttatgggataggcttaagcagtgaatgttgtgggatgatttatggctatagtttagctattatggatagacttgtgataatgagaggcttttgttttagctttatatttggct

SEQ ID NO: 1897 - DNA, 360 bp, Gossypium hirsutum
  Clone ID: uC-gsronu33B077f06b1
gcttttctcatggaggtaggaatgagcaacacctttcagcattgttggcaaaatagctattagcagcatggttagactgaatgtgactgctcaatagcgtgaggttttcttttttgtctttcatttctcatctgttttcctggttattttctttttcttaaggataaggaattgagaatgaaaaatattactcctatttgcatcttgcatttgatgaagtgggtttttgttaacatttctagtatagggaagtaaaagagttgtattgcagacttgttatgttcttgttcacaatctataatttatggggtgtaataaatttcttgtgtgcgaaaaaaaaaatataaaaaaataattaac

SEQ ID NO: 1898 - DNA, 489 bp, Gossypium hirsutum
  Clone ID: uC-gsronu33B077f08b1
ccgttctatcagccatgcaattgtaaaacttgggaggaaagaccttgatcctcaaggggaagggtcatcatctgcggatattaatgaagaaatggaagaagaggtggaggaaggcaaagtcgaggaaagtgaagatgatggaagaggaggtggggatgatgagatcgacggacatgatcaagagaaaacagaaggggaagaaagcgaggaagttgaggatttcattgatgaagaagataaagataaggaaaaccaacttgaagatttgagtttattggaagatcaatccatgagaagttgatgagcagcacacgattgaagaagatgatgagcaaagaggtgttattgagaaacttggtggcttaccatcttagctctctcactaacaccaagtgagaaactaggtgttagtaagaattgggcctttagattccttataggaactgtacaaagtgttttagcattaacccatcactggtaaagaaatat

SEQ ID NO: 1899 - DNA, 423 bp, Gossypium hirsutum
  unsure (1)..(423): unsure at all n locations
  Clone ID: uC-gsronu33B077f09b1
ccctcttcgtccgaacgagtatgtcctgacaagccggaattttattcgtactgtgacagatattcgtggtgaatggttagttgatatagcaccacattattatgatctcgaaaacttcccacagtgtgaggcaaagcgagtcctcgaaaagctttacagaaaaaaggagaaggatcgggaggagagtcgaaacaggagatgaagtgctacgaccatacaagttgttttgacatgaatttttcttcaacggtgctatttgggagttattacgtagtatgttagttgataaattggaagaagcaaaaatttcttgtaacatcatgtggaacttcttcccctagctatcttgtattttgtactagcactccaaatttgttcttttaaccttcttttttaatcatttaaagaacactngaaatgatc

SEQ ID NO: 1900 - DNA, 347 bp, Gossypium hirsutum
  Clone ID: uC-gsronu33B077f10b1
cccctcttccgcccacgcgtccgcccacgcgtccgatcgtctcctcccaaaaggaaaaattattttcccctttcaccataaattgaacgttgaactcctcaaaaatcttcaaagcttcaacttttccaaacatcagcgatccctttcactccaaatttcatcgggtgaataatggcgacgtttgagctttaccggaggtcaacgatcgggatgtgtttgacggagactttagacgagatggtttgcagcagttctttatgccctgagctcgctattcaggttctcgtccagttcgataagtctatgattgaagccctggaaagtcaagtgaagagcaaggttttcat

SEQ ID NO: 1901 - DNA, 454 bp, Gossypium hirsutum
  Clone ID: uC-gsronu33B077f11b1
gcaattagaaaaaatcactgcgcagctagggaaatacggcaagatcgaaggcaaattcgttttctactggttccaaaaccacaaagcacgcgagagacagaagatgaagcgcaacagccttggccttaccaattgtcccagaaactcacctcccattactaccataactttggatactaggatggaaataatggaaagatcagatgaggatagtccatataagaggaagtgcaagagctggtcatttgagtacttggatgaacaaagcatatccccatgtaaagagcaggaaaacagaactctggagctattcccattgcacccggaaggcagatgaagggtttgaaaataaaacaaatagacccaaaccaaaaagaagaaaaaaaagaaagctgttagaaaaccaaaactctgttcccattatgatctgctttgaagcagatgatgatgatga

SEQ ID NO: 1902 - DNA, 469 bp, Gossypium hirsutum
  unsure (1)..(469): unsure at all n locations
  Clone ID: uC-gsronu33B077f12b1
cccatgcgtccgcccacgcgtccgcgataaaacttttgaaagagttaaatgtgtttgatatttgagcaaattattttttatatgccataaaacagcagagaaataaacggggtgactctctcaagataaccacaacagatttcagatcctccttccaagctctgcagaaagtactgtgtgcagaaagtgaagaacaacgatggggctgacatttacaaagctctttagccggctttttgccaagaaagagatgcgtattttaatggtgggtcttgatgcagctggtaaaaccaccattttgtacaagctcaagctcggcgaaatcgtcactacaatccccaccattggattcaatgtggagactgtggaatacaagaacatcagcttcactgtttgggatgtnggtggtcaggacaagattcggtctttatggaggcactatttccagaatactcaaggtcttattttt

SEQ ID NO: 1903 - DNA, 371 bp, Gossypium hirsutum
  Clone ID: uC-gsronu33B077g01b1
cccacttgttcgaacggggttgccgggcaaaacttcaacagattgtatttaatgaagtccttgcacgataattgacgacgaatttttaattcatgggtagctgtaatattcctttttatcaatgaacaagataattacttttggtttttcattaaatcactttttttgttgtcactattgtttttggggtcatttgtttagcttttacctactaatgtaggtgttcatggtcaggcttgttttgtctgtggcccaaaaatttttgttagcgaatttaatattatcgctcgtaatggttacatttcggcctataatattacattttaaaaaaaaaaaaaaaaaaaaaaaaaaaaaaaaaaaaaaaaggggcg

SEQ ID NO: 1904 - DNA, 455 bp, Gossypium hirsutum
  Clone ID: uC-gsronu33B077g03b1
cccacttctttcgcaaagaatcaaatctctgctactgcatagtaaaagagagaaagagcgacaatggaggcagcaagaacagttaaggacgtttcccctcacgatttcgtcaaggcttacgcctgccatctcaagcgctccggcaagattgagcttacttcatggactgatattgtcaagaccggcatactcaaggaacttcctccatatgatcctgattggtactatatcagagccgcttccatggcgaggaaaatatacctgaggggaggtcttggtgttggtgcctttagaaggatttacggtggggctaagagaaatggaagccgtcctcgccatttctgtaagagcagtggatctgttgctcgccacattcttcaacaattgcagaacgttaacatcattgatattgatcctaaaggtggttggagaatcacatcgaacggccaacgcga

SEQ ID NO: 1905 - DNA, 564 bp, Gossypium hirsutum
  Clone ID: uC-gsronu33B077g05b1
ctccttttttgacaaccctaattcccttaaacggaaaacgcaaatttctctcttccccaaaacactcttctccttctccgttcctctgtttctcctctaaaaacaatccttccccttccggcgatagtgttcccagtaacttttgcatcattgagggaccggagactgttcaagattttgtgaagatgcagcttcaggaaattgaagataatataaagagcaggcgcaataagatctttctcctcatggaagaggtaaggagattacggatacaacagcggataaagaatgtgaaagttatcaatgagaatggcgaagaagaaacagatgagatgcctgacattccatcttcaattccttttctctctcatgtgacaccaaagacaatgaagcagctctacttcacaagcctggcatttatatctggaataattgtattcggaggccttattgcaccaacactggagctgaaattaggtctaggaggcacctcatatgaagatttcatatgcaacatgcatctaccattgcagttaagtcagtgatcctatcgtggcatccttt

SEQ ID NO: 1906 - DNA, 382 bp, Gossypium hirsutum
  Clone ID: uC-gsronu33B077g09b1
ccttttcgtccgctatttttggccttctcttggccactgtgtcttctttcaacaacaaacaacatatataaccatattatatacatacatacacaaggtctttccttctaaggaagccatgactggcaaagaaatcctccacaagatgaaggagaaagttcaagaaaaagtaggcttaaacccttctaataatgctgaatctggaaaagggaagagtaagatgtcgaagaatataacacatggttatcatttagtgaaggggaaagcgaatcatccaatggaagactacgttttcgcggagtttaaggcagtcaatggcagggagctcggtttatttgccatattcgatggccatttgagccatgttattcccgattatttg

SEQ ID NO: 1907 - DNA, 234 bp, Gossypium hirsutum
  Clone ID: uC-gsronu33B077g12b1
cccctcgtccgaatcccgaagcctgcaactaggatataagttgctttaaatccttatgcttgcttttaaagaggggttcgattttaatgttgcgcttttgatatcttctctaccataatatatcctatattgtgttctggatgtccaggaagactgctggtgatggcggtgatactttccacagctaattgctagcggctaacttttgtcccttcaaccaccattccaaatata

SEQ ID NO: 1908 - DNA, 282 bp, Gossypium hirsutum
  Clone ID: uC-gsronu33B077h01b1
agagatatcttcagcagattcagggaagcatcaaaaattgcgactgttaaagatgggtgggtcaagcaggccccacagggcctggaagggtcggctcaaggccttggttgcatggggatgtcagctttccacggcccaccaaagcctgaatccgccatgattgcgctcatacatcatgctatcgattctgggatcacccttcttgatacccccgatgttcatggccctcataccaatgaaatcctccctgggaaggcgctgaaagatggcgcccgagaaagg

SEQ ID NO: 1909 - DNA, 563 bp, Gossypium hirsutum
  Clone ID: uC-gsronu33B077h03b1
cccacttctttgcccacgcgtccgcccacgcgtccgcccacgcgtccttccacgcgttctcgaacagttaggctgaaccaccatacactaaagcttctcaagtattggacatggcaattcgttgtcatccgcccagtgtgttctgtcttgatgataaccctgcaacttcttcagttttatccatcttggttgagctggacattcacaatcatcctcaatgtgtctgtttcattagcattatactctttggtagccttttaccatgtctttgccaaagagttggaacctcataagccacttgcgaagttcttgtgcatcaagggaattgctttcttctgcttttggcagggagtggtgcttgacatacttgttgctgtgggcatcattcgagcaaatcatttctggttggatgtggagcaccttgaggaagctcttcagaacgtattggtgtgtctcgagatggttgtattcgctgttctccagcagtatgcataccatgtttatccgtatagtggagaaactgaagctaagttgaagctaggcaagaaacttgaatgattttg

SEQ ID NO: 1910 - DNA, 449 bp, Gossypium hirsutum
  Clone ID: uC-gsronu33B077h05b1
gaaaccttacggctctatcctcctttaaatcgcgtgatgagagatttaggaagagatgtccagttaggaaaacttgtcctgcctactcatttagaggtcgacatgcgattcatagctcgtcagcacagatcctgacttatggggagatgatggtaaccatggccaaccattgaagacagctgcttacggacactttggaagggacgacccagacttcacctgggaatgctgtgaatcccttaatgtgggacatgccccaatcttaagttcagccctgctgccctgtctcagtgcctgcttatccatagtactgaataatatttgccttgctgctcacctatactctattttcatccccagaatgcttttaatcttattcatatagtgccctattcattatccttttttttttttctattttctcccttaatttgttctttttttttttg

SEQ ID NO: 1911 - DNA, 404 bp, Gossypium hirsutum
  Clone ID: uC-gsronu33B077h07b1
gttgatcaatgcaattttagctgaggagaaacaccttgccatgtatcaagaaatggcttccaagtccaatgtagagtatattgctggaggtgctactcaaaattcaatcaaagttgcacagtggatgcttcaaattcctggtgcaactggttacattggctgcattgggaaggacaagtttggggaggaaatgaagaagaactcaaaagctgctggtgttaatgttcaatatctcgaggatgaaactgcaccaacaggaacttgtgctgcttgtgtcgctggtggtgaaaggtcactcattgcaaatctatcatctgctaactgctataagtctgagcatttgtagaagcctgagaattgggcgctggttgagaaggccaagttctcctatattggtggatttt

SEQ ID NO: 1912 - DNA, 479 bp, Gossypium hirsutum
  Clone ID: uC-gsronu33B077h08b1
ccctttcttccgtccactcgctctcttttccttgtcaccaaaaaacatctttctggtcaattcaatcctccttttttctattcaaccataatgtcttgcttcattagcaaatacgccgatgagttggctaaaaacgctgcttacattggcacccctggaaagggtatccttgctgctgatgaatccaccggcaccattggcaagcgtctttcaagcattaatgtagaaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaatgaaagtggtgtcctccctggcatcaaagtcgacaagggtaccgttgagcttaatggaaccaatggcgagacttttacccaaggtctggatggccttgcacagcgatg

SEQ ID NO: 1913 - DNA, 253 bp, Gossypium hirsutum
  Clone ID: uC-gsronu33B077h09b1
aatctccctttggttcctctcctagatcttgaatttgttgttattttttcctactgctacttgaagtttttgaccttctgtcctccaattattggtgcgtgatggaatattttcttggtttacctgcattgctgctagacctagaccttacaattttcatattcgtttgtgtttgtatatttttttagttataaccggttttttagggtcaaaaaaaaaaaaataaaataacctaataaaatataaatacctt

SEQ ID NO: 1914 - DNA, 441 bp, Gossypium hirsutum
  Clone ID: uC-gsronu33B077h10b1
caattttcgccccaactctgatggctgcggagtgagcaaaaatatggccctcaggtacttggccagcctagaggtacggaggtggccgtacggaggcatgcgtggcgtgcgaaggcatcacgcgcgtgaggagtggctcgaaggggagcctatgcgtggcaacggcggctgaagggttccagaaaccctaatgatttctggaatactttttcaaaataggctaattgggctgaatcgggttttgggttaggtgttgggccactgtaactgggccaatcagatttagtgttcggtcatgggcatttgggctagttgggtttgggtagtggatttgggctaattaggtttgggtagtgatttttgggccattaggcctgctgtaaaaaaatggactgtattattattttttggactttaatttttaatttttaattttgggtt

SEQ ID NO: 1915 - DNA, 527 bp, Gossypium hirsutum
  Clone ID: uC-gsronu33B077h11b1
ctattctattggtgtgcctgagcccttatctgtctttggggacagttacggaacctgaaagattcctgacaaggaaatactccaaattgtgaaggagaacttcgactttaggcctggtatgatcaccatcaacctggacctcaagagaggtggcaatggtcggttcttgaagacagctgcttacggacactttggaagggacgacccagacttcacctgggaagttgtgaagcccctcaagtgggacaagccccaatcttaagttcagccctgctgcctgtctcagtgcctgcttatccatagtactgaataatattgccttgctgctcacctatactctattttcatccccagaatgcttctaatctcattcatatagtgccctattcattatctttttttttttttctattttctccctttatttgttcttttttttttttgggtattctgagtttgtgtcctgtatcagtgtcgtgttgcaaaaatgtattgagaattttgctataatatattaatggcacttg

SEQ ID NO: 1916 - DNA, 381 bp, Gossypium hirsutum
  Clone ID: uC-gsronu33B077h12b1
cccctctgtccgcccacgcgtccgcccacgcgtccggggttgtttggctttgttttctctgtaggatccgaaaaaaaaaatgtcgtcaaatggaactgacaactcaacttctaagaagcctgcaagtccttctcctttgagattctccaagtgttttccagtccaacatgagaattcttgttactggcagagctgacatcatcggctcccatttaggggagaaatacatggagcatgactggactgaggagacaggtgatgctaacctgttgaccgactccacaggcaggcgcatgactgagatggagacagacagatgctatctcctaaggaatgtcaggtccatggcgaccatcatagaagctgatgaaagggaatgtc

SEQ ID NO: 1917 - DNA, 418 bp, Gossypium hirsutum
  Clone ID: uC-gsronu33B078a02b1
cccactcgttcggtcctactccgttgtcgcaaagaagatttggatttggtggagtctgttctggagtcagcaaaggaggaatatgcttctaaagtgaatgttcatccaccagagataatcgttgatgatgtccatcttccccctggcccttctcatcatcatggttttttccatcatcatgctgaggctcatggacctttctgctctggaggtgtagtcatagcatctcgagatggaaaaattgtgtttgagaataccctggatgcacggttggatgttgcattcaataagaaacttccagagatccgcaagtggctttttggtcaggttgctgcttgaaggctgaagatggtattgtttttctcagcagcttttgtcatcggccatagagcatagtgattaagttatttgttccatg

SEQ ID NO: 1918 - DNA, 120 bp, Gossypium hirsutum
  Clone ID: uC-gsronu33B078a03b1
aaagaaagtaaaataaattcaaatcagcgagatttcgagcacgaaggcctataacatcatgttctcgcctatccccccgcgtttcccatggctttctcctcccttcatctctccttctac

SEQ ID NO: 1919 - DNA, 455 bp, Gossypium hirsutum
  Clone ID: uC-gsronu33B078a04b1
cagggaccttaaacgggaaccttccatatgcttttcctgaatgtcaacattcttctgcgcaatatccctaaacttccaccttggtttcctttctacatgcatccaaggcccataattcttgcccttctcttccggtctatccacgaccatactgtgatttttcggtagcaattcaggcggtgctggtttctttttcgcgttcagttcagaatttctaaaggtacaactctccttcacatggccataccttccatagtggaagcaaaccatcagtaataattcgtattccactctttgtgttttgccattgattaagatttgggacaccaatggcctctctaaattaacataaacaaccatctaggcaaaacgacctattgccttaaaaaaaaaaaaaaaaaaaaaaaaaaaaaaaaaaaaaaaaaaaaaaaaaaaaaaaaaaaaaaaaagggcgg

SEQ ID NO: 1920 - DNA, 439 bp, Gossypium hirsutum
  Clone ID: uC-gsronu33B078a05b1
gtctccttatggcccttcgatcattagccaccaggaaaaccgtgaaccttgtctctcaagtccaccaggttggctcagtctcgagccttgcagaccttctcgctccccgatcttccgtacgactatggggcactcgagcccgccatcagtggagagatcatgcagctccatcaccagaagcatcaccaaacttacatcactaactataacaaggctttggagcagctccatgacgctatccagaaaggtgattcttccaccgtcgttaagttgcaaagcgccatcaagttcaacggcggaggtcatatcaaccactcaattttttggaagaatcttgcccctattagtgaaggaggaggtgagcctccacatggttctttgggttgggccattgataccaactttggttcattggaatcattgatccagaagatgaatg

SEQ ID NO: 1921 - DNA, 264 bp, Gossypium hirsutum
  Clone ID: uC-gsronu33B078a07b1
ggcaaatacacttgtctcactggagactgcggttcgtctgcgatagtatgctctggtgctggtgctatccctcctgcaacccttgcggagtttacattgaacggagcttcgggattggatttttatgacgttagccttgtggatggatacaatttaccaatgatggtgtctccacatggtggtaaaggaggtaattgtagttcagccggatgagctgtggaattgaacggtaactgttctttggtacttaaaagttgatgattg

SEQ ID NO: 1922 - DNA, 188 bp, Gossypium hirsutum
  Clone ID: uC-gsronu33B078a08b1
cccacgcttccgggacagtctaattcgcttaatttgatctgttaatccattgcttactgtaataaaatggcacttcttgttgttctttcctcttttagctttgggtttggttttgttttgttattgtttgtaaagttattgtcgccaatcgttgctattgtggaaatggatgaggtggtttttttatt

SEQ ID NO: 1923 - DNA, 371 bp, Gossypium hirsutum
  Clone ID: uC-gsronu33B078a09b1
ttcagtgaaagggggagaaagacgcctcttcttagctggagatcctttcaaatctaattctaaatccaagttcctctcctcaatctaattgcataccatactgaagttagagtaaccatgtacgttgaacatgccttctcgatatctgacgaggatatcatgatggacactccccacgccattaacaatcggcctccgtacaaggagatcggcctcgctgacgctcttctcgcctttggcacccttgggatcatcctgggtatcttcatggccgtcaacaaagtcggcggggacctcgcctatgggctttcctttgcaatactcggttctcgtgagggatttcaaagctatacgatgcttggccagacctt

SEQ ID NO: 1924 - DNA, 442 bp, Gossypium hirsutum
  Clone ID: uC-gsronu33B078a12b1
cccacgcttccgcgcataggagatgtgagcactggactgagcgaggaaatgattctgaagttgatggaacaacggaagcattcatctacttcaacagaatcccaacaagatctggaaccgtgttgtatctgtcaggaagaatatgcaaatggagatgacactgggatactagattgtggacatgacttccactctaactgcattaaacaatggttaatgctaaagaacttgtgccctatttgtaagacaacaggcttgcttaaatgatagcaaaagctgatgttagagctgggaaatttcgttatcttttgatcgtcattaagatcctataataagggtttaggtgcgcatgaaccatacaaaatttgaagatgctgctgctaattttatgtactgcaagatgagttgtttgtcgaataacttggcataaaagcatcaatga

SEQ ID NO: 1925 - DNA, 438 bp, Gossypium hirsutum
  Clone ID: uC-gsronu33B078b02b1
cccacgctttcggagatttaatgcggccaagatctttagccaccctgatgttgttgctgaggagccttggtatggtattgagcaagagtacactcttcttcaaaaggatactaagtggcctcttggatggcctgttggaggattccctggaccacagggtccgtactactgtggtgtaggtgctgacaagtcctttggtagggacatcgtggactcccactacaaggcttgcctttatgctggcgttaacatcagtggaatcaacggtgaagttatgcctggtcaatgggaattccaagttggtccatctgttggaatatctgcaggtgatcaaatatggattgcacgatacatactcgagcgaatcactgaaatcgagggagttgttctttcttttgatcccaaacccattccgggtgactggaatggtgctggtgc

SEQ ID NO: 1926 - DNA, 278 bp, Gossypium hirsutum
  Clone ID: uC-gsronu33B078b04b1
cccacgcgtccgcccacgcgtccggttcattgatcggaaagggtagccgtaatattcagagtgactcccggcggaccgattgacagacagagactgtacaacatggcagccgagacaggcgcttgcttcctggcaactgcctactcagagtatgtgactctctataggggaagccagaagtgtgcggccgcgacggaaacaccatgccggctgatcatagatggaaccaacaagggctctgcggagataatataagaggctatgggcacagatttgca

SEQ ID NO: 1927 - DNA, 148 bp, Gossypium hirsutum
  Clone ID: uC-gsronu33B078b05b1
atcaaagatagcctctcctcctcatcggtgtgcttcttcttgttgggttatcaacagagatgtgcaaacagcggtagtagcaatttttgttttgatgcatgagaggtaaattgaattggtggattaatcatgattttacattcatatg

SEQ ID NO: 1928 - DNA, 449 bp, Gossypium hirsutum
  unsure (1)..(449): unsure at all n locations
  Clone ID: uC-gsronu33B078b06b1
cttgaattttcnttcaatgaaataagaaacaattaaactgtttctgtcattgaaatttgctgctattttcagttttctgggaaaagtagaggcaaattttccactttttcgttctgggttgtaaggcaaagaacaagaagagcttcaactgaaacaatggtgaccaaaacagtagatcttcgatcggatacggtaacgaaaccaactgaggcaatgagggctgcaatggcaactgctgaagttgatgatgatgtcttgggtgctgatccgaccgcggcccggttggaatccgaagtcgctaagatcatgggcaaggaagccggtttatttgttgcatcaggcaccatgggtaacctcattagtgttcttgttcattgtgatattagggaaagtgaagtcattcttggtgacaattgtcatatccatatttatgagaatggtgggatttc

SEQ ID NO: 1929 - DNA, 431 bp, Gossypium hirsutum
  Clone ID: uC-gsronu33B078b08b1
aacattttcacttgcagttttctgaatggggacgatagttcaaactaccgttgtcactgtttttctttgtcttctttttcctattgtcttttccacatccaatgacggattgttcagaattggactgaagaagagaaagtttgatcgcaacaatctgttagctgcccaacttgattccaaggaaggagaagcgttgagaggttcttttagaaagtatcttcatggcaacttacaggagtcaaaggatattgatatagtggcactaaagaactacatggatgctcagtactttggtgaaattggtattggcacgcctccacagaacttcactgtaatttttgacactgggagttctaatttgtgggtgccttatctaagtgttatttctcaatagcttgctatttccattcaagatataaatcaagccactc

SEQ ID NO: 1930 - DNA, 67 bp, Gossypium hirsutum
  Clone ID: uC-gsronu33B078b09b1
ggaaaatggtttatcagaagagtacgatgattccccgggggtctctacagaccaagattttgtatca

SEQ ID NO: 1931 - DNA, 439 bp, Gossypium hirsutum
  Clone ID: uC-gsronu33B078b10b1
cccacgtgaccgcccacgcgtccgctggttagagctttgagaacaggtacttcaacggttaaagaaaacgcagcttgtgctttgcttcggctatcgcaggtagaagaaaacaaggtagcgatcggacggtcaggagctattccactgctagttaatcttctcgaaaacggtggatttcgcgggaaaaaggacgcatcaacggcgctttattctctatgcacggttaaagagaacaaaatcagggccgttgaagcagggatcatgagacctctagtggaattaatggccgacttcgggtcaaacatggttgacaagtcggctttcgttatgagcgtgttggtacccgtaccggaagctaaaacggcattagtcgaagaaggagggattcccgtttaagtggaaatattcgaagttggatcgcaaggcaaaaggaaatcgc

SEQ ID NO: 1932 - DNA, 450 bp, Gossypium hirsutum
  Clone ID: uC-gsronu33B078b12b1
aaaacttttgtattgatatttctcaaggtcacatgccaaatcatgtttacgaggccaagctcgagtctgttgcacaggatgagaaatatttgccttgctggagtgtacttgacattggcactggcaatggtctactccttcaagaactagctaagcaggggttcacggatttgactggtattgattatagcgaggttgcaattgacttcgctcgaagtcatgctgacagagatggattttcaagcatcaagtttctggttgatgatattcttgagacaaagttggaaagacaatttcaacttgtcatggataaggggactcttgatgccattggcttgcatcctgatggacctatcaaaaggatgatgtactgggactcagtctcgaagttggttgccccaggtggagtgttagtgattacatcttgcaaccatacaaaagatgaattgg

SEQ ID NO: 1933 - DNA, 436 bp, Gossypium hirsutum
  Clone ID: uC-gsronu33B078c01b1
acaaaatatataaaaaaaaaaaaaaaaaaaaaaaaaaagggggaaaataaaaaaaaaaattaagaaaaaaaaacccaaaaacaaaaaaaaaaacggggcggccaaaggggcggggccaacagcagccgcaggtgcagcaacaacaaaagaaaacgacggagaagagaaagctccgccccagaggcacgagatcagcccacaccagggaccaaaggccacaccgtagccgccaaggaatcggccacgaaaacaccccgcttaaaacccccgggccgcaagcgaaagggccgccaaacccgcccctccgagagccttgccggagacgagaccggcctggaacgccccggggccggccccaacagggggacttgagggagcccgacgacaccggaacccccccgaatgcgaagaatgattcctcccccccttctatgag

SEQ ID NO: 1934 - DNA, 442 bp, Gossypium hirsutum
  Clone ID: uC-gsronu33B078c02b1
cccacgctttcgcccacgcgtccgcccacgcgtccggaccaaccatctcaaagtgttgaagaaataatgcgtatcatacaagaggctaagacgacaacagccgaaggagccaaagttggtgagcaagctgctgccggttcatccgatcctgatgatgtggaggcagatttagaatctgaaatcgatgtcagtggtgactttgaagctcctatgtgagaacccgatgttaactgcttcaacaggatttgtgcatcgaggtttggagtgttatttggattacagtttatatatatggtttttatcgtactgggaaaatgttgtacagcagacattaacactggatcggtgttgccttgctttgtattaccttggtttagtgtctcatgttgtacatttcatactttgtgaagcatctttcagaaatgatttcaaagcttgtatg

SEQ ID NO: 1935 - DNA, 443 bp, Gossypium hirsutum
  Clone ID: uC-gsronu33B078c03b1
ggagaagtgttatgaatgctgtgagttgataatggaatgggcaacaagagtagaaggcaaccaatcaaacaagcgcaggtttagttccatcccagggagcccaaatggggtaatggatgtctcgtttagttccgatagctcaaacgattcctgggctgtggcatcattcgcatcagtgtcttcatcacctgagcctatgtccaagaagaccagaactcaacaagaccagcttctggaaaggctatcccaccatgctccttcagattttctcaccattcctcactgaattccctcttttcaatttcagactacaaaaataattagtccttgtaataatattgctgttctttttccatgatgcaaagttaaattgcttaccatctctgcatcttgaatcgattggtgaggaaatctagaatcagagatggtttgcattttatccg

SEQ ID NO: 1936 - DNA, 423 bp, Gossypium hirsutum
  Clone ID: uC-gsronu33B078c05b1
cgaaataatattaaaaaaaaaaaaaaaaaaaaaaaaaaaaaagaaaaaatttaaaaaaaattttaaaaaaaaaaaaaggaagaacaatataaaaggacacaagattacgggggcggccgttttaggggttcccatgtttacttccgcgtgcttgcaacgttttagttcttttttggtggcccctaatttcatttcactgcccggggttttccaaccttttgcctgggaaacccctggcgttccccaccttattggctttgcgccacttccccttttccccgggtggtttattaccgaagggccccctcccggtcgcctttcccaccctttgcccagcctgattggccattgggcccccccctgttccggccctttaaccccggcggtttgggtgtttccccccagcgggccctttccctttgc

SEQ ID NO: 1937 - DNA, 316 bp, Gossypium hirsutum
  Clone ID: uC-gsronu33B078c06b1
cccacgctttcggcgtgtaattcgtacgtcggaacttgtgcttatatgagtccggagcggttcgatcccgacgctaacggtggtaactacgacggcttccttggtgatatatggagtttgggattaactttaatggaactttacgtgggtcacttcccgtttctacaggccggtcaaagacccgattgggctacacttatgtgcgccatatgtttcggcgatccaccgtctttgccgccgggtgcttccgatgagttcagaaatttcatggagtgttgtttgcaaaaggaatctagtaaaagatggacagcttctc

SEQ ID NO: 1938 - DNA, 436 bp, Gossypium hirsutum
  Clone ID: uC-gsronu33B078c07b1
cttctgttttccttgttctcttctacattcagcgaaggggtgctctgagatcacataccaaaatggtgaaggccgttgccgtccttggcagcagagaagcagttccgcacagaggtcagcacaattgggacgatccagcatgttaatctagtgcggcttcgagggttctgctctgaaggtataaggaagctgttggtgtatgattacatgccaaatggttctttggatgcccatcttttccatgaagagaaatctaaagctctaacgtggaaaacaaggtaccagattgcacttggtacggctagaggcttagcttatcttcatgagaagtgcagagattgtattattcactgtgacatcaagccagagaatattctcttggatgctgaactctgtcccaaagtcgcagattttggcttggcaaagcttatcgggc

SEQ ID NO: 1939 - DNA, 439 bp, Gossypium hirsutum
  Clone ID: uC-gsronu33B078c09b1
gagtttttaaactggcaggagtgcaggcatagaggaccggggtgaactggaccataataatgaaggatacatggatcgatccactcccccgcagtcggtttatgttggagcttctataactttggttaaggttggagtgttggagaagctcatttggtttgggcatattcactgccgttgatggtgatgatgaaaaatacaggagctaagaatgtaatcagtcatcaatgatgaagctatacgaggagccaaagagaaatgggaagatcttgttttggagtcgacaaattgcttgtgtcctattgcctatgggtaaaagcgttttgccgtgaaataatatgcctttactggaataataaagtggaccacattatgtatcatattactatttgacccaggtgtattttgaaccttttgattactatctcagctagtctat

SEQ ID NO: 1940 - DNA, 370 bp, Gossypium hirsutum
  unsure (1)..(370): unsure at all n locations
  Clone ID: uC-gsronu33B078c11b1
gaaggctcgaaatgaagaaaatgtctgagctgatcgagaagtacaacttgaacggccaattcagatggatatcatctcaaatgaacagaatccgaaatggtgaactttaccgatacatttgcgacacgaaaggtngcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggag

SEQ ID NO: 1941 - DNA, 445 bp, Gossypium hirsutum
  Clone ID: uC-gsronu33B078c12b1
ctaacttttctttatccttaacttttgctaaccgcaaaccctgttacttcaacaccggagttatggtaatcgaccttgatcgatggagagagggagactacaccacaaagattgaagaatggatggagcttcagaaaagaataaggatttacgaattgggttctttgccaccatttttgttagttttcgccggaaatatagtgccggttgatcatagatggaaccaacatgggctcgggggagataattttagaggtttgtgcagagatttgcatcctggaccggttagccttttgcattggagtggaaaagggaaaccttgggcgaggcttgatgctaacagaccctgccctttggacgctttgtgggcaccatatgatctcctgcaaactccattcgctttagattcttgattgaattgaaagaaacgggaaatgcttgttaa

SEQ ID NO: 1942 - DNA, 201 bp, Gossypium hirsutum
  Clone ID: uC-gsronu33B078d01b1
gaagcttatcatagtcattcagatgttaagaaataaaagtgtgtgacaattaagcgcgtgttattaagtactgcaacttatatttcctatctacttcgtttcatgtttggtatgttaaactttgaacttatcaaaccttttttctgttgtgtgtctaaggttgaataaacaaaatctggtgacttgaaaacaacagaagtt

SEQ ID NO: 1943 - DNA, 363 bp, Gossypium hirsutum
  Clone ID: uC-gsronu33B078d02b1
agcgttgtttaggtgttctcccgcattgaccacaagtttgatctcatgtatgccaagcgtgcctttgttcactggtacgtgggtgagggtatggaagaaggagaattctcggaagctcgtgaggaccttgctgcacttgagaaggattatgaagaagtcggtgctgagtcaggcgagggtgatgaggaaggtgaagatgagtactaaataagtaatgtttgagtggagggcttgcattttgctacccaatgatttgtttccttttatcgtgtgtttttgcttattctattgtgtgaacttcgactcttctaagctttgttcaagactatatggactgcaatagatttgacgagtagttcggct

SEQ ID NO: 1944 - DNA, 438 bp, Gossypium hirsutum
  Clone ID: uC-gsronu33B078d04b1
ataaccttttcttggctcaagcagtgaacgatctcaaagaaaccaacagctcctctttcttcgttcttgacatgtacaatgccttttggaacgttttcaatcaaaaacaagctcatcaagtgagtcccacatttgtgaatccatttgagccctgttgtgttggagtgagtgccgcattttcatgtggaagtgtagatgaaaatggtgtgaagcaatacacactttgctccaatcccaaatccaaattcttttgggatacagttcaccctacggaacaaggatggcgagctgtttactcaactccagctcttcaaagcagtctcaagcaattctggtagacattaccatgaaatgcttaccttttatcactttatgatgtttttacatttagtttcttggtatctgtcaaatccctttgtgatctctgtattcatttgt

SEQ ID NO: 1945 - DNA, 436 bp, Gossypium hirsutum
  Clone ID: uC-gsronu33B078d06b1
cgaaaagtttgatatgcgccatgttgctaaggcaactggtgcaaccatggtttcgacatttgctgatatggagggtgaagaaacttttgattcatcacttcttggatttgctgatgaagttgtagaggaacgcattgctgatgatgatgtggttatgattaaagggaccaagagcacaagtgcggtttccatgatcctcaggggagcaaatgactatatgcttgatgaaatggaaagagctctacatgatgctttatctattgtgaaaaggactcttgaatccaacacggtagtagcaggtggaggtgcagttgaagctgctttatcagtgtatttggagtatcttgccacgactttaggatcacgtgagcagttggcaattgcagagtttgcagaagctcttttaattataccgaaggtgcttgcagtcaatgct

SEQ ID NO: 1946 - DNA, 443 bp, Gossypium hirsutum
  unsure (1)..(443): unsure at all n locations
  Clone ID: uC-gsronu33B078d07b1
atttatttgaagtaattataatttgatttaattgtgggtgattttaaaacgagattggtgttccaatggatcaactatgaattcttaggattgtccgatttagaaaaacaattattaaaattttcataacanataaaaaatatcaaatttttattgattcatttgattctttctaatttagatcaactgattaaattatcttctcaaacttatatatcaatctattcccagtccacttttgcttaaaattcatttttctactactttaccaaacattaaaacttggtttaattttctcactaaattgttaatttatataaaaataattaccaaaattcagcaattaaaatatatatttatatataaaacaaattcataaaaatctaagtaaaaataattaacaaaaatttagtaattaaattcaaatactaactaacaactat

SEQ ID NO: 1947 - DNA, 419 bp, Gossypium hirsutum
  unsure (1)..(419): unsure at all n locations
  Clone ID: uC-gsronu33B078d08b1
ctgcatacaaaattgtgtttgtatagccagagaaccgcaaatgatccccagtgccctagatgcaatcaagctgttgaggatgtgaatcatgccttacgcttttgtgaaagacatgtgggtaactttgcaatatgtcaacccgataagcaacaaccaaatgggtttccatgagtggctttcatggatgtttgaaaactactctgtctaaatgaacagaaattgcaattacattgtgggctatctggtatgcccagaacaagttagtgcatgaggatacaaagcagggggtgggngagtnaggtagtcttcatccgtggctattgcgcagagctcgctattttggctactagtgctcttcgatcgattccatccactattgttcactggtccctctaccggtgaatgttgttaaggtcaat

SEQ ID NO: 1948 - DNA, 438 bp, Gossypium hirsutum
  Clone ID: uC-gsronu33B078d09b1
ctttctttcacaagctctgaaaaaagtaagaaaagcagagaagagaagagaagagaagaggttttgtcaatttgaaacaatggcgacgacagggcagccaaaacgacaaggacaacagcagcagcagcagcagcaacaacaaaataaaacgacggagaagagaaagccagtgtttgtgaaagtagatcagctaaaaccagggaccaaaggccacaccttagtcgccaaggtattgtcctctaacatggtccttcaaaagggtcgagccgcttctcgaaatctccgccaaacccgcatctctgagtgccttgttggagacgagaccggcactgtcctcttcactgctcgtaatgaacaagttgacttgatgaagcccgatgacactgtaattcttcgtaatgcgaagattgatatgtttaagggttctatgaggctggc

SEQ ID NO: 1949 - DNA, 88 bp, Gossypium hirsutum
  Clone ID: uC-gsronu33B078d11b1
cccacgttaccgcccacgcgtccgcccacgcgtccgctcgggtatcgttaatagatgaaaataaaatttcccacttcactctcttcct

SEQ ID NO: 1950 - DNA, 434 bp, Gossypium hirsutum
  Clone ID: uC-gsronu33B078d12b1
cggacgtgtgggcggacgcgtgggcaagaccaggtgatgatgaccaccacagatgccttgccctcgcctcgtgactacggaaacggaagctcttcttggttttggtagtgtcataacaatgatcattttcaatttgtatacacctacccctgtcaatgtcttggacttactagaccacgacgaccacgtctctcttgattttgtttggcatggctttgcctaaccttgtaatctctgcactcctttttgtcacctcaattattgttttctactttggattgtattgcaacatttattatttttttactactttccctgttttccttctttcttttgtgttatattacatggattgggattgcattgttataattaataattgattatcccttattcctcccgtttccctctattctagtctaatttattcataa

SEQ ID NO: 1951 - DNA, 433 bp, Gossypium hirsutum
  Clone ID: uC-gsronu33B078e04b1
ggaagtgtttgatacaatcgtgatcgatctggaccctatgaccgtcgtggaactggaggtcctcgttctggttaagatgactgcttgtgctgatgaacttaactgagtcggccaacgatttgcctgtagggaaaagacatggatgaaagcttaagtgagtcaatgaaagcaaggaaaaagtacagagatgtggcagatgctgctcaagaggctttcgtatcagcagcttatgcagcagcagcagcacgagcagctgtggagctctcaagaattgaaccccaagactttgattctccaaataatgccatggcccgaagcgaagacctggagctgaacgaaatagaagagactagacaaagtttatgcagagaaaggacagtttctagatcaagttcagattcggatgcagacctttcaggtgaggaaagtgatg

SEQ ID NO: 1952 - DNA, 348 bp, Gossypium hirsutum
  unsure (1)..(348): unsure at all n locations
  Clone ID: uC-gsronu33B078e05b1
gaagcttttaaggccaaagtagctgaagccatggaggtgttgaggagtgttgctgctcatcaacaggccaacaatcaagccgaccaattggcttcattgtccctcaatgataacctcgtttcctgagtgactgaaattcgggtccggtttcttggcagagaagttgccaaaccctttatcaaaactgggcaatcatagtttattaggctttaagtttggaacctttatatatttgctttgtttttgtcggttaatagggtttttaatacttgctagacattgtttgttttggtttgccttcgtttttctttaatttagagcaacttgcggttttcaaannnccttgtt

SEQ ID NO: 1953 - DNA, 438 bp, Gossypium hirsutum
  Clone ID: uC-gsronu33B078e06b1
ccgacattgttactgatgagatcgagtgccagcacttgcttcgtctcgaagatgggtccgtggtcacgagagggaggacccagtggaggccaaagaatgccaaaatttctgggaatgtggggcaaaatccagctgatactgcctagaaatccaagtgttcttccgagttatatatgtttctatattttttcatgtatgtatttatcaatgtagtatatatgtatgtagcttcactgtatctctcttattttattctttctttatctctctcaaccttttattcattgaatcaagaaaactgtccaaggaaattaggagcagaccatgccagagaagcatatgtagttattctttattgttttattatgtagttatcatgtgatgtgcattttaattttttttattagattgccattttttttaaagttaataacagaa

SEQ ID NO: 1954 - DNA, 434 bp, Gossypium hirsutum
  Clone ID: uC-gsronu33B078e08b1
gttttgttggccaataatgatgaaacctaaaccggctaaaccagccacacctgaagcaccggaaaccccaccacatcctggaagtgaggctcaaccacagggtgcaaacagcccgaaagcaagccctaaccgcaatggtgaccccagtgaaaatgtgccggcaggaagtggtgaggcacctccagcatccgcagaaccaatggaaactgacaaaccggagactacgagtgccgcatagaagattagcagggtgagtcattttatgattttatatatatgcggccagaagttagttgttatgtataagcagttacaagcactattttctaaagagcctgagatgagatacccaactctatcttttggtagactgataagaaaaggctgtgttgttttcgattttaaaaagccttctcttgcagtgtctgctgaga

SEQ ID NO: 1955 - DNA, 441 bp, Gossypium hirsutum
  Clone ID: uC-gsronu33B078e09b1
cgcatttcaaaattcagagtaaaagatcgacgatgagcagcttttgctcggcgatggcaatgacggtgacggtcgtcttcttcttcttcttgttccttcagcaaactccattaatggcggaggcggcgaaacttgaagaagatcatttcatcattaagaataagccaacgctgtacgagttttcaagcagagatgaaatggtgcatttggccggatacggcgaagagaagctctcgacagttctcgtcaccggaactgttctttgtgaagcttgccaccgccgccgccgccgccgcgatccacaacctcaacttcgttcatggcctatatcaggggctttggtgtctgttaaatgtgaaactccttgtaagaccaaatcaagtacaacacgagctacaaccgatgaatacggagatttcatgatcgatcttccgtcccacc

SEQ ID NO: 1956 - DNA, 436 bp, Gossypium hirsutum
  Clone ID: uC-gsronu33B078e11b1
attttctctctctacaaaatctctgctcccctctctttattttatttttctcgacatcctaacactccctccacacttaaaaattttgacactcttttgcagtctgctccttataaaatctccctatctttatatgtatccaatgacaagttactatattgaacactaagctttcttttccaatttcctgaaacattttccaatggaaaatgacgataacagaggcgacaagaagagtgcccgggaagagtttgagaattttgagtcagaggctaactcggttccctttttaaaactctctcgagtcgactcgtccgagttcactcgtgtggaatccgcccttgattacgtggacgttcagttgccggagtcaaagcatatccaggaggatttgctgaacttcctggacgattccgacccggtcattggacctgga

SEQ ID NO: 1957 - DNA, 418 bp, Gossypium hirsutum
  unsure (1)..(418): unsure at all n locations
  Clone ID: uC-gsronu33B078f01b1
gaagaattttgctatcccttgcttttctctcgcaaaaaattctcaaacttgtttttaacgttcgctgaatactatcgctcatttcttccctcagaaccctaatcgataactgaagccatttaatcatgtttgggcgtgttccaaaaaaatctgataacactaagttttacgaagtacttggggttcccaaaagtgcaagtcaggatgaattaaagaaggcttataagaaagctgcaattaagaatcatccggataaaggtggagaccccgagaagtttaaggaactggctcatgcttatgaagtacttagtgacccagagaagagagaaatatatgatcaatatggtgaagatgctcttaaagagggaatgggagggaggcggttcttctcacaacccatttgacatatntgagtcat

SEQ ID NO: 1958 - DNA, 364 bp, Gossypium hirsutum
  Clone ID: uC-gsronu33B078f02b1
gtcatattgagaatccagatcctgagttgattccggtggcgcgatccatccagcaaacggttacaattaaagggaatataaagaatccagatcctaagtttatcactatagaatgatgatcagggatgagaccctaaaatctaatcgaagtagctgttaggaatagataggaagtttttcagcttttaatttaagaacatcagaaatcaacctctgctacatgaaaattgaattaaatatgaaatgaaaatcgattgcagagattttagataaacatctaatctaatctaatctaatgattgtagcttaagacttggattgaatattccaggtttcaattaataaataatcccagcactgtatc

SEQ ID NO: 1959 - DNA, 63 bp, Gossypium hirsutum
  Clone ID: uC-gsronu33B078f03b1
cccacgtctccggtttctttgttcaatattaaaattaaattgttaaaaggaggaatatgcttt

SEQ ID NO: 1960 - DNA, 437 bp, Gossypium hirsutum
  Clone ID: uC-gsronu33B078f05b1
cccacgcttttgcttggcttaggagaagctgctacggtgctaggtgcaagtactgtttcgggtttctttgctgctgcttgcagtttgccttttgattacgtcaaaacacaaattcagaaaatgcaacctgatgcttcgggaaagtatccatatagcggctctttggactgtgccatgaaaaccctcaagtctggaggaccattcaaattttacactgggttccccgtatattgtgttaggattgctccgcacgtcatgatgacttggatattcctcaaccagattcagaaggtagagaaaaaaatggggttgtagaagcgttgtcacttctcagagacgtggagtaatgctggactaattgattgcgtcaaataaaatcctggatttttgctggttctggctaatcatgcaaattttgaaatacatttcaagtcaat

SEQ ID NO: 1961 - DNA, 438 bp, Gossypium hirsutum
  Clone ID: uC-gsronu33B078f06b1
gtgtgatcttatagctagcatgtcaccactattcttccaaacaacaacttttatcagatagttttctttttcttcttctcttgtcttttattacagtcagacactccgtacaaaagcaaaaacatggcatcatcttcttcttctgaactaacccttgattgtaaacctcatggccattttgcggcgccgtccaagtgttacgcagaccagcagcagattgttgttgttaatcatacattgaagcttgaagactacctttctcgtctcgaggaagaacgccttaagatcgatgctttcaaacgtgaacttcccctttgcatgcaacttctcaccaatgctttggagtcatcaagacaacaactacaggcataccgagcgaatcaaggaccaaaaccagttcttgaagaattcatgcccctcaaaacctcagtgtcggag

SEQ ID NO: 1962 - DNA, 454 bp, Gossypium hirsutum
  Clone ID: uC-gsronu33B078f07b1
cccacttttccgcccacgcgtccggaaaccttagaaccagaaaaaaaaaagggaaaaaaaatctcagattttctgtcaaggaaaatatggaatcgagtaggggtcaaggtggaatccagcagttgcttgctgcagaacaagaagctcagcatattgtcaatactgccagaaatgccaagatggctaggctgaaacaagccaaggaagaggctgaaaaggagattgctgaatatcgagctcaagtggagaaggagtttcagaggaaactttccgagagcagcggggattcgggtgctaatgtgaaacgccttgagaaagagactgaagcaaagattgaccacctgaaaaatgaggctgcaagaatatcagatgatgttgtccaaatgcttctcaagcatgtaacaactgtaaagaattaggccccttgagatggcaaacattcatatatgttact

SEQ ID NO: 1963 - DNA, 350 bp, Gossypium hirsutum
  Clone ID: uC-gsronu33B078f08b1
agcatgtttacatgtatttcagaggtagcggtaaagctgacgagatgaagcgtgaggcttcaagaagaaccgtggctgcagcactctgataatgataaggaggccgtagcagaagatggtatttgcttgtattggacttagatcatgtcggataagataccatgtactcaaattgcatcttcttcccatacccttcctggctggcttacttgcctattcattttattgatatgttgtttaaatatatacacatactgctgaacgaagaatgttgagaaatcagataaaacttggatacaatgacaatcaaaatttgtggttagtaagatttagcagtcttaacttttaat

SEQ ID NO: 1964 - DNA, 437 bp, Gossypium hirsutum
  Clone ID: uC-gsronu33B078f10b1
cttattttctaatgaatcaagatgatctcctccatgcttttactttccttccaagggatctcaacttcattgattatactagcaatccgggttggaaacagaggggagagataaaccgaattgttgtagacccccaacttatattataagagcaataccccaattaactatgatgttgaaactcgaaaaccagacgctttcgagatttttggaggttcaccatgggtgattctttcaagaccattcatggagttttgcatctatggatgggataacattccaagaaagctattaatgtatttcaccaatgtagcttaccctcttgaaacctatttccacacagtgatttgcaattcatttgagtttcaaaacacaacattgagcaatgatttaaggtacgacattattccgaaatcccctaagcccaagattttaaa

SEQ ID NO: 1965 - DNA, 435 bp, Gossypium hirsutum
  Clone ID: uC-gsronu33B078f11b1
ctttgttagagggaggcacttatcccgagtacaggaagacaaaattaaatagttgaattgtcaagctttgagaagcatggaaagcaggaaagcttgcgattaatggagccaaaagcaagacggaaagctaaagaggagagaagatggtgggaagaggaagagaagaggagaaatgtggagagaataagagaagacagggcaaggaagctttatgaggaagaaatgagactgctggaagagcgagaaagatttgctgagatcacaagatacactgaagacattcgaagagagagggaggaagaggaacgccaaaaagcaaagaagaaaaagaagaaaaaggctgaaataaaagaggattatttagaagactacaggacaagaagaaatgacagaagagcaccggaaagagatcgaggtgcaaaaaggaaacctgtt

SEQ ID NO: 1966 - DNA, 433 bp, Gossypium hirsutum
  Clone ID: uC-gsronu33B078f12b1
aagttcatgcattttcacctcagcttcttcttttttctctttgtttcatcatggcttctttggctacatttaattttgttatgtttcttattgtcttggcctcttcgctacatttcaccgccgatgcaggaggctcgttgagtcagaccaacctgaccagcctttgctcttccaataccacaatggtcctcttctgtctgggaaaatctctgttaatcttatttggtacggcaagttcaagccttctcaacgtgcggttgtgtacgatttcgtcacttccgttgcgtcttccaagcctacaatagctcagccctcggtcgccacatggtggaaagccacagagaagtactatcagctcagcaagaaaccttattctcttgccatcacattgggttcacaaatccttgacgagaactactctttgggaaagtcg

SEQ ID NO: 1967 - DNA, 411 bp, Gossypium hirsutum
  Clone ID: uC-gsronu33B078g02b1
aaaaaaatttatcccatctttatagtcgctctctttctcccaggttatttcaatctgctacattgggtacccaagcactaaactttctccctgggttcctctttagtaaggaatttggagttggtggggggaaaaaaatggagttttccagggtttctatgattagttgttttgcgttactcttgtgctcctccttggcatatggtgcctctagtcctccagctcctatggcaatgagtcccagcccgacaccgtcaccggcaccagcccctgcaccggaatatgtaaacctaacttatttgctctcttgggctggtccatttcacacattcctcaactaccttgaatccactaaagtcctggatacttttcaaaaccaagccaacaacactgaccaaggcattacgattt

SEQ ID NO: 1968 - DNA, 218 bp, Gossypium hirsutum
  Clone ID: uC-gsronu33B078g03b1
gatttattgtggaggttttcatttcttgtgtactttttgtgtagaggcgataacaatttttgatatagtaattagtttttagttctaaacttcaattttgtattctaatacatgatttaggtttagggtttaggaatactagaaaattttaaagtgtgctggattggattgttgttaaattttaattttttttattgaaaactagtgatttttattag

SEQ ID NO: 1969 - DNA, 437 bp, Gossypium hirsutum
  Clone ID: uC-gsronu33B078g04b1
cccacgcttttggcggccctttttttcctctaccaggtgattttagctttgtgtgagttcctttaagcaattagccaagatgcagaacgaagagggtcaaaacatggatctttacatccccaggaagtgttccgccactaacaggctcatcacctctaaggatcacgcttccgtccaaatcaacgtgggacacttggatgagcttggcagatacactggcacattctccacttttgctctttgtggatttgtccgtgcccagggtgatgctgacagtgctctcgacaggctttggcagaagaagaaagctgaagtccgacagcagtagttggatacctttttaccctagtctatctccgagcttgggaatgaaaaatctcatggcagtgactattatgttctaggtcttttcaggttaaactatgtcaaatttatat

SEQ ID NO: 1970 - DNA, 438 bp, Gossypium hirsutum
  Clone ID: uC-gsronu33B078g05b1
gtttgattatctcctgagcagccgaccccccccccccccaaaaaaaaataagaccaacttttctcaccaataaaaatggtggccagcaagaaaacgaagaagacccatgagagcatcaacaacaggttggctctcgttatgaagagtgggaaatacactcttggttataaaacagtgcttaagtccctcaggagctccaaagggaaactgattatcatttcgaacaattgtccaccgctgaggaaatctgagattgagtactatgcaatgctctgtaaagtcggagttcaccattacaatggaaacaataatgatctaggaactgcttgtgggaaatacttccgtgtatcctgcttgagtattgtcgaccctggtgattctgacatcatcaagtctctaccaggtgaccactaagtcaatgaaggtctggttctctat

SEQ ID NO: 1971 - DNA, 411 bp, Gossypium hirsutum
  Clone ID: uC-gsronu33B078g06b1
gaaggattttttagggccgaggggggcctgaacaacgcagggggttattggactgattattttctaggtgagcaaacaaccccagctgtgaccttgggagaggcacagacagggaagctggacataacacgggacgcttccaacaagatcatgcaccacctggatgcaacctgtggagctattgtattgaaaggattcaactgagacagatagatgagatgatcaaggggggagggaatgttgtgaacgatgaatacaccaaaggggacaggcgggctgctgaagataatggcacttgcggaaaggcgacagtggcaaatctgctgctgatgccaataaaagatgcagatactccacacgagctgaagaagcaacgagacctataaaccctaaaaacaaaatgactgatgt

SEQ ID NO: 1972 - DNA, 304 bp, Gossypium hirsutum
  Clone ID: uC-gsronu33B078g07b1
cacatgtctggagtatccaggtcaaaggctgtcaaggcactcaaggctgctgatggtgacattgttagtgctataatggagcttactgcctaataacggtgttgatttagcagcagttttggttgcttgaaagttgtgtgcttcatttcagatatccctactgtttttttgagaatgttattgtgtcctttttcttcttgtcggttgttgtattagtaaaaaaaccatctgtgaggacgttttctgttataaaaatggtctcggttaagaattcttcgctgagggagagaatcccgttaccaag

SEQ ID NO: 1973 - DNA, 459 bp, Gossypium hirsutum
  Clone ID: uC-gsronu33B078g09b1
gccgtttgttataagtgtggtgagatgggccatttagcacgggactgtgggcagggtggcggtggcggtggaggcagatatggcggaggcggaggcgggggcggcggtgcttgttacaactgtggaggctctgggcatttcgctagggagtgccccaacagtggtcgctaattttgaggagggatttaaatgtgtcactcgcatctcctccgatccatcctttttttcctcttccgctactgtttctgtcggtttggttattattgtatggtttgctttttatgttttccttttccagtttatgcaggacgatttctcttagtcagtttgctgtttttgtctttttggattttgaagttggcaaatggttgtaatgggtgctttcgtagtagtcttacagtgagggtggacattagtgtcgatgggaaaacaacaatgaaagagaaaatgatgttaaaa

SEQ ID NO: 1974 - DNA, 435 bp, Gossypium hirsutum
  Clone ID: uC-gsronu33B078g10b1
cccacttttccggaaaagcagcgtaatgggtgaagaagtgaaggtttttggatactgggcaaccccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaag

SEQ ID NO: 1975 - DNA, 435 bp, Gossypium hirsutum
  Clone ID: uC-gsronu33B078g11b1
gaacttttgaaggcattggattattgccactcacaaggtattatgcaccgagatgtgtagccccataatgtcatgattgatcacgagcagcgtaaacttcgtcttattgattggggccttgctgagttctatcatccagggaaagaatacaatgttcgtgttgcttcgagatattttaaaggtcctgagcttcttgttgatttgcaagactatgattactctttagacttgtggagtcttggttgtatgtttgctggaatgatattccggaaggagccattcttttacgggcatgataattatgatcaactagtcaagatagccaaggttcttgggacagatgaattaaatgcttatctaaataagtacggtatcgaattggatccccatcttttatttcttgttgggaggcatagtcgcaaaccttggacaaag

SEQ ID NO: 1976 - DNA, 186 bp, Gossypium hirsutum
  Clone ID: uC-gsronu33B078h01b1
ctcacattttagtcattgtgtttctctgcatgggactaatatagtttgctggatcaagattttgtttatttttatttttccttcagaacatcatttggatggtatcttttgatttgatcttgattttggagggtaaattgtagtttgtggagagttttttaatgtttactggtgttttcattttct

SEQ ID NO: 1977 - DNA, 469 bp, Gossypium hirsutum
  Clone ID: uC-gsronu33B078h02b1
cccacgctttcgcccacgcgtccgctctctccccatcttgaaggcaaacttattaaaagtttaacacctctttcattctcatatctttaattgtttgaccagatggctcttctaattaacgaagtccacttcccttactaaccagatcttctccatccttgaaaacaaatttcttttcggtgatcacgagaacaatgctgctgcaaaaacccatgaagaagatcacttgaaatctggaaatcagatttccgggaaagtaagaatcctatccattgacagtgggagcttttccgatggtatattggccgcccaatccctccttaccctccagacttttctccgtcaaaagtcggggaatcccaatgctgtcattgcccagtatttcgacgttgttgcaggctctggtgctggtgcgattctcgccgcattgttgtttactcgcgctgaaaacggcgctcccatttttact

SEQ ID NO: 1978 - DNA, 230 bp, Gossypium hirsutum
  Clone ID: uC-gsronu33B078h03b1
ggctattgtagcttatcttttggcaaaccccgatgcctgcggctaatgatatagcttcctttgaattctcatgcatgcttttaaagggtggtgtgattataatggtgtggttttgatattttattttcggccttgaactctaaactgtctttggagtattccaataaaagtgatggtgatcagactttggtcatcttaattcatttttaatatagagtttgagttgaagc

SEQ ID NO: 1979 - DNA, 436 bp, Gossypium hirsutum
  Clone ID: uC-gsronu33B078h04b1
cccacgctttcgcccacgcgtccgcccacgcgtccgcccacgcgtccggtgacagagagcggcactgcaaaaaaaaaaatgtctgcaacgggaaacgtcggcggcggaggaccagaggaggataagatgccggccgatcaagctaatcacattaatctcaaagtcaagggccaggatggaaacgaagtgtttttcaggattaagagaagcactcaaatgaggaaactgatgaacgcatattgcgataggcaatcggtggatctgaactccattgctttcttgtttgacgggcggaggctccgtggagagcagactcccgatgagctggagatggaggatggagatgaaatcgatgcgatgttgcaccagaccggaggagcggaataaagcagtaggtattatatatatgatattgcttcttctatatatgtaaatg

SEQ ID NO: 1980 - DNA, 435 bp, Gossypium hirsutum
  Clone ID: uC-gsronu33B078h05b1
actgatttttcctcattctggaaactcttcaccgtagtcccggttttagtcactgcatatatctgccactacaatgtccacagcatagataacgaactggaagattcaacccagataagaccggttgtgcgaacagctctggctttatgctcaactgtttacataatgacaagctttttcggatttcttctatttggtgacgccacaatggatgatgtgcttgccaactttgataccaaccttggcatcccctatagttccctgcttaatgatgctgtccgtgtcagctatgctgctcacctcatgctcgtatttcccattgtcttctatccactgcgactcaacatggatggcctcctcttcccttattcaaggcctctagctcagtctaatacaaggtttgcttgtattactgccggactcgtagcagttatc

SEQ ID NO: 1981 - DNA, 417 bp, Gossypium hirsutum
  Clone ID: uC-gsronu33B078h06b1
cccacgttttcgcccattttcccaattccaaacagttaggaggcctatgttaacacatgtttgtgatagcggcgacggtgagtttcctctcaacgtcaccacttcgggaaacacagtggttttaaagacggtgctgatgaaaaccagtgttagtggtaccatttataccgatggtcagctggctgtttatcgagtcgatcaggtgcttcaacctttgcaagtcttcgctgctaggtcttcagctctggcaccggcaccgggaatgtctaggaaggctgctgacgttgatgggaactccaaagcttcgagccttgccatgcaaaacttagctttgtttgtagttagtgttatagcttttgcactttctttgtgacaaaaaagggttttgataggatttcgtgatggaaaaatcgggga

SEQ ID NO: 1982 - DNA, 276 bp, Gossypium hirsutum
  unsure (1)..(276): unsure at all n locations
  Clone ID: uC-gsronu33B078h08b1
ctaanataggagagactactactataatttacccataaagttaaaaaggataacaactatgagaaaaaaaaaaaaaaaaaaaaaaaaaaaaaaaaaaaaaaaaaaaaaaaaaaaaaaaaaaaaaatcagaatgaaagtttaaataaaaaactggagttttccgaaaaaaagagaagaagagcagaaaaagaaagatcttaattcatttttaatatagagtttgagttgaagcaaaaaaaaaaaaaaaaaaaaaaaaattatttctcgggttcccct

SEQ ID NO: 1983 - DNA, 462 bp, Gossypium hirsutum
  Clone ID: uC-gsronu33B078h09b1
gaaatttttaacccaaacccttcctccgccggcatttgggggcaaaataaaaaaaaatgaagttcaaattgaagaatgcctgtattttcttcaagagctatgttcaggaactacgacaagcatagaaaagcaaaaaagtgaccctaaaggcaaattgtccgacgtgttcaggagctatgctgattctaatggggagctaaacaaggaaaagctgaaagacgcttttctacatctggatgctgccatgccgtaccggcaagccgaagaagccctccgtgtcgtcggcaaaagctattacattaacatcaaggatgaaaccgaccttaacacccttgtcgactatgcttacaataagggttacgggtattcaatttgattagctaatttataagcttattttctttttctttttcacttttaatcatctaatatgttttttttaaatatatgtaagtttcgtcc

SEQ ID NO: 1984 - DNA, 384 bp, Gossypium hirsutum
  Clone ID: uC-gsronu33B078h10b1
gaatgatcttatcaatcctgaggtgaagatatcgatgggggaaaactctcctgatgatccccgacaaaggaagccggacataaccaaagcaaaagaggtgctcggatgggaaccaaaggtgaagttgcgtgacggacttccacttatggaggaggatttccgactgaggctcggggttccaaagaagaactgattgaaagctattttgcagcaacagaagttacaaatataaagtgctattgcttcttttcctttttataatcaaattccaatatgcttatcttcaatgcataataatggcagcaattgagttattttggattttgtttttaatgttttttgaacgatatttgagttaaatggaacacaatttttgcctttcat

SEQ ID NO: 1985 - DNA, 435 bp, Gossypium hirsutum
  Clone ID: uC-gsronu33B078h11b1
cggacttttgggatgcactcaaatccttcttgaagctggggcaaaagtggatgctctggacaagaataagaacactgccctccattatgcagctggctatggaaggaaagactgtgtggcccttctactcgagaatggtgctgctgtcactctccaaaacatggacggcaagactcccatcgaagttgccaagctcaacaaccagcacgaggtactaaaattactggagaaggatgcgttcctttgaagcgtgaagtggtggggatgcgaatggtatgtgtatgtttgggtcttagcatgtttgttataggcatctgattttattacccagctattggacaaatttggttgtaatcatggctgaacggcatgatatgctgtctttgctttggcctggttgcctacgttttgcaaatttatttagtggggtttttt

SEQ ID NO: 1986 - DNA, 434 bp, Gossypium hirsutum
  Clone ID: uC-gsronu33B078h12b1
tcgttttctaaaaaaaaaaaaaaaatctatgttaaatggctgtctccatttctgtctcatcggcgctcgtcttcctcgtccgctcagatcaagcctcgtcaactcgtactctaacttttcagcggtccggtcaagcgccgactcagccatggcagcactcaactcagtccgagtagccgcggttcagatgacctccgtcaacgatctcgcctccaatttctccacttgttctcgcctcgtcaaagaagcagcttcagctggggcaaaaatgatttgtttccctgaaagtttctcctttctgggtcccaagtctgaggatagtcttttggttgcagaagctttagatggaccaattatgcaaaaatattgctctttagcaagagaatatagcatttggttgtcccttggaggtttccaagagaaaggacatgatg

SEQ ID NO: 1987 - DNA, 52 bp, Gossypium hirsutum
  Clone ID: uC-gsronu33B079a03b1
cccacgcgtacgggccatgaagatgcgaagccagcacaatggggccatttta

SEQ ID NO: 1988 - DNA, 461 bp, Gossypium hirsutum
  Clone ID: uC-gsronu33B079a04b1
ctcgattctattctcatccaagtgcacatgtgcgcgctctcaggccatttgtccgtcgcttttttgtgcatatagcctcaatcaattcaaaatccaaggtggaaataaacggcatctgtggtgcctcttaccaggtcttcaatataggtgccatcaactggcaaactgatatcgataagtgctcaacacgggaagtttatagtcagctagcaagaggaatgactatactgtggctcgacactgcagccaaagaattaggatcgtaatatttccatatcacatccattaactttcggattatcaggataaatacccttgctatttctcctattaaaactgacaatccaaagaagactcaagacttgcttcaatttgctggaaccacatgggtcgggcagaaaatgcagctcatcgagtagttctaggggatgaggatgaaggctctgaatgccatgaaactc

SEQ ID NO: 1989 - DNA, 472 bp, Gossypium hirsutum
  Clone ID: uC-gsronu33B079a05b1
gccaattctgggagactggaatggtgccggcgctcacacaagggacagttcgaagtccatgttaagtgatggaggctacgaggttatcaagaaagcaattgaaaagcttgggctaaggcacaaagaacacattgctgcctatggagaaggcaatgagcgtcgtctcaccggccggcacgagaccgccgacatcaacactttcttatggggtgttgcaaaccgtggggcatcaattcgtgttgggcgagacactgagaaagccggaaaagggtatttcgaagacaggaggccagcatcgaacatggatccgtatgttggcacgtccatgattgcagaaaccaccatcctgtggaaaccatgaggggaagcccatgtttgggatgctgtttccatggtagaaagaaaggaaagagccaaagtgtttggtttgttcccctccagtaggatacactcatttcattgcacttagtaa

SEQ ID NO: 1990 - DNA, 479 bp, Gossypium hirsutum
  unsure (1)..(479): unsure at all n locations
  Clone ID: uC-gsronu33B079a06b1
aacatttctcttacaacagccccatcaatcccaactgaaccaaggaatgaagcagctgctgctaccccacctccatccccacctaaaccctctcctgagaagccttctccatttaaaagctctgcctttgggcagtcatccaagttagctgccttggaggcttctggatctagcaactatgttctagtaccttctcccgttgttggtatattccaaagaggtagaacaatcaagggaaaaaggcaacctcctatctgtaaggagggtgatttgatcaaagaaggacaagtgataggattcttgaatcaatttggttttgaactacctgttaagtctgatatagctggaacagtcttaaagatcctcttcgaagatggagacgccgttggttacggagatccactctttgcagntttgccatcatttcatggcatcgactaatctctttcttctacctatgatacttgtgcagagataat

SEQ ID NO: 1991 - DNA, 381 bp, Gossypium hirsutum
  Clone ID: uC-gsronu33B079a08b1
gccaagtactcttcagtctcagccgatcttaaaccatggggcgcgtttttacaaagacttttaggaaatcgacccgccaggtaatcgagcgggactattctcgaatgaccctcgattttcacaccaacaaaaagattatcgaagaagtagctataatcccatccaagaggctccgtaacaagattgccggtttctcgacccatcttatgaaacgtatccagaaaggaccagttcgcgggatttctcttaagcttcaagaagaagagcgcgagcgtcgcatggattttgtccccgatgaatcggccatcaaggtcgaccaaatcgaagttgataaggaaacacttgatatgctttcggttcttggaatgggtgatattcccg

SEQ ID NO: 1992 - DNA, 343 bp, Gossypium hirsutum
  unsure (1)..(343): unsure at all n locations
  Clone ID: uC-gsronu33B079a10b1
cccacgcttccgaaagcttgttgttatgttatgatcacgatttacattgcgaagagggggttgggtcnnnaacgctccaaggntatcaagaaagcaattgaaaagcttgggctaaagcacaaaaaacacacagctgcctatggagaaggccaaaaagcgccgtctcaccggccggcacgagaccaccgccatcaacactttcttatggggtgttacaaaccgcggggcatcaattcgagtcgggcgaaacacctataaaagcccaaaaaggtatatccaaaacagtaggccaccatcaaacatggatccgcatgttgtcacgcccatgattgcacaaaccacc

SEQ ID NO: 1993 - DNA, 394 bp, Gossypium hirsutum
  Clone ID: uC-gsronu33B079a11b1
gcgcgcgtcttctgaaatattgttcttttcgcagactgtctgggagttaaaagggaattcaaattccaaagagaaaagcgcgagaaatcccatatatttatctacacagcaaaaagaagagaaaaaagggaattcaaattccgaaagagaagaaaaaaatcgatggatttggatcagcggatagcaaaggctaaagaaggccagcatctttcggaagacgagcttcagcttctttgcgaatacgtaaaagaaattctcattgaggagtcgaatgtgcaacctgtcaacaggccggtaaccgtctgtggtgatatccatggccagtttcatgatctgatgaaactctttcagacaggaggacaagtgccagaaacaaattacatccccatgggag

SEQ ID NO: 1994 - DNA, 482 bp, Gossypium hirsutum
  Clone ID: uC-gsronu33B079a12b1
cacacttttaaatgcttaggccattttgctttaaatccccagccacaacgcccttattttttaatttctccaagcatttccaaaagggttattccgattcttctttctttaggtctaattggagaatcagcaattacccgtctttcatggctaccatctcctccgtttccacccacaaagaccctgtttctactcacgatgccactcccaatatcacccaccaaccagttcaggttgcgaagcgattggagaagttcaagactacaatttttactcagatgagtatgcttgcaatcaagcatggagcaataaaccttggccaagggttccccaactttgatggtccagattttgtaaaagaagcggcaattcaagccattaaagatgggaaaaaccaatatgctcgaggatatggggttccagactttaacaacgccatagctgctcgcttcaagaaggatactggacttgtgattgaccct

SEQ ID NO: 1995 - DNA, 335 bp, Gossypium hirsutum
  Clone ID: uC-gsronu33B079b02b1
cacgatgtttccatcgatggtatcaaaatgaggggcaggaggcactatttgaacccgattgttgcgactcgagagaacttgaggaagggttaggaaactcacagacggaatgtcctgggcaatgcgacctgggcgatcgagcagactatttatggtcgccaaactacaccagaggtggctgcgaatggagacgaaagcgatagacggaatgatcattacctcggccacgcttgagggtgacactgtaacgaacccgggtaacagcacatatgttcaggggcccgccgacgcgccgatggaagacgtatcaggttgcacggtgaatttcgggacgg

SEQ ID NO: 1996 - DNA, 257 bp, Gossypium hirsutum
  Clone ID: uC-gsronu33B079b03b1
cacaattttaagtgcaagcgatgaaccgagagagcaaaatgataccttatgagggaagattatcagtgacgaccgcaagaagcgtaagcaagaaccgtcagctaataaaccactactgtttgaagatgagccatgtgtgcaatctaacagtcgacaacgactaaacaatatttgctaccacaaagggactgactgcgtacatgataggatgcatatcttcacgcactatatggctaacaatggcatcaacctgggat

SEQ ID NO: 1997 - DNA, 161 bp, Gossypium hirsutum
  Clone ID: uC-gsronu33B079b04b1
cccacgcgtcctaaacacaaaaaaaaaaaaaaaaaaaaaaaaggcaaatttttaaaaaaattttttgtttaaacacccccaaaaaacaaaaataaaaatcttgcccctaatgaccaaaccaacctttttctttgcccgatttaatccccgctgcccccctt

SEQ ID NO: 1998 - DNA, 493 bp, Gossypium hirsutum
  Clone ID: uC-gsronu33B079b05b1
cccacgctttcggaaaacataggataacatgtatgcataaaagacgacaatggatgaatgaagataatatatcttacttaatcaactaacaaaacaattaaatatgattaatctaaaaatatgacctaattttcaagcatgtacggagaataattaatacaacaatacaaaacaatgaataaataatatgcaacgacaatgtatggcaccatacaaatcaatcaacaaaacatgtataaaacaaaatggaatttagaagtcaatgtggtataagacattttccaaaataatgatgaattaatgaacgcataatatatataagttgacaaatttacataaaaactggggatatagaattattgaaatagatattatagaataaaagtttgaatcaaattatatgcaaaatattttaaacacaagttcattcaaaaattgacaatgtacatgatagcttaaataatatataagatatgaaagaataataaaaata

SEQ ID NO: 1999 - DNA, 131 bp, Gossypium hirsutum
  unsure (1)..(131): unsure at all n locations
  Clone ID: uC-gsronu33B079b06b1
ctcacgnttgcgaccagacagtcagagatcctcccaatcaaagcgacaatgtcaaagagaaccatgaaggctggaattgttggaaaatatggtactcgttatggtgccagtttgaggaagcaaattaagaa

SEQ ID NO: 2000 - DNA, 265 bp, Gossypium hirsutum
  Clone ID: uC-gsronu33B079b07b1
aaaaaataaaaaaacaaaaaaaaaaaaaaaaaaaaaaaaagaaaaaattaaaaaaaaaaatagggaaaaaaaaacaaaaaaaaaaaaaaaaaaaaaaaaaaaaaaaaaaaaaaaaaaaaaaaaaaaaaaaaggggggggccgcccaaggggaccaaggcaaccacccccggggagggaacccaaaggacactaaagggggccccgaaaagaaaaccaccgggcccacgctaaaaactagcaaagggggaaaacccggggacaacc

SEQ ID NO: 2001 - DNA, 192 bp, Gossypium hirsutum
  Clone ID: uC-gsronu33B079b09b1
caatagtaaagaaacaaagcaagaacaagaaaaccagatggaaaaatgtcgggaatcatgcacaagatcgaagaaacccttcacatgggagggcacaagaaggaagaagagaagcacaagggagaagctcatcacgaaggcggccatggtcatggttatggcgccgctgagcacaagggagaagtgcatgac

SEQ ID NO: 2002 - DNA, 434 bp, Gossypium hirsutum
  Clone ID: uC-gsronu33B079b11b1
gccgtatgccagcctagcgtttccataaggaagaaatggcggtccctttgctgtcgaagaagattgtgaagaagcgtgttaagaagttcaagaggccccaaagtgatcgcaagatctccgtcaagacaaactggcgaaggcccaagggtattgactcccgtgttaggaggaagttcaagggatgcactttgatgcccaacatcggttatgggtcagacaagaaaacacgccactatcttcccgatggatttaagaaattcgtggtgcacaatgtccaagagctagagcttctcatgatgcacaacaggacatactgtgctgagatagcacatgatgtttcaacgaagaagaggaaggaaatcgttgagcgagcagctcagttggatgttgtcgttaccaacaaattggctaggctgcgcagccaggagaacgag

SEQ ID NO: 2003 - DNA, 343 bp, Gossypium hirsutum
  Clone ID: uC-gsronu33B079b12b1
gtgatttttgccgaatgcattcttcctgattaccccgaccgtagccttgccacgaagttggttgtccatattgattgcattatgttggctcacaaccctggtgggaaagagaggaccgcaaaggaattcgaggcactcgcaaagggtgcgggatttcaaggcttccaaattacatgttccgcttttggcaccaacatcatggagtttctcaaaagtgtttgaatcttacatgcttttggattctgaagcttggtgattgttgtctcaaaggtggattttctggaattacatactttttgtctgacagaaaacaataaagaatgaaatttcatggcttttacgt

SEQ ID NO: 2004 - DNA, 371 bp, Gossypium hirsutum
  unsure (1)..(371): unsure at all n locations
  Clone ID: uC-gsronu33B079c03b1
acccccactagtacgcgaccggccgcacaagagganccaagcgtgccgactttaagaccgatttcgcgatcacacccccncccaccaaagnacaaaccaccaccccaaaaacgcaccaacccccagccaaagaaccaaaaacaaaagaaaaacgcccaaaaaaaaaccaaaccccaaaaacatacaaacaacacacaaaacaaaaaaccaacaaataaaaacaccaagcaaaaaaaaaacacgccaaccacaaaacaaccaagaaaacccccgcaaaacccccaaccccaaaagcccaacaaacaaacacacctacccaaccaaacaaaaaaaaaaaaagcaacgaaacaaacaaccatacagcccccaac

SEQ ID NO: 2005 - DNA, 524 bp, Gossypium hirsutum
  unsure (1)..(524): unsure at all n locations
  Clone ID: uC-gsronu33B079c06b1
gcaggttttagagcaggcatggtatatgaagccagtctttgctatactcattggaggcattcttccatttggggccgtttttattgagctcttcttcatcttaacgtcaatttggctgaaccagttctattacatctttggcttccttttcatagtgtttgttattctaataatcacttgcgccgagataacaattgtgctatgctacttccagttgtgcagtgaagattaccattggtggtggagatcttacttgacagctggctcctctgctctctaccttttcctatactctattttctacttctttaccaagttggagatcacaaagcttgtctcaggcctcctttattttggctacatggtaatagtttcatatgccttcttcgtcctgactgggacaattggcttctatgcgtgcttttggtttgttaggaggatctactcatccgtcaaaatcgactaagatgagtatatagaaaggacacangacctatgcgaattacagactggatgaggggaaa

SEQ ID NO: 2006 - DNA, 543 bp, Gossypium hirsutum
  Clone ID: uC-gsronu33B079c07b1
cggacgtgtgggcgacactccacatcgcagcaatgggtgaggaagtttaggctttggtttctgagtcactgttgaagaagaacaagaggaatgaagaatgggagcttgccaaaaagcaggagctcgaagccgccaagaagaagaatgtcgagaaccggaagttgattttcaacagggctaagcaatatgcaaaggagtacgaggctcaggaaaaagagttgattcaattgaagcgggaggcaaagttgaaaggaggattctatgttgatccagaagctaagcttttgttcattgttagaatccgcggtatcaatgccatgcacccaaggaccagaaagatcttgcagctcctacgtttgagacagattttcaatggtgtttttcttaaagtgaacaaggcaacaatgaacatgcttcaccttgttgaaccttatgtgacttatggataccccaatctcaagagttgtagggaactccgttacaaaagaggtttggaaagtgaacaagcagcgagctggccggaccgacaacgcaattgttgag

SEQ ID NO: 2007 - DNA, 457 bp, Gossypium hirsutum
  Clone ID: uC-gsronu33B079c08b1
cgtttgtctcagatctcagaagatggcccgtaccaagcagagccgcccgtaagtcgactgttgggaaggctcctaggaagcaacttgctaccaaggccgcccgtaaatctgccccaaccactggtggtgtgaagaagcctcatcgataccgtcctggaactgttgctcttcgtgaaattcgaaagtaccagaagagtactgagcttcttatcaggaaattgcctttccagaggcttgttcgtgaaattgcccaggatttcaagactgatttgcgtttccagagccatgccgttcttgctcttcaggaagctgcagaagcataccttgtgggtctctttgaagacaccaacctgtgtgcgatccacgccaagcgtgttactataatgcccaaggacattcagttggctcgtaggatcaggggcgagcgtgcttaatttccaagtgtgtaatcacacac

SEQ ID NO: 2008 - DNA, 465 bp, Gossypium hirsutum
  Clone ID: uC-gsronu33B079c09b1
ggagccttatgttcgacctggtaaatgtctttgaagtgggggttccttaacttcttttatatgccaacccatcggatccattgaatggagaagctgctgctcttatgatgcgtgatcgtgctgcctatgaacaaagagttaaagagtattgtgagaaatatgccaaacccgaagacattggagcaaaggcggaagagaagtcgagcgacgaagagctgagtgaagatgaatatgctgcctctgatgatgaggaaatcgccggaaaacccgatccttaagccaacataagattaccctttttttcctagagaaaaaattgtgtgttgtacattgatattttcaggtccaggaaaatttgaagttgagcaaaaactatggggggacttaatggaaaaaatttccaaccccttggttttctgtctattttccatggatgttgtgtaaattaaaatcaactgtttactt

SEQ ID NO: 2009 - DNA, 369 bp, Gossypium hirsutum
  Clone ID: uC-gsronu33B079c10b1
cccacgtttccgcattttcacagcttaaaacacaatatgaggaaggatatagagaccatttcggagcaaggcggcggagcggagttctcagcgaaggactaccaggacccaccaccggcaccgttgattgacttggaagaactcaccaaatggtcgctttatagggcggcgatcgctgagttcattgccacccttcttttcttggatgtcacggtgttgactgtgatcgggtataaagtccaaaccgacccggtaaagaatacctgtgacccggattgtggtggtgttggtatacttggtattgcttgggcttttggtggcatgatctttatccttgtttactgcactgctggtatctctggaggacac

SEQ ID NO: 2010 - DNA, 470 bp, Gossypium hirsutum
  unsure (1)..(470): unsure at all n locations
  Clone ID: uC-gsronu33B079c11b1
agatgctataacgaccaaacaaaagttggngcaaaaaggtgttacaattacaaggagtttttgagtccctcacccccctcaaaaacccagccagaaaggaaaatacaaacacctcttctccttgctcaggagcatcgaagccagcttacaaatggcagcgaagagaatagaagctcaggctttattgatactgatgcctgccttgctgcggatgtcccttgcagctgtttacaaggttggagactctgctggctggaccaccattggcaatattgactacaaacagcgggctgcaacaaagaccttccaagccggtgacgtgattcttttcgaggacaaagctcagctacacaatgtgatgcgggtaacccattcgatgtacagggcccgcaatacctcatcccctttggctacatataccactggcaatggctccattaaaataactactaaagggcacccattttttt

SEQ ID NO: 2011 - DNA, 506 bp, Gossypium hirsutum
  unsure (1)..(506): unsure at all n locations
  Clone ID: uC-gsronu33B079c12b1
cccatgtgnccggaaaaccgtatcatggcgctaccaccctggattggttgccttcaagttttgacaaagcttgatcttcactcaaaccaacttataaaccttcctgattcgattggggaacttatgaatctaacagagcttgatctccgtgcgaacaggttaaagtcgctgcctgctacttttgggaacttgataaacctcatgaatctagatttgagttcaaatgagttcacccatttgcctgagacaattggaaatttaacgtctttgaggagactgattgttgaaacaaatgagcttgaagaacttccatacacaataggaaattgctccttatttttggagctaagattagattttaatcagataaaggctcttcctgaggctgttgggaagcttgaacgcttggaggttctcactgcacactataacaggctcaaagggttgccgacaacaatgggcaacctttccaatctaaaggagctcgacgtacgcttaacgagatt

SEQ ID NO: 2012 - DNA, 122 bp, Gossypium hirsutum
  Clone ID: uC-gsronu33B079d01b1
aaaaagttaaagggccaacaaagaagcaagggagcaaagggggaccttttgagggaagattatgacagacacccgcaagaagcgtaagcacgaacggcaagcaaaaagaccactactggcga

SEQ ID NO: 2013 - DNA, 550 bp, Gossypium hirsutum
  Clone ID: uC-gsronu33B079d02b1
aaaattatgaattgaaaataaagtactcaaggtgcagaatgatgctttatgtgggaagattatcagtgacgatgacaagaagcgtgaacaagaacggtaagctaaattaccactactatttgaagatatgccctgtgttctttctcactgacaaaatgtgctatattttatttcctagcacaacttgtctgtctttgtactttattttctgcttatcttcatgcactatatggctacttatggcatatcttgtgatagcagtgtagctttcatgtccttgacctctcttctttgatcttccatgatctcttttcttgttttcacacgtgttatcttccttttcatgggtgtatagccggtgggtacactgtaagtcggccaatattggccggtatgatagtgagcctccattgtgttatttgtaggggtaatcatataggagttacttcggtggtgcaggatgttgctaattctcttcagtatgggctttgatttggaatgtgttactacctcatgaatgttatttaatacatgaccagggaattactac

SEQ ID NO: 2014 - DNA, 117 bp, Gossypium hirsutum
  Clone ID: uC-gsronu33B079d03b1
aatgttctatcttactataatcaagttgtatgcaatcaacttgtcatatcttgctaccagatccattcaagcaatgagttctttaattaaccttatatatatacatatatattattt

SEQ ID NO: 2015 - DNA, 308 bp, Gossypium hirsutum
  Clone ID: uC-gsronu33B079d04b1
tactagatatcttatagagagagctaactacaatcaactgactggccgttgacaaacaacggactgactgaacaatggctggacccacctaaatcaattggcaggacatacatctttctttagctggctgaataactaacaggcaggcacggatcgatcgtcctaacaaacaggcacgcagaatggatggtgaaacgcacgctgtatggagccattaagtacgcgcggtgtggggggtactcacaggcagaccgatacattcgctagcgagctagctagcgctcgtttcgctcgcttaccttcctttc

SEQ ID NO: 2016 - DNA, 345 bp, Gossypium hirsutum
  Clone ID: uC-gsronu33B079d05b1
ccgatgttctggagcgactcgttgagaggcaggtggccgagcctagagaccgctatgaagctatgaatgttcgcccggcaaaccatgtgcaagcttacgctgtagacgactctgattgtgcgaccgaagcgaactgccctaagagatgagtattgctcattgactggaattctgaccagacacagtagaggcggagcgctagcggagctaggtgacaagaacaaaagggaattggatggcctgcatatagagttgcaagctaccgacccttgcgtgatagatcttgatgtcataatgaggcgagccaaatgaaatgtactgaccattgctttacagcaatgggac

SEQ ID NO: 2017 - DNA, 411 bp, Gossypium hirsutum
  Clone ID: uC-gsronu33B079d06b1
cccacgcttctcgaaaaaaaaaaattcacagatccaaaatcaattctctagggttcattccagcagcctccatttgctaaggcctgttcatcaccagtgcaccattaaaattggtgagtgatgtagaagcagcctttacctccaccgaaatcaacactcaagaccattttcacttgataatctgcattgcaaaccccgatttagacggagaagccaagggatctcatcgatgcatttaacgaagtattggatttgcctagtgtgcgtagagtgtgcgtaatgtctccgtccctttgcaggatcatccgtaccgaggagcagggagaggcacgcatgaaagaaaccgtgcgaggaaaccgctcgtgagatccaaccccctgacactgttcttggcatgtccagaagcttctg

SEQ ID NO: 2018 - DNA, 475 bp, Gossypium hirsutum
  unsure (1)..(475): unsure at all n locations
  Clone ID: uC-gsronu33B079d07b1
gaagtgtatttgcagttgttttgatttgttttgtggtgaccgctgtctgtggtcaatctccggcagcctcacctactaaagctccgccggccgcgactactcctgctactgctactgctcccgctactgcccctgttagcaaacctaaatcaccggctccaactgctgcccctaccacttccccaccaacttcttcaccaccggttgcggctccggagaagtctgcggcggttccagccccatctaaatctgctccgtcttctcctccggctgctgcgccggtgagttctccaccggctccagtacctgtgagctctcctccagccagatcgcctcccgttgctgcaccgacgactccaccagagagctcggcctctcctccggctcctgttacggcaccaactactgctgaggttccggccccagctccaagcaagagcangagcnaaagcangaaatccaaagaacaccatgc

SEQ ID NO: 2019 - DNA, 425 bp, Gossypium hirsutum
  Clone ID: uC-gsronu33B079d09b1
ctttgttttttcattgcttccttgcctgccttaaacctccgtcaagcatagccatgactactgaatggtaatggttgatgaagtcccttttcctccacaaatcacaactaccaagccactatctcttttgggtcatggaattaccgacattgagattcactttttgcaaatcaagttcacagcaattggggtttaccttgaaccagaagttgtaggacatttgcaacaatggaaggggaagcctgggaacgtgctagctgaagatgatgacttcttcgaggctcttattaatgctccagtggagaagtttctgagagttgtggtgattaaggagatcaaaggttcccaatatggagtgcagctagagagtgctgtgagggaccgattggcagctgacgacaaatacgaagaggaagaggaagaag

SEQ ID NO: 2020 - DNA, 370 bp, Gossypium hirsutum
  Clone ID: uC-gsronu33B079d10b1
gtttctggtttgcatatgatttagcgggttctcgtgtcgggttttctccccgtggatgcgcctaaaaatggcggtgcttttaatttttatattaagggacaaagctctatccctatctctatattattttccttggatatttttgggggagggtaagaaaggaagaaacataataatgttttcatagataagaatgtaagggaaagatgatgaccaggaaaggcgggttgctggttagaagtagagaatgtcgttcggcgggttttcggttttcacgtgttgtccattgtacttttgaaacaaaagaaatggcatgtccaagaaagctatataaaaaaaaaaaaaaaactataataaaacattgtttaag

SEQ ID NO: 2021 - DNA, 276 bp, Gossypium hirsutum
  Clone ID: uC-gsronu33B079d12b1
attgtctactcgctcgtgaacatcttacaagatctctcctggagtaaaatgtgtttacattgaaccaaacgagataagctcgacggtattatctttccgtaatgatactgtacttgatatgttttaggataatttttgtgccttgttttgaatgcgatagaactgaatatatacttgcggcagatgttgtttacattgatgttattgcaatgttgtgctttcttgatactacttgtcgtgccatctcattgcatccaataaaagcattcggttttg

SEQ ID NO: 2022 - DNA, 417 bp, Gossypium hirsutum
  Clone ID: uC-gsronu33B079e03b1
ggaagattatagagaaccaaacagcatgctcacctgccagggaggcctacaggaagcagttggctgagaccttgaacatgaaccgcacccgaatcttggctttcaagaacaagccaccagcacccgtcgaactcttcccttccgagcactcaacggcttcagctcatccgaccaaatccttaaagcctagaagacatattccccagagctctgagagaacattggatgctcctgatctcgtcgacgatttttacttgaatttattggattggggcagcagcaatgtactagcaatagcactcggaaacaccgtgtatctgtgggatgcttcagatagttctacttcagaacttgtcactggtgatgacgaaaacggaccacgaacaagtgtgaattgggctcctgatggtcggcata

SEQ ID NO: 2023 - DNA, 454 bp, Gossypium hirsutum
  unsure (1)..(454): unsure at all n locations
  Clone ID: uC-gsronu33B079e07b1
gtatcctacggtctccgtggctacgagtcctctgttctgggtgtcattggccatacacgtcacgctatctccttcgcccgctttgcttacaagcatggaaggaagtacgagacggtggaggaaatgaagcttcggtttcagattttcaaagagaatttggatttgatccgatccactaacaagaaaggcttatcttacactcttggtggtaatcgggttggtgattggagctgggaccaggtccaaaaacacaaggttgggagctgctcaaaactgctcagccaccacaaagggcaatcaccaactaactgatgtcgtcctccctgaatcgaaagattggagggaagcagacattgtcagccctgttaaagaacaaggctcctgtggatcttgctggacattcagtaccactggngcactagaggctgcttatcatcaggcatttgggaaaggg

SEQ ID NO: 2024 - DNA, 417 bp, Gossypium hirsutum
  unsure (1)..(417): unsure at all n locations
  Clone ID: uC-gsronu33B079e08b1
gatgatgatatggaggtggatgggtgcctgttgttgctgttaanattggacttaggtttattcttaaatacctcggagttctatggttatttgcccagttacccgcgcttttgaaagaaatcctgggatcgatcttgaaggacaatgagggtgcacttttgaacttggaccaagaacagcctgccttgcgtttctttgtgggaggctatgtgtttgccgtaagtgtccacagagttcaacttcttcttcaggttcttagtgtgaagcgcttccatcatcagcagcagcaacaacagcaacaaaacaatgctaattctcaagaggaattaactcaatctgaaataagcgagatatgtgactacttcagccgacgtgttgcatccgaaccctacgatgcctcacgtgttgcatcattca

SEQ ID NO: 2025 - DNA, 459 bp, Gossypium hirsutum
  Clone ID: uC-gsronu33B079e09b1
cccatttgtccgcccacgcgtccggttttctctgtttgcgcgttgccttaatcatctttctctttctttaaaacttcttcctatttaatttctgactaaacttgcgctgaattccatggctactgcagaggttgtaacagctcaaactaatccatgaggagaaacctgaagaagtggtcaaggttgaagaaattgcaacagaagaggtagtggctgttgctcctgcaacagaacctgttgctgaagaaccaaaggaagcagtgcctgaagcagcatccgaagaaccccaggctccagaaactgaagccacagttgaaactgaatcaaaggaggtggttgaagagcccaaggctgtgactgaggagccagaagttgagaaaaaagaagaagagactcctgaggaaacagtagcagagccagttgcggaggagtccaaggagactactgagcccacccgtg

SEQ ID NO: 2026 - DNA, 404 bp, Gossypium hirsutum
  Clone ID: uC-gsronu33B079e11b1
cagactttccaaaggaatatatatatgagccgtggacagcgccactaagcgtgcaaactaaagcaaagtgcattattggaagagattatcccaaaccagtggttttgcatgatactgcaagcaatgaatgcagaaagaaaatggggcaagcttatgcacttaaccagagactcaatggacgtgtaagtgaagaatatttaaggaagttgagaagaaaatttgatgaagatgaagataagcaggaacccaaacccagaaggcagagacaaaagctgataaaatgagctgcaaaatctactttttcatccatccatatctttttttcttttttaaactataacttgataacttagaacttgttattgtgttacatgtttggcacgtaatataaattgataacttgg

SEQ ID NO: 2027 - DNA, 457 bp, Gossypium hirsutum
  unsure (1)..(457): unsure at all n locations
  Clone ID: uC-gsronu33B079e12b1
cccacgtgnccgaactacttgaaaaaaaaaaattaaatggggaaattttttaaaaatttttttggtttaataacaaaaataaaaatagggagggggcttttgatgttggggggcccggttttggggttctcgggctgcggcgctcttgcgttgccccggcttcctttcctttttctggggccgcaattcttttctttttgggcggcgtattcccatgcgttggccggtcttttcctggcgttgcccctgggattcccttggggtccccctcttttttcgcgggccggcctctccccttttggcccgtggccgttttcccttacgggcacttgcgcctcctctttgccaaggggtgccccccctgttggggcgttttatcccccccgggtgggggggataccgcccggggggctggtgctttttcctgagggtttccccccttttttttccggttttt

SEQ ID NO: 2028 - DNA, 85 bp, Gossypium hirsutum
  Clone ID: uC-gsronu33B079f01b1
gtcgatctgaagttccatcattgttgctattgatcaaattgatgccgtttgatgcgtgattatcaaagccacacgcaattagtgt

SEQ ID NO: 2029 - DNA, 90 bp, Gossypium hirsutum
  Clone ID: uC-gsronu33B079f02b1
gaaaatctgaagagccacgattgatgctagtgatcaaaatgataccatgtgcagcgggaatatcacaaccaccgccaagaagagtaagct

SEQ ID NO: 2030 - DNA, 407 bp, Gossypium hirsutum
  Clone ID: uC-gsronu33B079f03b1
cctattttgtctgccctgccttttccccttttgcccataggggccccttttcatgggccttccccgccttcacccttgctgtcagtcggccgctttatgatcttattttttgcctcggaaagaaacaagcccccttttgtatggcgcgcaccccaaccaggcgaaaaaccaaaagtcgcccgccaagctgaaggcggcccacaggggggagacccttgcgccccccccccccaagcacctttattagcccgtgggggaaaaaccccccgtgtagggccccccccaccttacccccctccggggggaccccccccccaacaagggcgcccccaacgaaaggcctttcaacaaaaaacaaaacacctccgggggccaaaaaacaaaagagggcccccctaaaaagcccc

SEQ ID NO: 2031 - DNA, 431 bp, Gossypium hirsutum
  unsure (1)..(431): unsure at all n locations
  Clone ID: uC-gsronu33B079f04b1
gttctagtgcgcgagcgccgcccttcaattctcacataaggggtgttttttaaaggcttttttgcgtttnccaccccagagcagcccacncatgagaggctccacagacgctgaacaacacaagaaggagcaagcctgaaaacgaaacagacaggagccccggcccaaggaacatcaggtacaacgagaccatcaaagaagccgcagaacgggaaagcgccggagccgaagcacgagccgagaacccaagcccagaccgcaagggaaggcatcgctcacgcagggaggccctaaaaccccccccaaaaccggaagaagagacggaagaaggagcagagcacaagcagcggaggaagatcccccggaccacaaaagagaccaacactggccgcccagacaggaaagccgccacgggcaatgaccaccccgga

SEQ ID NO: 2032 - DNA, 456 bp, Gossypium hirsutum
  Clone ID: uC-gsronu33B079f05b1
ccttcaatttctaggaaacaagacaggatctcatcaaagtgcctcgaataagcacgcaagttcttcggtactgacgaggatcttcttctgatatccgttgatgagagccgtaaacagaactatcccataatatgatttttgatacgagtagcacctgatattcttcattgagctgctctcatcattttctgcactgcacatatttttcaagttcgtgtatagtaagctttcggaacgagtattttatgtcaatgaagaatgattcagttttaatccacaaatcaggtacatttgtaaaataagttggttcattttgtatatgagctgtatattataatgtatttgttgtatatttctttgtccatgttggcaacttgtttgtaaactcaaatctatataataaatttcttcctttttaaaaaagaatgaaggccaaagggcttatatttatatgtt

SEQ ID NO: 2033 - DNA, 437 bp, Gossypium hirsutum
  Clone ID: uC-gsronu33B079f08b1
cacagaaaacagcttggtcaacggaaaatgacttacaggtcaatggaaaataagcatttttccttataaaatgacttacccttttcaaaagcgtcagtcattttccggtaaagaactctcaatagataattttattttttatataaaaattaacttaaatcaagtttaatattattatattgataataaattttatttttatttttaaaaatatttaaaattattaaaatattaatataaaatattatattttttaatattattaaacatacgtatttaattatttatatttagtcatataataaattattaatataattaacataatttggtggttttaataaattatttaatatttaaattttattttaatagtaaaatttaaaaaatattattcacatattattgaaaatatcaatattaatatttaatactaa

SEQ ID NO: 2034 - DNA, 336 bp, Gossypium hirsutum
  Clone ID: uC-gsronu33B079f11b1
aaaaaataaaaaaaaaaaaaaaaaaaaaaaaaaaagaaggggagaaatttaaaaaaaaaattatgggacccaagcccagcgacccaaaggggcggccgtagtggaggcccaaagcaacccaccgcccgcaggcacccaccgacgtgtccgtggacgccctcgaagaacacaacgctgtcccccgtgttacacatgcccgcactggaagcccccggaagaacccaagcggaccgcgccgggcgcccttcccccttgggccgcctcccgaatggccaacgggacccgcccctggccgcctccctaacggcggcccacctggaggggccacgcagccgc

SEQ ID NO: 2035 - DNA, 466 bp, Gossypium hirsutum
  Clone ID: uC-gsronu33B079f12b1
gtgggtggatcctttgtttgctaagctcaaggctttaaatggagaaagaagtagattatcacaaagctttgagtacaactatggtgattttatccccattttgaggccattcttgagagggtatttgaagttatgcaaggaagtgaaggaaatcagattgcagcttttcagggaccaattccttgaggagaggaagaagcttgcaaccacaaaaagaattgacaacaatgctttgaaatgtgccattgatcacattcttgatgctcaacgaaagggagagatcaatgaagacaatgttctttacattgttgagaatatcaatgttgctgctattgaaacaaccttatggtcaattgaatggggcattgctgagcttgtgaaccatcccgagatccagcagaaactccgcaacgaaatcgacaccgtactaggacccggcgtgcatgttaccgaacccgacacccat

SEQ ID NO: 2036 - DNA, 476 bp, Gossypium hirsutum
  unsure (1)..(476): unsure at all n locations
  Clone ID: uC-gsronu33B079g04b1
ctctaaattttgaaaccctaaaaaaggggctcgccaaaagggggcgttttgaaacgatctttcgggacgcacgacagngaaaagatgagtagccgcaccagcaggactctttacgtaggaaatcttcccggtgatgatcgcgagagggaagttgaagacttgctttataagtatggtcctatagctcaaattgactagaagattccaccaaggcctacaggttatgcatatgaagagactgaagaagctcgagatgctgaagatgccattcgtggacgcgatggatatgactttggagggcatcggttacgggctgaacttgctcatggaggacgtgggcgctcatccatagatcgacacagcagctatagcagtgggcgcggacgtggaccatccaggcgaaccgaatatcgcgagctaggaactggatagccatcttctgctgcatggcaggacctcaaggatcacatgcgccg

SEQ ID NO: 2037 - DNA, 506 bp, Gossypium hirsutum
  Clone ID: uC-gsronu33B079g06b1
cccacgttttcgcccacgcgtccggcgaagcggccaagtaataagatgaaagggacattggggaagcactttcaagttcagttccaccaccaccaatcatcttccgccacctcatcctccatcttcacccggaaccttctagatttcggatctcaggatgacccttccacttccgttcccgacctcgacgccgccgatgacaaagatttcattctcagtcaagacttcttctgcactcctgattatatcacccctgataatcagaacctcatgaacggctttgattgcaacaaggaaaatattccttgccctaagtcgccggagaagccgaatactctcaaaagcaagagacctcgacaagatggtatcctggtaaatcccctcagccctacattatctggctctcaacagatagtggaacttgccagtgacaacttttgataatattgaggcaaccctagaaaaagcatcatacctggagtacagaagactttaaaatatgtttc

SEQ ID NO: 2038 - DNA, 404 bp, Gossypium hirsutum
  unsure (1)..(404): unsure at all n locations
  Clone ID: uC-gsronu33B079g07b1
gctcttttatttattttcaaggggaaatcccttgcaggtgtgttgcctgcgattgatctttttggccacaatgctttggtggggatattctacttcattggttttggatttttctgcattgaatcattgctcagtgtctgggttattcagcaagtttacatgtatttcagaggtagcggtaaagctgacgagatgaagcgtgaggcggcaagaagaaccgtggcggcagcactctgataatgataaggaggccgtagcagaagatggtatttgcttgtgttggacttagatcttgtgagataagataccatgtactcaaattgcatcttcttcccatacccttcctggctggcttacttgcctattcattttattgatatgttgnttaaatatatacacatact

SEQ ID NO: 2039 - DNA, 403 bp, Gossypium hirsutum
  Clone ID: uC-gsronu33B079g09b1
gtcttatttaggttaggaagaatggcacctgcccctggcgaaggccttatggtaaaacttaggttactgttgagtactacaatgacaagggtgccatggttcccgttcgtgttcacactgtcctcatttccacccaacatgacgaaactgttacaaatgatgaaattgctgctgacctcaaagagcatgtcatcaagcctgtcatccctgaaaagtacctagatgagaaaacaatcttccaccttaacccatctggccgctttgtcattggtggtcctcacggtgatgcaggtctcactggtcgtaagatcattattgacacctatggtggctggggagcccatggtggcggtgctttctctggaaaggaccctaccaaggtggacaggagtggtgcttacat

SEQ ID NO: 2040 - DNA, 167 bp, Gossypium hirsutum
  Clone ID: uC-gsronu33B079g10b1
gattttttattattctgatttgtggatggatataatgtaagctggtctgcagcgcatcaaaatgactgaacctactttgtcgccatagttgcatttgcttcaaaggattaggttctgtaagtttgtgctttgattgcatttagatcaatgtttacaataagaggggt

SEQ ID NO: 2041 - DNA, 72 bp, Gossypium hirsutum
  unsure (1)..(72): unsure at all n locations
  Clone ID: uC-gsronu33B079h01b1
cagctattattaactctcgacagctgntgatgaactcttgagaggccttcttgctgctcaaagagattcctc

SEQ ID NO: 2042 - DNA, 92 bp, Gossypium hirsutum
  Clone ID: uC-gsronu33B079h02b1
cggacctttttacctacgcttagaggaccatcgggctatgggggacgatcatcctagctatgtgcgttcacaatactcttggcgattcactg

SEQ ID NO: 2043 - DNA, 515 bp, Gossypium hirsutum
  unsure (1)..(515): unsure at all n locations
  Clone ID: uC-gsronu33B079h06b1
cggacgcttgggcggacgcgtgggcttgttcgtagcaattgatcgtcatttcaagctcaattctctgaaaatttttgtgctgaacttcttttttctctttgtaccaccatgtgtggaggtgctattatctccgatttcataccgccgtcgcggtcgcgacgattgacggccgatttcttgtggcccgatctgaaaaaatccgggttgaagaaggggtcgggtaagagatactcgaagcccgtgatcgacttgggcgatgatttcgagactgactttcaggagttcaaagatgaagaatctgatatagatgattatgatgttgatgatgttttggctgatgtaaagccctttgcttttaacgctacaaagaaacctgcttctgctgtatctcatggttcgaactctgaaaaatccatgcaattcaatggtcaagctgagaaatgtgcgaaaagaaagaggaagaaccagtatcgtggaatcccgcagcgcccatggngtaaatgggcttgtgagat

SEQ ID NO: 2044 - DNA, 248 bp, Gossypium hirsutum
  unsure (1)..(248): unsure at all n locations
  Clone ID: uC-gsronu33B079h08b1
gtttnctttcgccgttagtaaaagcttggaagaagactgaggtggtgtaaaaaatgggtttcaagcgaggtggaaaggtggccgtcccagccaagaagaaacaagagaaggttgtcaatccattgtttgagaagcgtncaaagcagtttggtattggaggggctctacctccaaagaaggatttgcatcggtttgtgaagtggccaaaggttgtccgcattcaaaggaaaaagagaatccttaagcag

SEQ ID NO: 2045 - DNA, 109 bp, Gossypium hirsutum
  unsure (1)..(109): unsure at all n locations
  Clone ID: uC-gsronu33B079h10b1
cccacgctgnccggctctagatcgcgagtggccgccctggggttcattttaaaagtcttttttggtgttttttgaccagcaacaccaaaaggcaaccgacaggcaccac

SEQ ID NO: 2046 - DNA, 446 bp, Gossypium hirsutum
  unsure (1)..(446): unsure at all n locations
  Clone ID: uC-gsronu33B079h11b1
cccactgtttccgctctttctcgctctcccgctccgcagtagaccaacctgccgtcactatgagcagatcaggccagcctccagatctcaaaaagtacatggacaagaaactccagatcaagctgaatgcaaatcggatggttgttggtactcttcgtgggtttgatcagtttatgaatctagtggttgacaacacagtagaggtgaatggcaatgagaaaactgacataggcatggtggtgatcagaggaaatagcgttgttactgttgaagcccttgaacctgttggcagaatgcagtgattctggtttttctattgatttatcactttgatgtatctcttcgctttgttgtttcaatggcatccctgctagtttgggattgggattgggatattttatgtaattgagaatttgtcggaagttagatgggtctncatggaatct

SEQ ID NO: 2047 - DNA, 472 bp, Gossypium hirsutum
  Clone ID: uC-gsronu33B079h12b1
aaaggattcttatgtaggtgatgaagcccagtcaaagagaggtatcctcactttaaagtaccctatcgaacatggcattgtcagcaattgggatgacatggagaagatttggcaccatactttctacaatgagcttcgtgttgcccctgaagagcatccagtacttcttacagaagcaccactcaaccctaaggcgaatagggagaagatgacccagattatgtttgaaacattcaattctccggctatgtatgttgctattcaggcagttctttcactttatgccagtggacgaacaacaggtattgtcttggactctggtgatggtgtgagccacactgtgccaatttatgaaggctatgccctcccccatgctattcttcgtttggaccttgctggacgtgatcttacagattccttgatgaagatcttgactgagagagggtactctttcacaacaactgcagagcga

SEQ ID NO: 2048 - DNA, 503 bp, Gossypium hirsutum
  Clone ID: uC-gsronu33B080a02b1
ccttatcagagctcgggtactctcatcttcagccggaggcatggtgaacgtacctaagaggaagaagacctactgcaagagcaaggagtgcaggaagcacactttgcacaaggttacacagtacaagaagggcaaagatagtttggctgctcaagggaagcgccgttacgatcgcaaacaatcaggttatggtggtcagaccaaaccagtgttccacaagaaggccaagaccaccaagaagattgtgctgaggctgcaatgccagggttgcaagcatgtatcccaacatccaatcaagaggtgcaagcattttgaaattggtggcgacaagaaggggaagggaacatctcttttctaaatggtgtttatttatttcatgtcatgtcatgttgttgggaaccttttaagacagtatggaatttttgtttttctaatgtaatgttttccgagggatatggtgttctttaagcacttaatagttaatggcatcggttgatctcatt

SEQ ID NO: 2049 - DNA, 581 bp, Gossypium hirsutum
  unsure (1)..(581): unsure at all n locations
  Clone ID: uC-gsronu33B080a04b1
cccacgcttcctgcccacgcgtccgaaaaaaaaaaaaaggaggattaaaaaaaaaaataccggaaaaaaacccccacacncaaaaaaacaaacaaacaacaccaaacaaaaacacagtccaaaaacgggcgcaccccccagatcaccctcccctggcccccccccctgaacccccaaaacctcccaagaaaaaccaacccaacccccatttaccaacaaccgccctaaacaccaaccaacccgacagggccacaaaacccccaaactgaacaacacccccgcctccccaccaagaaacccatcccaaaaaacacaaaaccaccccccacgggcaacgcttcccaaaccccaaaccccccaaatggcccaccccacaaccccccccattccaacacaccagcccccgcccttcccaacgatacaaaacaccccccccacggacccttttgaaacacctcacccccaccacccccaatatgctatatccccctcacccccattaccaccgcttaccatccccccccccccccagcattccccccataaaccaaaaagcaccccccccccgcaacccccaaaaa

SEQ ID NO: 2050 - DNA, 356 bp, Gossypium hirsutum
  unsure (1)..(356): unsure at all n locations
  Clone ID: uC-gsronu33B080a06b1
gctattttttatcttcaatttccttagaccataaacaggcgtttggaataataacattggtcttctttttgtattatgatgcaagttaaattgcttaccatctctgcattttcctattccaattgagtctcatcttcagattctgatgcttaaaaccatctgcttagtctgaatggttttgaaatttgcaagcagagatggtttgcattttatccggaagaaatttcttttgttttttttcttttagaaaaaaaaaatgaacatagcaatgcagagtccttagcattnaaagaattacaaaaaaaaaaaaaaaataaaattaaaaaggaaacacccccttaaacagcccataaacg

SEQ ID NO: 2051 - DNA, 497 bp, Gossypium hirsutum
  unsure (1)..(497): unsure at all n locations
  Clone ID: uC-gsronu33B080a07b1
cttcttatacccagaaatgaaggcttctcagngctttggagtgtctctataacttcttatgggtgcttaacacatgcccttggctgatttcagcaaatccccatctcaataattttcttgcgcgcctcgattcgttttattccaatgacatctctaaggtaatctacacccaaaatcaagcctctcatgcatctgtattgaacgctaccactcaaaacccaagatggtcaacaccacccacaccatagccctgaggctgcgatgccacggttgaaacttctcatattcaagcaacaatccgaggttcaagaacaaatggcctgaatcttccaatacggagaggggaacatcgcttttctaaagcggcgataattatttcatggcccgtcatgttgttgggaacctttcaagacagtatggaatttttggttttctaatgtaacgttttccgagggatatggtggtcctttaagcacttaatagctaatggcctccct

SEQ ID NO: 2052 - DNA, 182 bp, Gossypium hirsutum
  Clone ID: uC-gsronu33B080a09b1
cccacgcttccggctctagatcgcgagcggccccctgtcgctgttttttagaacgctgtgcccgtcatccaagcgcttcccctcccctgcgtgctcatcggcgaccgtcggaaaccaggggctgttgcggatatctcggaagccccaggcgtgacaaagagggacttgctggagcgcacgtt

SEQ ID NO: 2053 - DNA, 533 bp, Gossypium hirsutum
  Clone ID: uC-gsronu33B080a10b1
caaagaaacgcaagatttgtagattcgaggtggattgtctatccacctgcggtcaatggctttgccgaaccagcaaacagttgattatccaagcttcaagctcgttatcgtcggcgatggaggaactggaaaaactaccttcgtgaagaggcatctaactggagagtttgaaaagaaatacgagccaaccattggtgtggaggttcatcccttggacttcttcactaactgtggcaaaatccgtttctactgctgggatactgctggacaggagaagttcggtggtctcagagatggttactatatccatgggcaatgcgccataattatgtttgatgtaactgcccggttgacatacaagaatgttccaacatggcatcgggatctttgcagagtgtgtgagaatattcctattgttctatgtggaaacaaggctgatgtaaagaacaggcaggtcaaggcaagcaagtcacattccacaggaagaagaatctgcaatactatgaaatttccgccaagagaactacaatttc

SEQ ID NO: 2054 - DNA, 532 bp, Gossypium hirsutum
  unsure (1)..(532): unsure at all n locations
  Clone ID: uC-gsronu33B080b01b1
atnnataagaagaatgggaaatctgcttctattcaatacggttctggagctatttctggtttctttagtaatgacaatgttaaagtcggcaacttggttgtgaaagatcaggaatttatagaggctactaaggagccaggtgttacatttatggcggccaaatttgatgggatattaggacttgggtttaaggagatttcagttggggatgctgtcccagtgtggtacaacatggtcaaacaaggtcttatcaaagaccaggaattttcattttggcttaatcgcaatgtaggagaagaaatgggtggtgaaattgtgtttggtggggttgatccaaaccactacaagggcaagcacacatacgttcctataacacaaaaaggctattggcagtttgacatgggtgatgttcttattggtgacaaaccaactggatattgtgctggtggttgtgcagcaattgcagattctggaacttccctgctggcaggtcctacgactgtgattaccatgataaaccaagcaattggag

SEQ ID NO: 2055 - DNA, 187 bp, Gossypium hirsutum
  Clone ID: uC-gsronu33B080b02b1
gaattaaaacatgggcagaagctgtatggagtagccgtcttatagacactcactgatgtattggacatctcagagccttcaagtaaggtgccagttatagatgcacgaatcagccgagtgcttgagatcatcttgtgtttcttcaaacgccgcatttaatgatgctttgtttctgcacctgacaaat

SEQ ID NO: 2056 - DNA, 165 bp, Gossypium hirsutum
  unsure (1)..(165): unsure at all n locations
  Clone ID: uC-gsronu33B080b04b1
gccggactcacactctatagaaaaaaaaaaggccnatnncgtaacatatttaaacatgtatgtgctgcaccacacacnacgcaaaagaaggaattgatccgtgttcttaatggcatctagaaacatatcactgcccaagaaacatcacatatgacaacgctgatc

SEQ ID NO: 2057 - DNA, 468 bp, Gossypium hirsutum
  Clone ID: uC-gsronu33B080b05b1
gcacattattgttttgatgcaaacttcacagaacagatcagcgagaacatttatggattactcttccgtaactcaagccatggatggtatatgtggactatatgaaaggaaacttaaggagctaaatccagcaacaagaaacatcacatatgacattgctgatctttacaattttattgatggccttgcagatatgagtgcccttgtctatgatcacagtattcaagcatatttgccttatgacaggcaatggattaaacagaaagtgtttcaacaccttaaaaagttggcacattaaacctttttcagtaaaagagaatttgattagggaaaaaacatgtaccaagtgcagaagacctcatgtgataattgtgctgttggttccctcactttttagaaccattgcagctttctccagggtttccataaatagaatgttgtaatataagcaaaaatacaaattatgga

SEQ ID NO: 2058 - DNA, 237 bp, Gossypium hirsutum
  Clone ID: uC-gsronu33B080b07b1
cttttatttgcctctttggatgagatcaagtcatcgttgttaacttattaagcgatttgttctaataaagagagagtacaagtgatgcccgtaatagccagtgatcgtgaatcactaattgttcttggacttggaggcgagtatgtggggatgttttcgtctaacttgtgggattttaggacttgcgtttacggagattttagttgtggatgctgtccccagtgtggttcatcatgg

SEQ ID NO: 2059 - DNA, 78 bp, Gossypium hirsutum
  Clone ID: uC-gsronu33B080b09b1
aaaataatattaaaaaaaaaaaaaaaaaaaaaaaaacgggcgatattataaaaaacacattttgtgtcttacacacac

SEQ ID NO: 2060 - DNA, 319 bp, Gossypium hirsutum
  Clone ID: uC-gsronu33B080b10b1
aacttatcaatttctgttaaaattaaattattgatggtgcaataaaatattcatgttaaaattttcaaaaaaaaaaaaaaaaaaaaaaaaaaaaaaaaaaaaaaaaaaaaaaaaaaaaaaaaataaaaaagcaggaaacattacaaatgccaaggctgctatcacaagattacaagatggtctctcagatataagtgcccctaattataaatacagggttgaagcatataagccttaagaacaggaaatcgattaaacagaaagtgttaaaacaccttaaaaagatggcacattaaacctttgtcaacaaaagaaaaat

SEQ ID NO: 2061 - DNA, 527 bp, Gossypium hirsutum
  unsure (1)..(527): unsure at all n locations
  Clone ID: uC-gsronu33B080b12b1
ggatcaagaccggggttggggtcgggaccgtgagggggatttagatagaagttgggatcgggatcgggatcgggattgggatcgtaatagagaaagaaacagagagagagagagggagagggagcaaagacatgattatgatagaaggtcaaggtacgctgatgaaagtaggcgatacaggagcagaagccgaagtccgagtgtgagcagaaacaggagcagaagtcagagtgagcaaggtgggaacagtcattatgatcgacttccaagtccatcaaaagagggaagcaaggcatccagtaatttggcgaagctgaaagatctgtacggtgatgtaagtgatacaaagggagatgatgctgggttcgaaaggatagcaaagagggacaacagtggtgaagaggtgattagactaggtggttctttttggaaataatagggtggttggttgcattgnagagcatcaattcaatttatgaccagacccaaatacatgacaaactatgtcaacattttattctccctgt

SEQ ID NO: 2062 - DNA, 563 bp, Gossypium hirsutum
  Clone ID: uC-gsronu33B080c01b1
tcatgcttccggtcatggtctttggagagattaccaccaaatccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactttacaaagcgtccagaagagattggagccggtgaccagggtcatatgtttggttatgccactgatgaaacccctgaattcatgcctcttagccatgtccttgcaactaagctcggtgcacgtcttactgatgttaggaagaatggcacctgcccctggctaaggcctgatggtaaaacccaggtcactgttgagtactacaatgacaatggtgccatggttccagttcgtgtgcacactgtcctcatctccacccaacatgatgagactgttacaaacgatgaaatcgctgctgacctcaaggagcatgtcatcaagcctgtcatccctgagaagtaccttgatgagaagacaatcttccaccttaaccca

SEQ ID NO: 2063 - DNA, 441 bp, Gossypium hirsutum
  unsure (1)..(441): unsure at all n locations
  Clone ID: uC-gsronu33B080c05b1
ttttatcttttaacgcttcattagaaagaaatttcttggtactctcaaggaacgcgagaggcttctcgaagacatggaaaacaagatcacttatctgcagtctgttatatccactcttaaagatgattcattacttgctaatgaaaagcttaaggctctacaagaggaggtatgtttgctttgggatgcttcgagaaaaacaactttgaacttcatgttttggaatcggaagcacaggacactgaagatagggtggaagctgttaatttaaaagttaaaaaggtttgatggtcagaggatgctgatggtgattgggactgtgtgcaaactttaggtgaatctagcaggtactaagcctagaactctttctatttggtctgtttcaattcattntcttggtcattggattggctgatatgtacttttatatgtacctattaa

SEQ ID NO: 2064 - DNA, 290 bp, Gossypium hirsutum
  unsure (1)..(290): unsure at all n locations
  Clone ID: uC-gsronu33B080c07b1
cccacgctgccgcccacgcgtccgcccacgcgtccnggggctaattgatcgaaggtttgctcagaatccacagatagtggagaccttaagagaaaacaatctgaaatggattctgaaccacataaatcacgaaaaagagatcatggagaccaatcgtcaccaagcactagtaaagcctccaagaagcactcaaagcgtgagaagctggattgaaatgcactcaggcgaccaaagcctgctaggcgagcatagctgggaaatggttttaacatatatgaagggcgtaacat

SEQ ID NO: 2065 - DNA, 569 bp, Gossypium hirsutum
  unsure (1)..(569): unsure at all n locations
  Clone ID: uC-gsronu33B080c08b1
ataatgatggcttgaatctgtcagcaccccaaaccttgcgttccaatggagatctcattgagcaatgttgctgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttccatcctgtggctacaatcctcagttacctcaccaaagcccctcttgttccaccaggcacaccggtggtgaacgcactgtccaagcagcgtgcaatgctggagaacatactaagggccagcattggcttggctccttgaaacaacatgattttggaaatacaagtgaaaagttgagagaaaagtggacaaagctntgttcttagactttaggaccattt

SEQ ID NO: 2066 - DNA, 544 bp, Gossypium hirsutum
  Clone ID: uC-gsronu33B080c10b1
tcctcgcgtccgatgaacttgacactgttctaggacctggttaccagatcactgaacctgacacccacaaacttccctaccttcaggctgtgatcaaggagactttgaggttacgaatggcaattcctctactcgtgccccacatgaacctgcatgatgcgaaattgggtggctatgatatccctgctgagagcaaaatcttggtaaatgcatggtggcttgccaacaaccctgctaactggaaaaatcccgaagaatttaggcctgaaaggttctttgaagaggaagccaaggttgaggccaacggcaatgatttccgctacctcccctttggcgtggggagaagaagttgcccaggaattattcttgcattgcccatccttggtattactttgggtcgtttggtacagaattttgagctcttgcctccccctgggcaatctcaaattgataccacggagaaaggtggacagttcagtcttcatattttgaagcattccaccattgttgctaagccaaggcaattttaacttggtctcttcta

SEQ ID NO: 2067 - DNA, 197 bp, Gossypium hirsutum
  Clone ID: uC-gsronu33B080c11b1
ccctgcttccgcccacgcgtccggggaatatgaagggaaattgttatggaacttgttctgattaccctgacgatcctcttacatacttcaagtctgccttaaaactcaggcttggcataaaaacaattgtgagatttggacgtcagacaagttggacggtgaagcaagatgcagagtatgtacttcatgtattaaaa

SEQ ID NO: 2068 - DNA, 574 bp, Gossypium hirsutum
  Clone ID: uC-gsronu33B080d04b1
cttactcgtccggcaatatgcagtaaatgtaaagggaaaggttcaaagagtggagcctcctctagatgctatggttgccagggcacaggaatgaaaattacaacacggcagattggactgggcatgatccaacagatgcagcatgtttgtcctgaatgcagaggctcaggtgagatgatcagtgatcgggatagatgcccacagtgcaaagggaacaaggttactcaggaaaagaaggtgctggaagtacatattgagaaaggaatgagagatggtcagaaaattacatttgagggacaagctgatgaggctccagatacaataactggagacattgtttttgtattggaacaaaagaaacaccccaaatttgataggagatttggggacgaactttatgttgaccacaaactcagtttgacagaggctctatgtgggtttcagtttgccctaactcaccttgatggcaggcagctcttaattaaatcaaacccttgcgaggtcgttaagcctggtcaatacaaggctatcaatgatgagggtatgccccaccatcagagacctttcatgaagg

SEQ ID NO: 2069 - DNA, 547 bp, Gossypium hirsutum
  unsure (1)..(547): unsure at all n locations
  Clone ID: uC-gsronu33B080d05b1
anttttnccaagttgtagagaaataggaatggttcagggaagattcagagcagtggcagccacagtgctgctctgctgcttgttgctccactttgaggtggctcaatcagcaagtttcactgttggaggaagaggtgggtggacctttaacgccgctgcttggccaaaaggcaagccctttaaggcgggtgacactctcgtgttcaattacaacccttcaatccacaatgtggtagctgtgaacagagcaggatacaaatcatgcaaagcaccaaaaggtgctaaagttttcaagtcaggcaaggatcagatcaagcttaaaaagggccaaaactttttcatctgcaattacattggccattgccaagcaggaatgaaaatagcagtcactgctgcctaatccgagattaggcattgccatatgatatcttcagtttgctttaaagtattaatgtaagatttggtgtcacaaagtctactctagtgttagacttgcttgctttgagtgggtaggtggtgctccaaacactaaatctatactataata

SEQ ID NO: 2070 - DNA, 598 bp, Gossypium hirsutum
  unsure (1)..(598): unsure at all n locations
  Clone ID: uC-gsronu33B080d06b1
tccatgcttccgcccacgcgtccgcggacgcgtgggggctttatttgaaggttctctggtagtttttgattttttgggtgtttgttaaaatctgtatacaattttaccttagaaatttgagagggaaagtgatattgtatcagtggctaagttaaaggaatacgtgatgggagaggaggaagccaataaaatggaagcctctgaacccaaggaggacatgcagcagcagcagcaacagccacagcctgttaaggaagaagagatggagaatgaagatgaagcaggtgcagagaagaagagtgtgatcatccctcttcctcaaaaagttgcagcagcagaaacaccaccatcagttacagagaaaagtccaaacaacagagattccgtgcttgctcaagttgagacagaaaaaagactagctttagttaaagcatgggaggaaaatgagaaggcaaaaatagacaacanggcatataagaagatatctgctatnggatcatgggagaataccaagaaatctgctgtagaagcgcagctaaagagcattgaggaaaaacttggaaaagaagaaggaagaatatgcagagaaaatgaaaaa

SEQ ID NO: 2071 - DNA, 582 bp, Gossypium hirsutum
  unsure (1)..(582): unsure at all n locations
  Clone ID: uC-gsronu33B080d07b1
cccacgtgntcgggcccaccgaactgaacctcctctcgagaggctttttctacctttttcacaccccccccccccaatatggcgatttcggcgctccaaaaactcacctcccaaatccaccgtctcccatatctctcctcccaaatcctcacccgatcctccgccaccttaacctcctccccctcctcttccaaaaaagttgctgatcggctcgtcaagctcttcgccatcgaccctgaaggccagaagcgtgaggttgtcggcctcgctggccagaccttacttcgtgccttgactaacagcggcctgatcgaccccgactctcaccgcctcgaggagatcgacgcttgctccgccgaatgcgaggtcaacattgcccaggagtggctcgagaagcttccgccgcgtacctatgatgaggagtatgtgttggtgaggaattcgaggggtcgcatcttgaacaagcattccaggcttggatgtcaggtcgtgcttacgccttagctccaaggtatggtcgtcgccgcccccgaggctagccgtgggatattccataaatattngtaggggaaaaagagatga

SEQ ID NO: 2072 - DNA, 522 bp, Gossypium hirsutum
  unsure (1)..(522): unsure at all n locations
  Clone ID: uC-gsronu33B080d08b1
cccacgtgntcgggcattcaaattactcaatgagagcccagcagttcagtctgttgttgcttccattgcttctgatccaaatgtatggaatgctgtcctgaacaattcagcttatatggatttcattaaatcccagcagacaaatgataagtttgaatttccgggatctccccgaagttctgtatcttcagtgaagcttgaggaaaatgaagatagtggagattcattttcggcttttatacagaaaatcaagactagtgtggtcgagatggtgagtaaaacgactgatttcctccatagtctctttagtttacccttggcggacaaggctaaagaaaatgctggatcgaacaatatggataagacaattggagctagcttgatgggattggcagtgatggttattatggttgttcttttgaaacgagtgtagcaccctattttaaagtaaatttgccgatattacaaactcaaaaacacttgcttgtttggttactcatggatgataatgatgatcaatat

SEQ ID NO: 2073 - DNA, 352 bp, Gossypium hirsutum
  unsure (1)..(352): unsure at all n locations
  Clone ID: uC-gsronu33B080d10b1
gattacttcaactatatgatgtggaactgttgtagtgagagcactataacagtgtattagcatgaacagataaaggggaactctcttggcagtgtctaacaccanaaaaaaaaaaaaaaaaaaaaaaaaaaaaaaaaaaaaaaaaaaaaaaaaaaaaaaaaaataaaacaaaaaaaaaaataaaaaaaaaaaataaaaaaaaaaaaaaaaaaaaaaaaaaaaaaaataaaagggggggccgttttaaagaaaaaaagtttacaaaccggggaaagcaaagaaaaagtttttttatggggccccaaaaaagaaacacatggccgctaaaaaaaaacggcgtgacgggaaaaac

SEQ ID NO: 2074 - DNA, 549 bp, Gossypium hirsutum
  Clone ID: uC-gsronu33B080d12b1
ttttctatgacatcacaagcactacattttaccgaatgctgtcagcaagaaggtacattttagtccccagttacagactgatcctaggcaaaattatctccatgctaaatctcgtcttcagccttcagatactcctgcatcaaaaactctttcttggcacttatcctcagaaaccaagtctactttgaaagggacttcacaaactttagcaagcaatgaaatctcaaaacctcctgcgcccgcttctgaggttttccagttagtggagaatggagacaatgcaagggcaaagtcttcagcagcactttttcctgcttctaatgcacttgtcccatcactgggtatcacacatagggagttggagggttccaaacctttgacagcattcaggtcatttgataacccaaagcgcgacattatacgtgcacctgttaggagcaaaagtgtgctgtcatctttctttgtcaaacaaaaacaaatgaagctaaaggctggatatgttgcatgaatctcctaaaacaaacttacgacaacgatgatgccacacta

SEQ ID NO: 2075 - DNA, 447 bp, Gossypium hirsutum
  unsure (1)..(447): unsure at all n locations
  Clone ID: uC-gsronu33B080e01b1
gnattttggttagtaaggcagttaaaaagatccgcgggatgttcattaggtccacgtggtacctcttcctggaggagatccgggatgaagctagtacccgaatcatcggattccggccatttccggttnttgttcgtggaactagtggggaacagtccggctgtgttcgaatacaattcagagaccgaaaaatggcagtgcagagaagcaagagaggggaaggggaacttcgcagggaatgattgtatgtttctcaatgcacataatgcacctcaggagagtttggtggttgcgattggatctgaatacatcccaccaaagatcctacgaccaagattcggaaacagagagcagcaggcaagctgggtgaacgtaaatgaccgaagacacgtgtatggtgacggacacgtgatgataatgagatcgcgggatcaaaggagggcaaag

SEQ ID NO: 2076 - DNA, 432 bp, Gossypium hirsutum
  Clone ID: uC-gsronu33B080e02b1
gtaagtgcttaaccaagagcggaatgccacacgctcgggggatttgaaagacacttgtactgattcatcctgccaatgatgaccctcatcagacctccagcagcgcagacaaaacattggacctagagctgggagctgcgcacagacaaacatgcctgatatgcatgataactatagcagcccttgggatcagcttgtacggtgtcgaactgtatccaggatcaaatctgaaaataatggttaccattcttagacaaacgagtcaacttatgcttcagatcaggtgcagactatagaaagctctagtgagccttcattagcgggtcctgccctcataatgaatgagaagagagaaaagctacattaccagcaacaaaaactagccccactgaaaaagaaggtcaaacatgcaaaagtgggtagtaagatggc

SEQ ID NO: 2077 - DNA, 578 bp, Gossypium hirsutum
  Clone ID: uC-gsronu33B080e05b1
gtaatggagaggaagaaacccaccgattccaactggaactctaagttgaacatagccatcatacacccagatcttggcataggtggagctgagagattgattgttgatgcggctgttgaattggcatcccatgggcacaatgttcatattttcacagctcatcatgataaaaatcgatgctttgaggaaacccgtgccggtatctttccggttactgtgtacggagacttcctgcctcgacatattttctatcgccttcatgctgtatgtgcatatcttcgctgcatttttgttgcactttgtgtgctgttcatgtggccttcgttcgacgtcatactagcagaccaggtctctgttgtcgtcccattgttgaagcttaaacgatcaaccaaggttgtattctattgtcattttccggatcttttacttgctcaacatacaactttgttgcggaggatatatcgaaaacctattgatattatagaagaactgacaacaggaatggcagatatgatacttgttaatagccgatttactgcatctacctttgcaaaacatttaagcatctccatgcacga

SEQ ID NO: 2078 - DNA, 387 bp, Gossypium hirsutum
  Clone ID: uC-gsronu33B080e06b1
gcgtgggccgccctttttttttttttttttttgtggggtttttttataattttttgtggtttttccccctttttttttcaccaaaatcgagttgctggagggatggcaaataaaaaggaaaagggggggggagaggaagggaaggattcccgggaaagacccaaaccagtgtaagacaaagtccccccaattgaaccccaatgcggggaattaaagagagaaacctcattccttgttcagcaaaccgccaaaacccaaatcaaactggggcttatgttccccatattgaaagcaagggaaaccggtcccttggatgaagccgcccttttcactcaaatgcccccagaacctgtaagatttggggaggaggaaaaagaagggtgaggg

SEQ ID NO: 2079 - DNA, 332 bp, Gossypium hirsutum
  Clone ID: uC-gsronu33B080e08b1
atgaattgtagttcactgaagctgaaagcaacatgaaggaggcggtttagagtatcaacaataccaggatgctactgctgaagacgaagagtatgaagaatacgaggagtacgaggaagaagcttaaagcttgttccttgttcttttctttttatttataatggtaggatatatttggttggttttgttatgcttttgtgcatgtgaagcctgttggtgcaatgtcggcattgccgggtgcttcgatgaggatcactttagtgttaattttctgttgttctaccagactacttgtatcgctgcattgttttttatgaataatcttagcagcc

SEQ ID NO: 2080 - DNA, 488 bp, Gossypium hirsutum
  Clone ID: uC-gsronu33B080e09b1
tgaggttttgtcttgaagaaaaggaaagggaagctgggctgaagttgcaaaaagctcaggagcttggaaaagcagaactagctgcagcgattgcaaacgagaaagcagcacagattgaaaaattggcagaagcaaatcttaatataaatgccttatgtatggcattttatgcacgatctgaagaggcgcacaaaagtcattctgttcacaagctagctctgggagcacttgctctagaggatgcgctttctaaaggattaccaatccaaaaagaaatagatgctctgcgcacctaccttgaaggtattgaaaaggattcagtgttggatttggttctttcgtctcttccagaagaaacacggtaccatggtaccaacactgtactacagttgaatcaaaagttcaatgcattgaaagggaccctaaggcacttcagcctaattccaccaggtggtggtggcatcttgacacattgtttagcacatatt

SEQ ID NO: 2081 - DNA, 527 bp, Gossypium hirsutum
  unsure (1)..(527): unsure at all n locations
  Clone ID: uC-gsronu33B080e10b1
cccatgcttccgcttttctcatgaaggccggaaaagctttgcatcgtaagcgggcggagatcagagttcagttcagacacgttccaggtaatttgtacaagcgtaattttggaactgatttggacaaggctacaaatgagcttgtgctgcgtgtgcaacctgatgaagccatttatctgaagatcaataacaaagttcctggtcttggaatgagattagaccgcagtgaccttaatttgctttatcgagccaggtatccaacagaaatcccagatgcatatgagaggttgctcttagatgctatagcaggggagcgaaggttgttcattagaagcgatgagctcgacgctgcttggtcactgtttacgccgttgttgaaagaacttgaagcaaaaaagatttctccagaactatacccttatgggagcagaggacccgtcggagcacattatcttgcagccaagtacaatgttcggtggngtgatgtcgggggtgaagacgactaatgctccaaagtatcaaacaat

SEQ ID NO: 2082 - DNA, 534 bp, Gossypium hirsutum
  unsure (1)..(534): unsure at all n locations
  Clone ID: uC-gsronu33B080e11b1
cccacgcttccgcccacgcgtccgcccacgcgtccgggagatcaatggaggggaatgaagaagatgttagattgggagccaacaagttcccagagaggcaacctattgggacagcagctcagtcccaagatgataaggattacactgagccaccaccagcacccttgtttgagcctagtgagttgacctcatggtctttttaccgagccggaatcgctgagttcgttgctactttccttttcttgtatatctcggtattgactgtgatgggagttgttaaggacaaaaccaagtgtacaactgttgggattcaagggattgcttgggcttttggtggtatgatctttgcacttgtttactgcactgctggtatctcaggtggtcatatcaatccagcggtgacatttgggctgttcttgggtaggaaattgtcgttgacaagggcaatatactacatggtgatgcagtgcttgggagccatatgtggngctggtgtagttaaagggttcatggggaagacaggtatggtgcttt

SEQ ID NO: 2083 - DNA, 483 bp, Gossypium hirsutum
  Clone ID: uC-gsronu33B080e12b1
cgctgcacttttcacaccttcttcacttcagcagagaaaacagaggcaggcagccatggcaaggatcaaggtgcacgagttaaggaacaaatcaaagacagagctgttgagtcagctcaaggatttaaaagccgaactttctctccttcgtgttgccaaggtcactggtggtgcccccaataagctctccaagattaaggtggtgaggctatccattgcacaagtattgacggtgatatcccaaaaacagaaggctgctttgagggaagcttataagaacaagaagtttttgcctcttgatctccgtcccaagaagaccagagctattcgccgccgccttaccaagcaccagcaatctttgaaaaccgagcgggagaaaaagaaggagatgtactttccgatgaggaagtatgccattaaggtataagcttgaaatttgacttaggatggatacctttatgttagtttcaaagtgactactcg

SEQ ID NO: 2084 - DNA, 168 bp, Gossypium hirsutum
  Clone ID: uC-gsronu33B080f05b1
ccctgcgtccgtttttttattaggatgtcttatattggtgattaatgcagtgacttaggttatttttccggaagaacctaccttgcaggccctaaatattgacaataaccgaatttaagggcttcatgataaaccttacaaagttaaatcagagccctttcgagttgg

SEQ ID NO: 2085 - DNA, 574 bp, Gossypium hirsutum
  Clone ID: uC-gsronu33B080f06b1
ctttttttaaaatttaaggctttttttttcttttaatggatctcaatagttcaaagcaatatccacccgtatcaatggcggagcaagcggtgggaaagccacttaacagttcatctgagtctgaaaatggtggaatattggagaaaaccccgccactccaggaccagaaagttgatgagaatattcaagaagattcaggcaaagatttgaaaaaaacgtgcacccctgataggcttaaagtccccaaggcattcaagttccctgaaaggtatagaagtccaaccgattctatgatgtcgcctgttacaaaaggtcttcttgcaagaaacaggaaagctggaggttcactcttaccacctagtataaatcaaactaagatccatgaattgcgtgttcaagatgttggtctttctcacaactgaacaagctaaaaccagatggatttgtctgaaatgaaatggtgttaatgtcgatataaattacaagcaaaaagaatgctgtttatgggatgtaatctctcttttttttggatgcgaatcttgtctaataatacatattttggtagctgataatc

SEQ ID NO: 2086 - DNA, 467 bp, Gossypium hirsutum
  Clone ID: uC-gsronu33B080f07b1
cccacgctggctgcccccacattcctggtaccgatgtaggaggagatgttttacaagttggatcagaagtccagagtttcaaagttggggagaacgttgttgccgtacttggtaatggaggtgcactagctgaatatgctgtggctaatgaaggttccacagtttcaaggcctccagaggtatcagcccgtgaagctgcagctttgccaattgctggcctcgcagctcaccagtcactcacccagcttgctgggatcaaactcgatggaaccggcccagaagtgaatgtattggttaccgctgcttcaggtggtgtaggtcaatatgccgttcaactcctaaagctcgctaatgcacacattacagccacttgtggggctcgtaacatagatttagtcaggagccttggggctgatgaggttcttgactacaaaactcctgatggggtggctctcaagagcccttct

SEQ ID NO: 2087 - DNA, 473 bp, Gossypium hirsutum
  Clone ID: uC-gsronu33B080f09b1
cccacttctttcggcattaccatcaagcctcaaaccgataggtgggtcttccctgaaaccaacaccggcatcattgtgttggctgaaggacgtctcatgaacttgggttgtgctactggccaccctagctttgtcatgtcatgctcgttcactaaccaggtgatcgcccagctggagctgtggaaggagaaggcaacaggcaagtacgagaagaaggtgtacgttttgcctaagcaccttgatgagaaggtggctgctcttcaccttggaaagcttggggctaacctcaccaagctcaccaaggatcaagctgactacattagcgtccccattgagggtccttacaagccccctcactacaggtactgaggagagaatacgagagagggagagagagtgagagagagagagggagagagttggactagaaaaaggaaccatacaacgggatggtttggttttactaaaattta

SEQ ID NO: 2088 - DNA, 544 bp, Gossypium hirsutum
  Clone ID: uC-gsronu33B080f10b1
atcaatttgtatgttaagctactgtacaagcgacacaaaagcactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctatggcgttcttgacaggtttgccgccatgggtattgacaccccttgagtcgttgccctcctaggagctcacagtgtcggcagaactcactgtgtgaagctggtgcatcgtttgacccaagagttgcccctgccctaaccccgacatgtccacacatactcat

SEQ ID NO: 2089 - DNA, 476 bp, Gossypium hirsutum
  unsure (1)..(476): unsure at all n locations
  Clone ID: uC-gsronu33B080f11b1
cccacttgttcgcccacgcgtccgcgatgatcgaatctttgaatcagataattatgggaagttttccacttcatcatcatcatcatcttccatggttgctccttctgctagtgctaagattattttatcaaccggagttcaatctcctgctgtctgtcgtttgactcctcgccgcgtcgttacatgaaaccatcgcatgcttatgggttaatctagggtctgggaatttcatgtatgtagaaaatatatatgtatttctgtttacgttaatcattatgtatgggtacttaataagcgtatgaaaaaacccaaagggggaagcatacgctcaaatgttatgggtgtagggaggccaaagggatgaccctatngccttgtgtattggacatagatggtaaatgtggagagatgattttattaatgttgaaggccacagggcttctatttgaatgttattggtaatcgacggcggaacc

SEQ ID NO: 2090 - DNA, 529 bp, Gossypium hirsutum
  unsure (1)..(529): unsure at all n locations
  Clone ID: uC-gsronu33B080g02b1
tcctgacaccagtccagagtttctatcaggaagaatggctgtccctttgctgtcaaagaagattgtgaagaagcgtgttaagaagttcaagagaccacaaagtgaccgcaagatctccgtcaagacaaactggcgaaggcccaagggtattgactctcgtgttaggaggaagttcaagggatgcactttgatgcccaacatcggttatggctcagacaagaagactcgccactatcttcccaacgggtttaagaaattcgtcgtgcacaatgtccaagagctagaacttctcatgatgcacaacaggacatactgtgctgagatagcacatgatgtttcgacgaagaagaggaaggaaattgttgagcgagcggctcagttggatgttgtcgttaccaacaaattggctaggttgcgcagccaggaggacgagtgaaggtcggttcttgaaatgttgatttgtcttnttaatatgatattttcttttctaggaagtaagactttttgtcctatgtttggagtgtatttt

SEQ ID NO: 2091 - DNA, 406 bp, Gossypium hirsutum
  unsure (1)..(406): unsure at all n locations
  Clone ID: uC-gsronu33B080g03b1
agactantcatggcgaacgccggtcccggaacgaatggatctcagttctttatttgtaccgctaagaccgagtggctcgatgggatgcatgtggtgtttggtcaagttgttgaaggtatggatgtggttaaagccattgaaaaagttgggtctagcagtggaaggactgctaagcctgtcgttattgcagattgtggacagctttgttaagaacaagaacaagaacaagaaatggaataatgttgactctggtctatgaatggtgattcatgtctgaaatttatcatttttatgtgttttcttttgctggttactggatttggcttaggttgttctctaagaacatgactgccataaataatgtacgctatttatcatcatatttgaccatataattgagttatta

SEQ ID NO: 2092 - DNA, 446 bp, Gossypium hirsutum
  Clone ID: uC-gsronu33B080g04b1
ctttcttgtccgcccacgcgtgcgcccacgcgtccgggtgcttccaacactgttgcatccgctgctcttcttcttaccttgaacttgttgttcttcactctggttagctctacctacgtgccttgcccaccaccaccaaagagccacaagcctacccacacgagcccaccctcggcacctaaacagccagccacttgccccaaagatacactgaaactaggtgtttgtgctgatttgttggtctcggtgcgcgttgttgttggaccgtcgaggaccaaatgctgctcactcatttcgggttcggctgatctcgatgctgctgtttgcctttgcactgctattaaagctaatgtgttgcgggttaacctaaacgttcctgtttcattgtctttgctcctcaattcctgacgaaagcaaatgcctgctggttacacatgtgcttaagc

SEQ ID NO: 2093 - DNA, 65 bp, Gossypium hirsutum
  Clone ID: uC-gsronu33B080g05b1
atttttataaaaaaaaaaaaaaaaaaaaaaaaaaaaagagaaaaattaaaaaaaaaaatagatag

SEQ ID NO: 2094 - DNA, 449 bp, Gossypium hirsutum
  Clone ID: uC-gsronu33B080g08b1
gcgatgggtgactagaaaaggaagacaacgatggtgtctttgaagttacagaagcggctcgccgctagcgtcctgaagtgtggccgtggcaaggtttggcttgatcctaatgaaatcaatgaaatctccatggccaactccaggcagaatgttaggaaacttgttaaggatggttttgtcatccggaagcctaccaagattcactcccgatctcgtgcacgcagaatgaaagaggccaagagaaagggtcgtcattctggctatggtaagaggaagggtaccagggaggcaagattgcctacaaagatcctttggatgaggagaatgcgagtactaaggcgtttgcttcgtaagtacagggaatccaagaagattgacaagcacatgtaccatgacatgtacatgaaagtgaagggtaatgtatttaagaacaagcgtgtcttgatgga

SEQ ID NO: 2095 - DNA, 478 bp, Gossypium hirsutum
  Clone ID: uC-gsronu33B080g12b1
caacattaataaaaatctttccagtttctattttctaaaaacaaaactgaaaatgtcttgctgcggaggaaactgtggctgcagctctggttgcaagtgtggcaatggctgtggaggatgcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggttcttaattatgtgtaatgtgggcttttctgctatgtcagaatgtattatgatatttaagaaaagtttgttttcaattgaaagaatgg

SEQ ID NO: 2096 - DNA, 348 bp, Gossypium hirsutum
  Clone ID: uC-gsronu33B080h01b1
gtgatttcacattcccgctcccagcccctaattcccaatgcctaattcactttaccgatggcacccctaattccccttccaaatccctaatcactcattcacagagacgacacctccccccaccaatctaggttttatttttgtttctccgatccttcattggttttttttcctcaaaaagaagatttgtttcggtttcttatcaacattcatacgaagacggagaagacgaagaagaaaaagaacattcccattctgttttttggtcaagcttcaatcaggactcaagaatggctgggaaggcagcacaatctgtggtgaaggcagtgggagaataccaatatccat

SEQ ID NO: 2097 - DNA, 417 bp, Gossypium hirsutum
  unsure (1)..(417): unsure at all n locations
  Clone ID: uC-gsronu33B080h07b1
gtgatatcactttcccgctcccagcccctaattcccaaggcctggttcactttaccgattacaacccctaattccccttccaaatccctaatcactcattcacagagacgacacctnccccaccaatctaggttttatttttgtttcttcgattcttcatttgttttttttcctcaaaaagaagatttgtttcggtttcttatcaacattcatacgaagacggagaagacgaagaagaaaaagaacattcccattctgttttttggtcaagcttcaatcaggactcaagaatggctgggaaggcagcacaatctgtggtgaaggcagtgggagaataccaatatccatggcgtgaaaagttggcgaagtacaaagtagagttatcaaagggagtatggggctattgggaacttggag

SEQ ID NO: 2098 - DNA, 451 bp, Gossypium hirsutum
  unsure (1)..(451): unsure at all n locations
  Clone ID: uC-gsronu33B080h08b1
cccacgtggtcttaaaagtccagaattagggttccgatggcggcttttcttagcatattccctgcaactccgacatcttttgggtccctttgtccttcaattagatcacagcttttcgttcaaaatatattccccctgttattgttcttaatttcaagcaacaatggcggagcacttggcctcaatcttcggtacggagaaggaccgcgtgaattgccccttctatttcaagattggagcatgccggcacggggacaggtgttcacggctccacaaccggccgacgatctctccaactcttctnctttccaacatgtaccagcgcccggacatgatcactcccggagtggatgcccagggccagcccatcgatccccgcaagatccaagagcacttcgaggacttctacgaggacatcttcgaggagctgagcaagttttgtgagatcgag

SEQ ID NO: 2099 - DNA, 542 bp, Gossypium hirsutum
  unsure (1)..(542): unsure at all n locations
  Clone ID: uC-gsronu33B081a01b1
cccacgcgtccggcacgttgttttgtgctctgtgtttctcaataaattccttattcctacaaaacccccaaaattaaagaaggatcaaaccgaccctttgcaattccaagacacaagaaccaagagacataccacgatggcaacaacgacggagaagcaagccatggttgttggaatcgacgacagcgagcacagtacgtacgcgctgcagtggatcctcgatcacttctttgctcctttcgcttccaatcctcctttcaagctcgtcatcgttcatgccaagcctactgcttcttctgctgttggtctcgccggacctggagctgctgatgtattgccctatgtggatgcggatttgaggaagatcgctgccagggttgttgagaaagccaaggaactctgccttagcaaatcggtacatgatgccgtacttgaagtggtggaaggtgatgcaaggaatgttctctgtgacgctgtaaaaaaacaccatgcctncgttctcgctgttggtagccatggttatggagctataaagagggctg

SEQ ID NO: 2100 - DNA, 409 bp, Gossypium hirsutum
  Clone ID: uC-gsronu33B081a02b1
gaggaatgcacttaaaagagctccccttttaatccccatttttagtcactgctatattccatgtaacccgtctttagccggtaacccgattttcttcatcgacgaaacccggattttctgttgcggatttgatatatccagctttttcgacagggaatcctttttccggacctccgaatccgacccggaatcgttgaagaaacagagatcggttagcgaaaaattagccgggtcgtccaccgacgtatccaggcgtagtatggatgccggtttccttaccggcactcgaacccctagatgggtagagttctggagcgacgcggcggttgatcggcgccggagaaactcatcgtcttcaccctcggattcatcgcccgagacgtattttgatctgccgagaaccggaatt

SEQ ID NO: 2101 - DNA, 438 bp, Gossypium hirsutum
  Clone ID: uC-gsronu33B081a04b1
cgattgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggttttgcagctgaaatcattggtacctttgtccttgcctacactgttttctctgcaactgatcccaagaggaatgcaagagattctcatatccctgtcttggaaccacttcctattggatttgctgtgttcatggtttacttggcaac

SEQ ID NO: 2102 - DNA, 500 bp, Gossypium hirsutum
  Clone ID: uC-gsronu33B081a05b1
gaggaatctgactggggtaataagcttctgtttttacctgctgcaaggagtatgtcgatgctggtggtcgaatcgagcccttggaatgcaaatgattttgggattccatatccaacatacttccatcctgcaaaggatgaggaagtctttgtatggcaagatcggatgcgaaatctggagcggaaatggcttttctcttttgcaggtgcacctcgtcccggtaaccccaagtcgataagagggcagattattgatcaatgcaggcagtccaaggtgtgcaaattgctggaatgtgattttggggagagcaagtgtcattcaccaagcagtataatgcagatgttccagagctccctgttctgcttacaacctcaaggagattcatacacacgaagatctgctttcgactcaatgctgctgggttgaattcctgtcctcttccatcctggctcggcgtacacacagtacacttggcaccttccgaagaattatactacata

SEQ ID NO: 2103 - DNA, 482 bp, Gossypium hirsutum
  Clone ID: uC-gsronu33B081a08b1
catctctaccatctgcaagaccagctataacaacgacctccaaagtggccccacaaccaaattttcaaaacagtgttggaatggcaggtccgccacgtctggtgcgtagtcgtgctgttaggagggatcttgtgagagactggaactttgaagaggttgtgatggaacgctagtttgcttagtatgaggtgcaagactgtgggggctctctccatttgggctctctattttgtattagtatgcaaaaactgaacttttcagcatatgtaacacactgagtaaagattattgaatgtgaagaacatatcacatgtcctatgtctcctgccttatttgtttaggtgtctttggtacagcatgggcgtggctgacaatgtgtacagcttccttaacccacttgaaatttgggttagacaggtggaagccagcaagattggctctgctcagccttgttagacagcattcgaagtagttttattatt

SEQ ID NO: 2104 - DNA, 445 bp, Gossypium hirsutum
  Clone ID: uC-gsronu33B081a09b1
gttgtactcgttcctcgaaccgactcccctcgagttctcgaaccggttcgggtagtagttgttctcagaacccacacgatagtagtacttcccattctccaagtacctagtatcactcataccttgcttctcaacattgctgcactcattgttaccattgcaatagccgctggtgttctggctttccttagtactccatcctttctcagtgaacatggcctcattgataccattgtaatagttgatgctattctggttttccttagtactccaccctttgtcagtgaacaaggcctcattgctaccattgaaatagttgccattgcagctgctggtttccttggtggaccatcctttctcattgaacctggcttcactttgctgctcagtgctaccgttcgcatttgccttggtatagaagtaagagtctttgttgatggtgttg

SEQ ID NO: 2105 - DNA, 223 bp, Gossypium hirsutum
  Clone ID: uC-gsronu33B081a11b1
aagaacactacacgagtggttttgaactgcaaaaggagatcgatttcgaagccttttcaccatgagagctaagtggaagaagaagcgtatgaggaggttgaagaggaagagaagaaagatgaggcaaagatctaagcagtctaactatatcttaaagctagcaattcggtctatgtctctttagattctctgttgtttgatggatactttactttaaaaggat

SEQ ID NO: 2106 - DNA, 79 bp, Gossypium hirsutum
  Clone ID: uC-gsronu33B081a12b1
cccatgcgtgcgattagcctgtagaaattttggggtcgcgaggatttattagtaagagggactgggaaatagatcttga

SEQ ID NO: 2107 - DNA, 565 bp, Gossypium hirsutum
  unsure (1)..(565): unsure at all n locations
  Clone ID: uC-gsronu33B081b01b1
cccacgcgtccgtttacttctctgggtcataattttttcctccccccccccccccccccccccccccccggggggnngnncnnnnntcttcnnctcccccccccctccctcccccctcctcccctaccccccctcctctcccctcccaccccccttccctcccacccccttnccccccaccccccccctccctccccctcttccccccccctccccaaccccccctcccccctccctcccctccccctctcccccccccccccccttctctccccccccaccctatcctactccctctgcccttccccccccccctccccgcacgccccccccccccccttcccccccccaccccctcccctctccccccctgcccctcccttcccccccccccctccccttccnctcccccctccctctcctcccccccctctccccccccccctcccttcctctcctcctcattccctctcccttcttccccccccccctcccccccctcctttccttccccctctcctctcccccccccttccccccctcctctaccccccctccccccccc

SEQ ID NO: 2108 - DNA, 509 bp, Gossypium hirsutum
  Clone ID: uC-gsronu33B081b02b1
cccacgcgtccggtttgtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgctaggcctatgactataattatgtctctgtctgtgtcttgtgtaatagaagctttgtttgtggtgaaaataatgtataagccagttggttgggagccaattttccttttgtccaaggatttttgctgctcattcat

SEQ ID NO: 2109 - DNA, 487 bp, Gossypium hirsutum
  Clone ID: uC-gsronu33B081b04b1
accacacttagggcgggcggtcgcgatctagaacctagatattatatttagccacacgagatgcaaatgtttgctacgactctaaccgacaagactaacactctcgaggacaggagctacgattcgagcgacaacgtgtaggccagaatccatgtgaaggatggcctccctccagaccagcagcgtctgatcttcggcggataacagctcgattactgtcggaccttggccgagtacaacaatcaaaaggagtcaactctccacctcgcactgcgaatgcgcagggggatgcaaatcttcgcgaaaaccctgactggccagacaatcactcctgaggtcgagagctccgacacgatcgacaacgttaaagcgaagatccaagacaaggaaggcattcccccagaccagcaacgtctcatctttgccgggaaacacttcgaagacggccggaccttggccgactacaacatccagaaggagtcaactc

SEQ ID NO: 2110 - DNA, 385 bp, Gossypium hirsutum
  Clone ID: uC-gsronu33B081b05b1
gtgatcctgagggtcctcttatgctttatgtttcaaagatgattcccgcttctgataagggtaggttctttgctttcggtcgtgtcttttctggcagagttgcaactggtttgaaggtcagaatcatgggtccaaactatgtacctggggagaagaaagacttgtatgtaaagagtgtacagagaactgtgatttggatgggaaagaagcaggagacagttgaggacgttccttgtggtaatacagttgccatggttggttttggatcagctcatcaccaagaatgctacattgaccaatgagaaggaagttgatgcccacccaattcgtgccatggagttttctgtctccccttgtgatcgcgttgctgctcatgtcgaggttg

SEQ ID NO: 2111 - DNA, 523 bp, Gossypium hirsutum
  Clone ID: uC-gsronu33B081b06b1
gtcactttcagcaaacatcgttggtcaggtaatttaatatgctatttcataatccacaatgctttggctacttcaaactgatactttccctactaaatttgaaggctgcggttctgaaagggtatccatcggagataacgttggtttccttctattgcctctttgggaccattcaatctgcattggttactttgatttttgaaagagaccccaacgcttggatgttgagtccagatatcgagctcatttctgtggtctactcagctttatttggaaatgtggtaacattcggcgtgcaagcatggtgcatacggcgtaaagggccggtctttgtggccatgttcaagcccttaagtattgctattgctgccttcttggggttcattttccttggtgaaacgctttatattggcagtattgtgggagcagccataattgtaacgggcttttatggggtgatatgggcacagtcggacaaggaagaagtggcaagacacaaccacccccccttagaggacatgat

SEQ ID NO: 2112 - DNA, 452 bp, Gossypium hirsutum
  Clone ID: uC-gsronu33B081b07b1
atcattttgtagtcaaaaaagtgaagctaggagacaggataacagcacttcaacaaattgtgtcgccatttggaaagactgatacggcctctgttttactagaagcaattggatacatcaactttctacaagaacaagtgcagttactgagtaatccttacatgaagcccaactctcataaggatccatggggcagcttggatataaaagagcagaaaggagatattaaggttgatctaaggagcagaggtttatgtttagttccaatatcttgtaccccaaaagtttaccatgaaaacactgcttcagattactggagcccaacatatagaggatgtttgtatagatgaagaattaaatctcatgctcgctttgacacgcacaaacacacgtacgtatatttatatgtatgtattacttttaaggaaagcaattggaatcattttgtagtc

SEQ ID NO: 2113 - DNA, 556 bp, Gossypium hirsutum
  Clone ID: uC-gsronu33B081b08b1
cgtttctcataatcaaagctttacaggtgtctatgtcaggcgccttaagtaaggccacaatgtgagaaacgaagagaaggtgatgcatgcggtgttggctgggtgcttgagtttgagtctgcttcttccttcttctatgtttcttcttttcggctatattgattaaaattttgttttaagctttgcttgtttgagttcttttcgctatcaaggcctatcaaagccaacaaagaagaaaaaaactgaggaaagtggtcttttttagatctgggtttctcaactttaagggaagagtgatgatgagattaaatttccagagccttggtattaagctcttaggaggaaaagcatggtgtggatctttgtggtgatttttccacttatttttccttggttatttactgcattcacccatgcttctccttctacattctcggtatgtttctatatcaaaatttttttctttgcttaattttctagggaaaaaaaatatgagttctggggtccttgtaatttcatggacagattaaatggaagttttgagtgtttgagagaa

SEQ ID NO: 2114 - DNA, 102 bp, Gossypium hirsutum
  Clone ID: uC-gsronu33B081b09b1
gccattcgtacgatcagtcttgggtaatgttagtgtagaaatgatccctaagtccacgggactgagaatactagagagtgatactccctctcctaaatcagt

SEQ ID NO: 2115 - DNA, 102 bp, Gossypium hirsutum
  Clone ID: uC-gsronu33B081b11b1
gccattcgtgcgatccgtgtgtggtaaatgtagggtagctttgatcccttggtcaaagggactgtgaatgagaaatagttaaatttcgtctcgtaaatcagt

SEQ ID NO: 2116 - DNA, 103 bp, Gossypium hirsutum
  Clone ID: uC-gsronu33B081b12b1
tccattcgtgcgataaattggtcagcattctagggtagcttttagaactaagtcaccgggactgaaaaagcgagctggaaaaacctcttctcataaatccgtg

SEQ ID NO: 2117 - DNA, 506 bp, Gossypium hirsutum
  Clone ID: uC-gsronu33B081c01b1
cccacgcttccgtgttcaccaccactgctgaacgggaaattgtccgtgacatgaaggagaagcttgcttatgttgccctggactatgagcaggaactggagactgcgaagagcagctcatctgttgagaagaactatgagttgcctgacggacaagtcattactattggagctgagagattccgttgcccggaagtcctcttccagccatctttcatcgggatggaagctgctggaatccatgaaactacctacaactctatcatgaagtgtgatgtggatatcaggaaggatctctacggtaacattgtgctcagtgggggttcaaccatgttccctggtattgcagaccgcatgagcaaggagatcactgcacttgctccaagcagcatgaagattaaggtcgttgcaccaccagagagaaagtacagtgtctggattggaggatctatcttggcatcactcagcaccttccagcaaatgtggatttccaagggtgagtatgat

SEQ ID NO: 2118 - DNA, 221 bp, Gossypium hirsutum
  Clone ID: uC-gsronu33B081c02b1
cccacgcgtccggccagactcaattgtggtaacccgggattcaccgttaaagaagaaaacggagggattagctttggttggatgggccgaactctcaccgtcgcatcagcctggcgttaacttcacctttttctctctaatattggtattaattgctagaagaaaaagcgaacaaaattccagcaaacccaaataataaaaacttgtgtttggattcctcg

SEQ ID NO: 2119 - DNA, 375 bp, Gossypium hirsutum
  Clone ID: uC-gsronu33B081c03b1
ctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggagctttcgttggcgggaacatcactctcttgcgcggtattctttactggatcgcccaactcctaggctcaaccgtcgcttgcctgttgcttaagttcgctaccggcgacctggctgtaccagcttttggattgtcatcaggcgtgggcgtgtctaacgcattggttttcgaaatcgtgattgacct

SEQ ID NO: 2120 - DNA, 284 bp, Gossypium hirsutum
  Clone ID: uC-gsronu33B081c04b1
gcgctcttacttacgctcggtcacctcgaagaaagatggggttccattcatacaattcccaggagtgcgttggatgacaacaagaccggaacccatttactacagtggcctgtggaagaagtggagagcttgagactgagtgctacagtgcctaaggatgatgtaattgatgcaggatcagttgtgccccttgacctaggcaccgctactcagtggggtctgttagcagagtttgaaatagaaacgtcggtatggtacaacacggaggatgaagtcagtgattg

SEQ ID NO: 2121 - DNA, 299 bp, Gossypium hirsutum
  Clone ID: uC-gsronu33B081c05b1
gtcattcttagggtccattggcggtcaatcgagccaggatgttatatcctactccacagggcggagacttctataaagagattctcttcctagtcaatcagtatgctggtcttaaggtcggttacttgtgacagatttctggactttcttcctattatgtcttggatgccacgcgacctcaatgggctgctcttagtctggaaacagacccaagaccttggttggtgcgtccatagctacatcccatttctgtggcctactcagatctatctgggaatgtgggggcattctctgggcat

SEQ ID NO: 2122 - DNA, 134 bp, Gossypium hirsutum
  Clone ID: uC-gsronu33B081c06b1
gccactcttaggatccatcgttggtaacgcgagccaagatgctatttcatgctccacagggctcagggtgctagaaagtgacacttcccctactaaatcagtaggctgcggatctgattgggtttccatcggag

SEQ ID NO: 2123 - DNA, 347 bp, Gossypium hirsutum
  Clone ID: uC-gsronu33B081c07b1
gtcacttttaggatacatcagaggtaacgcgagttattaagttatagcatgatccacatggctgagggtgctagaaagtgaatctcctcctactaaaacagtaggctgcggatctgaaagggtatctaggagagataacgtgactctccttctattgtctgtttgtgaccatatgacctgaattgggctacggcgatttcggaaagatacccaagcgttggcattcggagatcagatataagactcatttctgtggcgtaatcatggctatgtggaaacgcaggaaacttgtgttggcaggatgcctgccagctgtaatggggaagactattctttgtgctgttgaa

SEQ ID NO: 2124 - DNA, 262 bp, Gossypium hirsutum
  Clone ID: uC-gsronu33B081c08b1
catcacttcatctgcgttttcgttggaacggtctcaggaatggcttttaacaagctgaccgacatcggatcatcaaccccggccggtctcgtagccgacgctctagctcatggcttcagtcttttcctagctgtcttcgttggcacctacatctgatgtgttcacgtgaaccccggcgctacattgggtgcttccgttggcggaaacatcactatcttgcgcggtattctaaactggatcgcactactttttggattatccg

SEQ ID NO: 2125 - DNA, 128 bp, Gossypium hirsutum
  Clone ID: uC-gsronu33B081c09b1
gttattcgtgcgatcagtgtggggtaaatttagtgtagatattatttcttagtccaaaggactgagaatgagagaaagttctacttcatctcgtaaatcagttggatgttgaagataaactgtatcta

SEQ ID NO: 2126 - DNA, 113 bp, Gossypium hirsutum
  Clone ID: uC-gsronu33B081c10b1
gtcattcgtacgataagtgtgaggaaaagttagggtagatttgattgcttggtcgaggggactgagaatgagagaaagttcaactttttctcatagatgagtgggatgttgaa

SEQ ID NO: 2127 - DNA, 310 bp, Gossypium hirsutum
  Clone ID: uC-gsronu33B081c11b1
gtcattcgtacgatcagtggggggaaactctagggtagatttgattgcttagtccaagggactgtgaatgcgagaaggagctactttacctcgtaaatcagtgggctgttgaagaagaactgttcttatgcactgataattgcgatggcctatggatgaactctcgtggaccattcagatttgaaatgatacacgccgagcgtggaaagatgccagaggggttgaaattttagtggccagattggactgagttctttgacgtacgcgaatcggtgaggataaatgggatcgttcagtgggtaggtctcat

SEQ ID NO: 2128 - DNA, 103 bp, Gossypium hirsutum
  Clone ID: uC-gsronu33B081c12b1
cccacgcgtccgatcagtgtgggggaattctagggtcgcgatgagcgcttagtcacagtcactgagaaagagagctaggtacacttcctctcttagatccgtg

SEQ ID NO: 2129 - DNA, 567 bp, Gossypium hirsutum
  unsure (1)..(567): unsure at all n locations
  Clone ID: uC-gsronu33B081d01b1
cttttgttagttctgttatctggaggacttgattcatcattagttgcttccatcacagctcggtatttggctggtaccaaggctgccaaacaatggggaagccagctccattctttctgtgttggcctagagggttcaccagatttgaaggctgcaagagaggtggcagactatttgggcactgttcatcacgagtttcacttcaccgttcaagatggaattgatgccattgaagatgttatttaccacattgaaacctacgatgtcaccacaatcagagcaagtactcctatgtttctaatgtcacgaaagatcaagtcacttggtgtcaaaatggttatctccggtgaaggctccgacgagatttttggtggatatttgtatttccacaaagcaccaaataaggatgaattccatcaagaaacatgccggaagatcaaagcccttcacctgtatgattgcttgagagctaacaaagcaacgtctgcatggngattggaggctcgagttccattcttagacaaagaattcatcaatgtcgccatggctatagaccctgaatcaaag

SEQ ID NO: 2130 - DNA, 564 bp, Gossypium hirsutum
  Clone ID: uC-gsronu33B081d02b1
caaaaagaaaagtaatcatttttttttcttattttgtagaaaatggttgaacttgattggaaagcaaagatggtttcttccgatattccaaagaaatctccaaagctctctaacaaactccaagtttccattccgacgccgtttcgtttctccaatatgtcttctccgctctcgacttcaccttcggcgtccaaagcttatgattattatctccggttaccggagctgaggaagttatgggagacacaagagtttcccgcttggaaaaacgaggtcgttttgaagccggctttgcacgctttggagattacgttccggttcatttcgatcgttttgtccgatcctagaccgtatttgaaccgtcgggagtggacgcgtcgactccagtcgcttaccacgagtcagatcgaactcatcgctatgttatgcgaagaagaaaacgaagctccgatccttgatcttacgtcgtcgaacggtgtattaacacgagagagcagctccgccgaggtgtggaagattcacggagaacgaccgtggtgacaggaccagcgaagccgcttattg

SEQ ID NO: 2131 - DNA, 512 bp, Gossypium hirsutum
  Clone ID: uC-gsronu33B081d03b1
gttccccaacaacatcatcgccgcctgcagcatctccgactactcctcctcctccacagatccaaccaccggctgcgactccgccttcttcttctagcccatcgatttctcccccaactgcttctcctccggctgccactccttcaagctctccgccttcattgactccaactagttcgcctacttcaatgactccggccggggctccacctgtttcggctgatattccttcgagttcaacgacgccggccgaaagtcccggggttttcccgtcgagcagtagtccaccgagtcctactccgatcggttcgtcccctgagagtgcagcgggcccggctgctaatgatgattcgggttcaagatccggatacgaagtcgggttcgttctaagctttggtttggttattggggccccattggctatttagattttgatactttcttggatagtaatttttttgaaaattttattttctaaggcagccttcatttaattatttgggattttaatt

SEQ ID NO: 2132 - DNA, 443 bp, Gossypium hirsutum
  Clone ID: uC-gsronu33B081d05b1
cccattcttacggtcagtttgcggtcaaacttgtatgggagttatatttaatgcctgagtttggaaaataataaaaaaaaaataaaaaacttctgaaagtatatagagctacctaaatgaaattttctggcactagtattacaaccagctcactgtaaaataccatgagaaaggccaactcaattttagaggaaccaagttccggtatcgacccttgacctcctaaagttttttcttggtgccacgcaactttcataacatggccccacatttaactggagaatgagtggaacacccttggggtgcactaacctaaactggttggggggaaataccccctatggtgagcgtgcaaaatgaaaaaaaggtccctaccgataattttgcataaaaattacgattctaaaaaggatatggggacccccccgtttagggataataaa

SEQ ID NO: 2133 - DNA, 140 bp, Gossypium hirsutum
  Clone ID: uC-gsronu33B081d07b1
ttctctcgtacgatcactcggtggccaaagtattcgggcagatatagcttgtgccaggggagttggtataaaagacagaccaacttcctctggtaaagctgttacatgcccctctctgagtgtatctatcggagctaatt

SEQ ID NO: 2134 - DNA, 205 bp, Gossypium hirsutum
  Clone ID: uC-gsronu33B081d08b1
gttattcgtccgatcaatctttggtaaaggtagggtagattttatctcttggtccaaaggactgagaattataaatagttaaacttcatctcgtagatgagtagtatgtagaactcaaacagtatctatgagccttatttgcgatggaatatggatgaatgtgtgggatccttcaatctaaattgtatacgtcgattttggaatg

SEQ ID NO: 2135 - DNA, 137 bp, Gossypium hirsutum
  Clone ID: uC-gsronu33B081d09b1
gtttttcgtacgataaatatgaggtaaagttagggaagaaattatttcttagtcaaaaggactgagaatgagaaaaagttaaattttttcttatagatgagttggatgttgaactaaaacggtatctatgagtaata

SEQ ID NO: 2136 - DNA, 121 bp, Gossypium hirsutum
  Clone ID: uC-gsronu33B081d11b1
ttcattcgtgcgatgagtgtgggggaaagttagggaagctatgatcccttggtcaaagggactgagagtgctagaaagagcaacttcatctcataaatccgttggctgttgaagtaaaacg

SEQ ID NO: 2137 - DNA, 305 bp, Gossypium hirsutum
  Clone ID: uC-gsronu33B081d12b1
tccatgcgtccgatcagtttcagggaattttgtgctcgcggggagggcttagccacagtcactgagaaagatgactaggcacacttcctctctactatcagtggcatgttgaactccgacggtacttgaccagcttaatggggacacgcaataggtacatatggtcgatcgcatcggctcgaaccatcatccatgtccgtggaatgttgcgcactgagacggatagagagcggtcccaatgaaagtcggattgctatgtacgcgaaacttgcatcatgtattttcctgatcctgtggtagtaatc

SEQ ID NO: 2138 - DNA, 67 bp, Gossypium hirsutum
  Clone ID: uC-gsronu33B081e01b1
aaaattattagtacttgtaatatatatttttaaaatagtagtatgcttttagcctccgttcagtatt

SEQ ID NO: 2139 - DNA, 374 bp, Gossypium hirsutum
  Clone ID: uC-gsronu33B081e02b1
actccgccgactttttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagttttgagtgtgttttcttgtttatcttttcctaataatgcctatggttttttattttttttcc

SEQ ID NO: 2140 - DNA, 127 bp, Gossypium hirsutum
  Clone ID: uC-gsronu33B081e08b1
ttttctcgttcgatcaatcttaggtaaagctagtgtagaatttatctcttagtccaaagtacttagaataataaatagttctattttatctcattaaatcagttataatttgaactaaaacagtatc

SEQ ID NO: 2141 - DNA, 130 bp, Gossypium hirsutum
  Clone ID: uC-gsronu33B081e11b1
tttattcgtgcgattagtgtggggaaattttagggtagcgttgatctcttggtcaagggcactgggagagagaactagaaaaacattatctcataaatcagtggtatgttgaagacgaactgtacttatg

SEQ ID NO: 2142 - DNA, 302 bp, Gossypium hirsutum
  Clone ID: uC-gsronu33B081e12b1
cccatgcgtccgattagtgttagggaattttatggtcatgtcgagggcttagtaacagtcattgagaatgaggactatgctcacttcctctctacgatcagtggcatattgtacaccaacgttgactatacagattattggggacacgcatataggtacatctggtcgatcgcacagcttgaattaacctccatatccgtggaatgatgcgcacttcgatggatttagagaggtcccaatgaaagccggattgctatatacgcgaaaatagcatcatgtatattcctgatcctgaggtagta

SEQ ID NO: 2143 - DNA, 521 bp, Gossypium hirsutum
  Clone ID: uC-gsronu33B081f02b1
ccctcgcttccgaattttattattctcccactccgaatcgatctatgatttgggcaattcctctgttttcgctgtaaatattattcaaaatcaatttcatcaattatgtttttattgtctttttcgttgatgacttgcaacgtgatattccaaaacctgcgtgtgttcggtcctggcttgaatcctttttcccctttctgcgtcgctcatcattcctctgcttctcgctaatctgtttccctcttctccttgttttcatctctatcatgtaatcatttttctcttcatcttaagctttcgaggggattgtttgctttccaagaaaaaaaaatgaaagggatctaactctttgtgaaaatttcacgtttttacaaaaatatcatgcgtttctttgcctaatcaatcaaatcttggtctggtgttctctttacttcttccgagttaaaggaaaaagtctatatatctgcaacggtattgcttggtttttgatattgcttcaaaaatatgacccaaggacagtc

SEQ ID NO: 2144 - DNA, 60 bp, Gossypium hirsutum
  Clone ID: uC-gsronu33B081f04b1
tctttctatcaacaaatcaacatataccttgatcgtgggggatttctaatgcatcaaaga

SEQ ID NO: 2145 - DNA, 92 bp, Gossypium hirsutum
  Clone ID: uC-gsronu33B081f08b1
gtttcgcgttcgatcaatgttaggaaaggctaaatagatatatgacttgtgctctagaggatttaatgttataaatagtattaataatcaat

SEQ ID NO: 2146 - DNA, 230 bp, Gossypium hirsutum
  Clone ID: uC-gsronu33B081f10b1
gcctatcgtgcgatagatgtggggaaattctaagctagctttgatcatttggtcacaggcacattatgagagaacttgatctaatttatatcaagattgactgtactctcaaggacaaacagtacttcagagacttaattgcgactgaatatcgataggtatgttagggtcgccggttgaaagaatactccaatacatgcttctattgagtattgtggcaacatgtttga

SEQ ID NO: 2147 - DNA, 477 bp, Gossypium hirsutum
  unsure (1)..(477): unsure at all n locations
  Clone ID: uC-gsronu33B081f11b1
cccacgcgtccggccctttgcatttgactgcaaacattttttctcttctctcatcgcccttcaccttctttcttgctttcttgctaaccaaaacctctctattccctttccattcccaccgctttccttctgctttccttttgattctctccacaaaaggaaaagaaaagaattccatctttcctttttctctccttctttattcccttattctttcctggctagctataattgtagttggaagctgtgggtaaattcagttcgatccaaggaaatgggggtttcagggaagccaaaagcggatgagggtctagattcacaaggccaaaaatgggttttagctgtgatttctatacgagctccattgaagcctatatacacaagtggtccattgaagacaaataatgatgaacaaggtgacgactcatgttccaccactccaacggntgaagatgccaaaattcaaacctctntgac

SEQ ID NO: 2148 - DNA, 324 bp, Gossypium hirsutum
  Clone ID: uC-gsronu33B081f12b1
ccctctcgtccgcccacgcgtccgcccacgcgtccggtcaaccataagtaagttgctgcgtgagcagtgatacattatcagaggcaaagaagaaaggtcaaaaatgggtcttcttacaaatagagttgagaggaatgagatcaaaccaggagatcatatttacacttacagagctgttttcgcttactctcatcatgatccgacattccctcaatcaacttgtccaactttccctgattgcggcttccggcagccaaacagtggggtagtactttcatgcctggattgtttccttcgaaatggatctctctactgtcttgaata

SEQ ID NO: 2149 - DNA, 436 bp, Gossypium hirsutum
  unsure (1)..(436): unsure at all n locations
  Clone ID: uC-gsronu33B081g01b1
gcctgactataaatcttatctattgctatggctactgaacaatgtgtgcgccctgttgaaaaaaccctacacgaagggaaacatgaacaccatccgagcagtggccaaactcaggttcataaggagagtaagggtgtgaatcaatcacatgggcacaaccaactgagtcatgacacacccaaaacacatgccgagtccaagaccgtgagccatggtgtccatgctcagcaacatgtggctcaaagcacggncatgcctacaacttgccatggaaagaaggaaaagaagatgaaagacacgaaggagaaaagacaggacaggaaggaaaagaaagaaaagaaggaaaagaagaccgagagcatgatgaagcctgggacggagaagagtaagcacaagatgagcaaagacgacagcagcagtgacagcgactaaagag

SEQ ID NO: 2150 - DNA, 437 bp, Gossypium hirsutum
  Clone ID: uC-gsronu33B081g02b1
ccatctctaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggctgaataatttgtgtctgttgtagtttgtgtggtgacttatatcttgcagttaacctttcttttccttactatgatgtaatggctatgcttatggcctaatctggttaatgaagtatccttacttt

SEQ ID NO: 2151 - DNA, 184 bp, Gossypium hirsutum
  Clone ID: uC-gsronu33B081g03b1
cggtcgcgtgggaaaaattttgaaagaagggtttggtttatatctttatattctgttttaaagtcttgcgtttttcattggtattggcttgcgatatgtatttgtgaaaggtaataaggaactcaatggtcttttactatcttgcggatgacatattgttggttttgccatatgaaatgaaact

SEQ ID NO: 2152 - DNA, 430 bp, Gossypium hirsutum
  Clone ID: uC-gsronu33B081g05b1
tttctttctctacactttcactttctctctctagaaaccttctctctaaacagtttattatattttttttccaaatcctttataaaatcaccagtaactctctgatttgaaaactgaggggttttttttgtctgcaatttttttggaactgaaggttgactaacggttatggcggacatcgaaggaaataagaagagagcccgggaagagtcagaggctaacttggtgcccaatacaaaactcgctcgagttgactcggacaataataagggtcccgactccgactctcccgagggtactcgtgtagaacctgatcctgatgatggagaagataatttgccggaaacaaggcatataccggtggaattgctgaacatccttgacgattcagatccggttagtggaccagatccggcgattcaaggacttg

SEQ ID NO: 2153 - DNA, 55 bp, Gossypium hirsutum
  Clone ID: uC-gsronu33B081g06b1
gccattcttccgatgactcgtgcgtaagaataatagcgaatatggctgtgggtcg

SEQ ID NO: 2154 - DNA, 52 bp, Gossypium hirsutum
  Clone ID: uC-gsronu33B081g07b1
ttttcgcgtccgttcactcttgcgaaggggaaagggcaattaggtcgctcgt

SEQ ID NO: 2155 - DNA, 294 bp, Gossypium hirsutum
  Clone ID: uC-gsronu33B081g10b1
cttattctttctttttctgtaagaatattttagggttccctcaaccctttgagcaccggccccccctttgcgccaaggctctgattgcgacggagatggccacgactcggcgggttcggcgtatggtccgtttttgcaggtgttcataaagagtacggcgcgcgtggagaggaggctggccccaagacgcgcggggcctgtaattctgctggaggcgcggaggctgcggcggctagggcgtatggtgctagggttgctgctatattttagataatgggctattggggtttgggc

SEQ ID NO: 2156 - DNA, 320 bp, Gossypium hirsutum
  Clone ID: uC-gsronu33B081g11b1
ccttgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtcttttccttttccttttttcgccggcattgtttgaacatggggttgtgcgcccgtcaattccagttaaatatggtgacttttgtttttc

SEQ ID NO: 2157 - DNA, 481 bp, Gossypium hirsutum
  Clone ID: uC-gsronu33B081h01b1
tcctctctttcgtccacgcgtccaaccggaaccggggaagaagggatgggtgtgattacaaaagcttaaaaaacaatggccaccgctcctttggaaatggttttccatattaatcgcaggtggaggtcctggagcttaagacaaaaagaacccaacggttcaatggtttcaaaatcgaggagaagcaaaagcaaggtattgtggagaagcttggtgaaccaaccgaaagctacgaggattttactaaatgtcttcccgctgatgaatgtcgatatgctgtgtacgattttgattttctaacggtcgagaacgtcccgaagagcagaatctttttcattgcattggtctcccgactccgtcaaggatcaggagccagatgatttacgccagcttcaaagacagattcatgcgagaactggacggatttaagtggaatttgcagcaacaatcccacttgaatgggttctgatgttttaaaagc

SEQ ID NO: 2158 - DNA, 363 bp, Gossypium hirsutum
  Clone ID: uC-gsronu33B081h02b1
gcatcttattaatgaaatgagccgatttggagctgcagagctccatgccgatgctgccatcattggtggaactgcatctcaagaagtcattaagcttatgacaaaacaggtagttccaatgactggcacgtctgcattcaatgcgattgatcacaagtcccaattgttgaatctgtgttagagaacttgacgcaacgcagttgtttgaagcccaacggcactattcatctcatctggttcaaactacctcatttaatgtcgatttcaagtgaagaaatgttgcgagtggaaaattcggctgggagatgggatcacaaatcgattgcaggcttacctttggggcctcattaatcaaaagatgac

SEQ ID NO: 2159 - DNA, 551 bp, Gossypium hirsutum
  Clone ID: uC-gsronu33B081h04b1
ctgcagtgcagagagcacaagctgaagcccgtcaaagagcagcagctgaggcaagagaaagagctgaaagagctgctgcggaagcgagagaaagggaagcaaaagagaaggaagctcaagagaaggctgaaagagctgaagcaaagcttagagctgaaagagctgctgcagagaaggctgctgctgaggctcgagaaagagcagctgcttctgcaagggcaagccagcaaaataatgacaatgatcttgaatccttctttagtatgggttctcgaccaagcagtgctccaagaccaagaactaactcttctgatcccctgtttgatggacaaaataagggagggcctgaagtagctaggggaacatctgccggatcctcatctagcatgaggaaagcttcttcaagtgcaaatattggtgatgatctcagctctatttttggagctgctgcatcctcatttggggagttccaagaggttgatggggaaactgaagaaagcgaagagccaggttggacgccagcaaagactcggagcgcgcggcaaagcact

SEQ ID NO: 2160 - DNA, 235 bp, Gossypium hirsutum
  Clone ID: uC-gsronu33B081h05b1
caactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgcgtaatagaagctttgtttgtggtgaaaataatgtataagccatttggttgggagcaaattgtccttttctccaaaggatttttgctgctcattcatggt

SEQ ID NO: 2161 - DNA, 379 bp, Gossypium hirsutum
  Clone ID: uC-gsronu33B081h06b1
cccttgcgtccgcccacgcgtccggagctaaaaaagaagggaaatcaatggaggggaaagaagaagatgttagattgggagccaacaagttcccagagaggcaacctattgggacagcagctcagtcccaagatgataaggattacactgagccaccaccagcacccttgtttgagcctagtgagttgacctcatggtctttttaccgagccggaatcgctgagttcgttgctactttccttttcttggatatctcgggattgactgcgatgggagttgctaaggacaaaaccaagtgtacaactgttgggattcaagggattgcttgggcttttggtggtatgatctttgcacttgtttactgcactgctggtatctc

SEQ ID NO: 2162 - DNA, 537 bp, Gossypium hirsutum
  Clone ID: uC-gsronu33B081h07b1
ccaccgccgtcgatctcgatccttatcctcgttttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaaagcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaactgaatacggttctttaggcatctgcaaccgggaagcttcttccttcctcctacagtatgtctttact

SEQ ID NO: 2163 - DNA, 478 bp, Gossypium hirsutum
  Clone ID: uC-gsronu33B081h08b1
tcctctcgtccgagagaaataagagaaagctaagatctttgataactatagtgaatcggttttctcaccggagataatcgccggagcttctttccggtgaattatggtatattgtgccgcctgactgacgagtgtcatgcaaccagactggtttctttaataattagtggtttatttaaattattatcagcaagacgagctaattttacagagatggatagaaccagagaagcgaggagagtcagtatggcgaccgccgccgcgaccaatggcctttcacggcggcgacataggactagctctctcagagactctccagaggaagacggaccggtggagacgcatgaaacggcgcgtttaagggatcgaaagaaggatgggataggcagcgatgtgaagaagatggtggcggaggttaacaatgaaccggagagtgcaggagataccgcgaaaacagaggctcacagtgggagtagtc

SEQ ID NO: 2164 - DNA, 160 bp, Gossypium hirsutum
  Clone ID: uC-gsronu33B081h09b1
ctctcgcgtccgtaagaaacaacaataagctaagagaacttataatccttaggaaatcgatactcttactgaaaatactaactaaccctcatctaactacgaatcatttcttagggaaccaagcgacttcggggtgctattcaaacacgtccatgtatcc

SEQ ID NO: 2165 - DNA, 210 bp, Gossypium hirsutum
  Clone ID: uC-gsronu33B081h12b1
gtgaatttatttagcgcctcaggcgagcttgcgctctcctggtgttcctccatagagtcattctctcttttaagaggccttttcacttaaaaacttgtacctctccaagcattggcccttctggcaacagcttttgtatctcctccagtcaaagcaagtttgtgttgatactcttgggtttattaccaccaatgaagagagtgtccctct

SEQ ID NO: 2166 - DNA, 539 bp, Gossypium hirsutum
  Clone ID: uC-gsronu33B082a01b1
cttttctgtttgcttttactaaacggctcttcatctttagggcaaccgacacccacttcagaacaaatctcatctcctctccctttgctccgaatggtccagacgagttggttcctgctcctcccataactcacgtaaagtctctccactccaggagatgccacatttgcatgaagaattaactttgctgccacgattttaccctcctccttgacatcatggcctgacgccgatctgttatgttgtgagtcgaatgccgcatcgaagaagatagccatattttctctttgttgtctctgactagactttgtattcgttactgaggaatttatttctgcttgtccagagtatccatagcccatagctgaatcctcgacactgttcagttgttcccttgctgaaaacccaggacactgttgaaagacgtggttactatcttctgtttcctgaccacacctcaagcatcgatcctcagttattacctctctcagtttaagctggagaaaagtggaatgtagttccacgcgattttccatact

SEQ ID NO: 2167 - DNA, 414 bp, Gossypium hirsutum
  Clone ID: uC-gsronu33B082a03b1
cccactcgtccgcccacgcgtccgcccacgcgtccgaaaaaattttagttgcagcagcggcaaggagcaaatttgcataggtctcctcggtcctttgttttatttttctctttatatatttttttacctctactttggtgattgattataagattataacttgcatgctgatgaacctatattcactgaaattgatttgtgaagaaatctggaaaaagagtaaaccagaggaagaaaaccgctgaatctgtatgtgactgtctgacatagagtgctattatttccctctgcttagagatgaactaaaaagaaaggaaagagaaaaaaaaaaaaaaaaaggaactattgactatgggctaaccttttgtcaggttttctttggagtggccagtggttatgttggttgtataggta

SEQ ID NO: 2168 - DNA, 266 bp, Gossypium hirsutum
  Clone ID: uC-gsronu33B082a04b1
gggatgacccttttcatatgagagagcagtagcttggaaagtgttgaacgaagaagagaatgctcattgtatctgctttatgtttgtcaactggtcttttgtctaaaactctcaccccaaaaaggggagacaaattatcctatcctgttttgttggcttgatgtttatctatctgtagtccgtaaaactttttatgctaaatcatcatgtctgttattcctctatacttttaagacgactgcttaatgttatgacaatcttatgct

SEQ ID NO: 2169 - DNA, 300 bp, Gossypium hirsutum
  Clone ID: uC-gsronu33B082a08b1
gaaggattatggctacactgtgtgcgttacactggaccggaatgggtttacgaatgcccatatcctgactgggcatcactcacttaatttcactcttctttatatatttccgagaaaatgcggtgccgtgccaaccattcttggaattttctgaaagacaattcattttgaaaatttgttgtagtaattgaagatgattcagtttctaactgcgaatgtacaacctatttgttatcattcaaatgctgatatgtatttcataaaattacatgccgagttgaagcttctttcacttatatc

SEQ ID NO: 2170 - DNA, 488 bp, Gossypium hirsutum
  unsure (1)..(488): unsure at all n locations
  Clone ID: uC-gsronu33B082a09b1
ctcctctcgtccgcccacgcgtccgatggctgggttggaccatgcgagcaagtttctttgttgtatgaaggcttcggaattggaaatgcctccaactatgattgtgttaaaagttttactcaacttatgtggcctgaaggtcacccacacttttgcgacactatatataccatgggaacacaaatggaggagctaaacaagttaatctggttaatgctaattgatagctatggattaggagatgactcactgaagttgaactacacaattggtgcggatgatgaaatacatggctcctccaccaggggagtatgagagaggactttttgctcatactgataaaccagtcagtacacttatttgtgaggatcaagtttcaggattggaaattgaggtcaacgacggccaatggatcaagttgaccaatctatctncttcttcttttgtttttgaagttggagatcctctcaaggcatggagtaatggga

SEQ ID NO: 2171 - DNA, 409 bp, Gossypium hirsutum
  Clone ID: uC-gsronu33B082a10b1
tattcttacaaaacaataatctgactgggcgaataccggatagtcttgtaggaaaacctggactggacttgaggacttctggaaatcagtttttatccccgtcaccttcttaagtagattgtacatgcgttcagaggtaacatcacacgattgcaatgatcaaaatactcgatttcactgaattctgtatcaaaaaggcatcatcttggtctgaaattttggcggaagctccaccattgctgtctgtttgattgcaaagttgtctcctattctgcatgttggagcatcctcagttttaattatactagaaatagttggccatgttcagctagtctgttctttatttactcaaatacgaaatcatttctggaaataatagccatttactccttttttttctttaccaatt

SEQ ID NO: 2172 - DNA, 477 bp, Gossypium hirsutum
  Clone ID: uC-gsronu33B082b02b1
gaaaatgggtgaaaaaagtgaggatcaagcatagatggaaaacatgggagttctaggcaaggtggtggattaccttctattgttatcattcttcagcatgacattaacagctcagttggacatgcccgagtgcatgctcccccacgcctacaatcccttctatcaagtttataccacgttaacccaagattatttggtgcttgagcagcctgcttttttcaaggcacttatgacgttggaacttgttcaccaactccctctcgctttgcttaacatctatgggttgttatactctaagccctggttcaacaccacctgcctcctgtttggtgcctctatcgctgcctctacgacagctatggtgggagacattctcaattcccagaaggcatcagccaatttgatggccatgtattatccaccgtttcttccattaggggttctggctatagtgcgaggggtggttggacaatcgag

SEQ ID NO: 2173 - DNA, 219 bp, Gossypium hirsutum
  Clone ID: uC-gsronu33B082b05b1
cccactcgttcgtgacgttctgagcttaacatgttctcatgagattttcgccgctgctggtagtaccataggttgtagacacagttttgtaagttagagggacataaccaaagatggactttgttttatcgtttaaaaagtcttttagggtgattctaatcaaacagttataaatccttcttatatttcaattgcgatttatatttaaagtttgatttg

SEQ ID NO: 2174 - DNA, 239 bp, Gossypium hirsutum
  Clone ID: uC-gsronu33B082b06b1
cccactcgtttgatttgaggtttaattgaagttgggcagagggcagagcaagcaacctccgacaccgatcgagggtgagaacgagaggtaagaagatgggatggggaagcaaagcgggggattgggcgttcaaagggctcacagctggtctggggttggccaccatttacctaactgccactttctctgttaatgtttaccgaggcctcgcctggcacaactctcattccaaaattgag

SEQ ID NO: 2175 - DNA, 530 bp, Gossypium hirsutum
  Clone ID: uC-gsronu33B082b08b1
gctttggaactctaccagcgaaactgtaaccctgagtggcaagaaagtttggcaaggctctcatgacgcggatttcccggaaaccattgaagatggagatgtgggtgagtttacgcatgatgcagtgactgagcagaatgatgttccaggttccatggttggtcttgtgtacaagctacatgatggaactaggtggattgttgcttggagcaaccctcaaggtgaagacagcaaggtctatactaatatccacaaagaacctattcgttgggagcaaatcaaaaccgatcttgacacaagaggaagctcaaaatctaaagttagaaagtttgggtacgttgcatcaatggaaattgatcccaagaaacgttcgccgacactgaaggcatcatttgagtcagaggcataactgtgttttgcatgctgatcaaattggtgtggtaatgaaggctatctaaaataaataataatgtgcttcccgctgggtgcattgcctataccactactgtactaaatatgatacccagtag

SEQ ID NO: 2176 - DNA, 606 bp, Gossypium hirsutum
  unsure (1)..(606): unsure at all n locations
  Clone ID: uC-gsronu33B082b09b1
ttccactcgtccgcccacgcgtccgcccacgcgtccgcccacgcgtccgcccacgcgtccgcaacaactcaagttgaccttcgaaaagatgaatcatctgtgacaccaggcgcttctcttcctcagaagctcgtgttttacagcacaagctcggcaagtgggcatgatttacttccgaacgaacaccgtcggaaggacctcaaagcttctctcatgaatgacctaaagagtgaagatgaataccgatttggaaggtcatcaaacaatgatggatttgacagcttagaaagcatggtaagaattaaggaagcagaagcaatattgttccaaagcaaggccgatgaagcacggagagaagtggagagctacatgaggatgatccgggccaagtccgaaaagttggaagaggaatatgccgagaagctatcccgactttgcttacaggagacagaggaaaggcgaaggaataaaatggaagaacttaaggttttggaacattcacagtgtgattactacaaaatgaaacttagaatgcangcagagattgccagtttggtggagagaatggaagcttcaaagcagcaatggggttaacccttttctttt

SEQ ID NO: 2177 - DNA, 199 bp, Gossypium hirsutum
  Clone ID: uC-gsronu33B082b11b1
actgatcattttcacaggttaaaacacagtatgactaaggatattgtgaccacggcggagcaaggcggcggagcgaaatcctgagcgaaggactaccaggacccaccaccggcaccgttgattgacttggaagaactcaccaaatggtcgctttatagggcggttatcgctgagttcattgccacccttcttttcttgt

SEQ ID NO: 2178 - DNA, 257 bp, Gossypium hirsutum
  Clone ID: uC-gsronu33B082b12b1
gctctctctgtcttaacgctataatcattgaagaaaaatgggtttgaaggaggaattcgaggagtatgcggagaaagctaagacccttccccagaacactaccaacgacgacaagctcattctctatggactctacaagcaagctactgttggaccagtgaacaccagccgtcctggaatgttcaacatgaaggaaaagtacaagtgggatgcatggaaggctgttgaagggaaatcgaagaggaagcactgaacga

SEQ ID NO: 2179 - DNA, 121 bp, Gossypium hirsutum
  Clone ID: uC-gsronu33B082c01b1
cccactcgtccgcccacgcgtccgtttctactgagaggagcgccaaattcattctcaaaatgcaaagcagttaacagtattgttcaacattgatttcaagaaatggatcattattgtttcc

SEQ ID NO: 2180 - DNA, 534 bp, Gossypium hirsutum
  unsure (1)..(534): unsure at all n locations
  Clone ID: uC-gsronu33B082c03b1
ccctcgcgttcgcccacgcgtccgactttggggagtctttgtggtcccaggtattgcaagttcaagaaaatctgggttttaacactctttatgatggttctgatagtctgaatatgcattggtctgaaataaggcgttgcattcctggttctattggttctgatttttctgcaataggaaatattggtagaggctcactggtgagtcctgatatttcccgtaataatgtaggctttggggaatctttccgattccgtaaggtcttgcaaggtcaagaaatttttgtgtcccctccatatagaaacggttcaactgcagatgaaaatgaagaaaatgacgcttttggtctccctgatgttggtcagttgtcgggaactagaagtggatggtcttncttgatgcataggtataatactcatcaccactatcttaatccatttcttatcagattttttcttgaaagaacctaacaattagttcttactgtccccacgcaacttatcatgtttttccctgtttttccctcttgggctc

SEQ ID NO: 2181 - DNA, 253 bp, Gossypium hirsutum
  Clone ID: uC-gsronu33B082c04b1
ccctctcgtccgcccacgcgtccgctttctgactcattcccctacaaggaaatcgagaatgggatgctgtgggaagttgagggaaagtgggttgcgcaaggagctattgatgttgacattgtggcctatgcttcagccgaagatgctgatgaggatgaaggcgttgatgaccaatctgtgaaggttgctgacattgttgacactttcaggcttcaggagcaaccccctttcgacaagaagcagttcgttgtgt

SEQ ID NO: 2182 - DNA, 243 bp, Gossypium hirsutum
  Clone ID: uC-gsronu33B082c05b1
tttatcttttaaacaaaaatagatatttattatgcaggcagggtgttctacagtcatcacctcagtaccacacatcatcatatagagtctctacgcaaccaataccagacgtacggggacccatggttaggggaacttccgtttttctatgagctacaactcatgactcgaagcagatgcacagcattcatctgtccctgcgcggcacggccaccatctagatgggcaagaacaccacgatcc

SEQ ID NO: 2183 - DNA, 470 bp, Gossypium hirsutum
  Clone ID: uC-gsronu33B082c08b1
cgcagtaacccattggcctggtgttggatatatctgaaaagcatttgacaactttaagaaattagatgcagaaaaagagcatgtgttcaatggaagagccaaaaaacaggacatgcgttcttcatcagctgacctgtccatgattttggctctctttttcggcagagcacagcatatattacaagaagcagaggccatactttcaactacgattttttcatctgccaaaaatattccaactcaagaaaaatggtaatatatggttcccatgccattgacagattttcttggagtcgtgttggagagagcttactgctgcataaaacctgaaacatacatgaaatgtcagatatccaagtgatttaaacatgattcagtcatattcacttgtaaaatactaggattcggtcatagtagccgggtgagaccttgcagatttttccttgagaagtttcataggcttgtttatc

SEQ ID NO: 2184 - DNA, 451 bp, Gossypium hirsutum
  Clone ID: uC-gsronu33B082c09b1
gctttccaatacaaagcttcatattatcttttttagttccgacaaaagaaaacgaaaaaaatagaagaaatacaatcgttttctttttgaagtcgggttttagtttttggggagaaaaaaatgttgggagtatttagcagtgcgatagtgtctccgccggacgagctggtggcggccggttgccgaactccatcacctaagataacggcggatgctctggtgaaacggttccttgagacgaactcctccggcgtgtccatgcagatcggagaccatgtccaattcgcttattctcaccataaagagtctcctttacggcccagatcatttgctgtgaaagatgaaatcttctgctcgtttgagggagcccttgataacttggggagtttaaagcagcaatatggtctggcaaagtcggcaaatgaggtgattttggtcattgaagcttaca

SEQ ID NO: 2185 - DNA, 471 bp, Gossypium hirsutum
  Clone ID: uC-gsronu33B082d01b1
aaattttattaaaaaaaaaaaaaaaaaaaaaaaaaaaaaaaaaataaaaaaaaaaaaaaaaaaaaaaaaaaaaagggagaacgttttaaaggttacactgatatattgacgcaatcttcttttgtggggcgcccttttttggggcccctgttttccttcccctggcctgcgtgttcatactttttttttggggaccccttttttttttccactggcggggtttttacaccgtttggtctgtaaaacccttgggtttccccatttttttccctttgggacaatcccccttttcccatgttgtgtttttttggaatgggccccccccgttggcctttcccattttttgcgcccctttattggtttttggacccccccttttttgggttttttatgcccggggggtggggggttttcccccagtgtactcctttctttggccaggccctttggcccccctttttgctttttttc

SEQ ID NO: 2186 - DNA, 482 bp, Gossypium hirsutum
  Clone ID: uC-gsronu33B082d02b1
tcacatgccacctcatcaatcctggggtccacctcaaggtgtccctccaaatgctagtggaggttctggttatggtcataatcctctgtacatgccaccttctcggcaaatggacaattactaccctcctgctgatatgccacctcatatggaaaaacagccccatcagggtatttctgcctatggaagagaggtgccaatgggtgcccatggatcatcaaatccccagaatgcaccatcaatgatcacacaggtcactcagcaaatgcaaattccactatcttatgctgatgctgttattgggacagctggtgcaagtattagctatattcgacgtgctagtggggcaactgtcaccattcaagaaacccggggtgtccctggtgaaatgacagtcgaaataagtggaactgcttcacaagttcaaactgctcagcaactgatacagaattttatggcagaagcttgtgcggctccagctc

SEQ ID NO: 2187 - DNA, 394 bp, Gossypium hirsutum
  Clone ID: uC-gsronu33B082d06b1
cccactcgttcgcggacgcgtgggattgccggtcacctcgacatctacatcttcatcaaccgctaataactcagccccaccgaagttcccttgggaattcttcgattaaagacagtatgctactatgtcctctttggttttcattgcattttttatctgtgtgaatgtgattcgggcttgcttcttcttgttgtacttagattttctcaagcatcccttttcttttcttttttttcccactttcataaaatctggcattaagctcatcagacaaaaaatcaaaacaaactggggcgcctccatcatttaaaaaaaaacaaccaccctgtttctattctcttttatatcccagtctgtaatgtccttttgatgggagccgaaacttgggattctc

SEQ ID NO: 2188 - DNA, 124 bp, Gossypium hirsutum
  Clone ID: uC-gsronu33B082d07b1
cggacgcgtgggtgccatcacttggaaaatcgggccagaccctcttggggttaaatctacagcagcgcaaggcaaccagcagtggggcagctgacctgctatgagagcacctatggtggtggga

SEQ ID NO: 2189 - DNA, 467 bp, Gossypium hirsutum
  Clone ID: uC-gsronu33B082d09b1
tttttacattgatgagaatatcaatgctgctgctattgaaacaaccttatggtcaattgaatggggcattgctgagcttgcgaaccatccagagatccagcagaaactccggatcgaaatcgacaccgtactaggacccggtgtgcaggttaccgaacccgacacccataagcttccatatctgcaggcagtgatcaaggagacactcaggctccgaatggccatccctctactagtcccacacatgaacctccatgatgcaaagcttggtgggtatgacatccctgcagagagtaagatccttgtgaatgcatggcggctagccaacaacccggctcactggaagaacccagaagagttccggcccgaaaggttcttcgaggaggaatcgaaggccgaagcatatgggaatgacttcaggtatctttcatctggtgttggaaggaggagctgtccagggattattt

SEQ ID NO: 2190 - DNA, 525 bp, Gossypium hirsutum
  Clone ID: uC-gsronu33B082d11b1
tcctctcgtccgcccacgcgtccggaaaatatgggcaaaaagtggtcaaagggaacccatatccaaggagctactacaagtgtacacatccgggatgtccggtgagaaagcacgtcgaaagagcatcccacgatcttaaggcggtgatcacaacctacgaagggaagcacaaccatgacgtcccagcagctcgtggcagtggcagccattccgtcaacagacctttactcgacaacaacaataacaatggggcaatgacaataaggccatctccacttaacaatcccatgagcaacaaccaagctcttcggggtttgaggcaatcgacaaccgaaggtgaatcccctttcatgctagaaatgtttcaaggcaacggaaacttgggattctcgggtttcgggaactcgggagggtcaattatgaatcaacatgatgtaaacaacatgttttcaagaaccaaggaagaaccaagagatgaagccttcattgagtccttgctatattgaaattaaaatctacaaaagg

SEQ ID NO: 2191 - DNA, 233 bp, Gossypium hirsutum
  unsure (1)..(233): unsure at all n locations
  Clone ID: uC-gsronu33B082e01b1
tttatatttagtttttgtttttgtttttgcttttgtgtgatttgggcttattgggcccggtcaaatttgggcatttacacatgttttgtcaaaatgaccctaattgtatttttgagccttttttggccttcaacctttgttctatttttatttcaatctatattttctaatanaaaaaaaaaaaaaaaaaaaaaaaaaaaaaaaaaaaaaaaaaaaaaaaaaaataaataaaa

SEQ ID NO: 2192 - DNA, 125 bp, Gossypium hirsutum
  Clone ID: uC-gsronu33B082e02b1
gaagattgttcaatggaattcatttgattggttggatatgattgtgagtgtaaatagtgacttataatgttgctttttggatgataattagcttagttaaaataaagttggctgtgaatgatgaa

SEQ ID NO: 2193 - DNA, 324 bp, Gossypium hirsutum
  Clone ID: uC-gsronu33B082e06b1
cccactcgtccggagaatatgaagttcattggctgttttctggtgtttcttgctattttaggcattgccttgcttaatgttgcagaaggagctggtgaatgtgggagatcatcccctgatagggaagcctggaaggtagctccttgtgcaatggttgcacaagattctaacgctccagtttccagcagttgctgccaacaggtgaagaaaataggccagaatccgcgatgcctgtgcgccgacatgctttccaacacggataagagttctgggatcaagccggatattgctatcactattccataacgctgcatcatggctgat

SEQ ID NO: 2194 - DNA, 273 bp, Gossypium hirsutum
  Clone ID: uC-gsronu33B082e07b1
cagaattgcaaatggagattctttctcaacgaccatcttctttctcaactttgaatcccaacgctccattgtttgttccgttagcgtatcggacggtggaggatttctctgatgagcggtgggcctctcgtccaatcctacccgtgtttccgcgactcctggcttcaagaacgtttccacgatccccaaaacgacgacgccgatcttctttttcccgacgatcttgatgccgtctttgacgattacgacgactttttcgttgtccctacctgt

SEQ ID NO: 2195 - DNA, 209 bp, Gossypium hirsutum
  Clone ID: uC-gsronu33B082e08b1
gtgacgcccctgggagaccatgggtcacacttgattcatctctgaatggtcagattatatcatttgattcagttttctttgttattaggattctatagtctaaacctgttctgtttttgcatgctatatgttgctgaagcctgttaaaaattgtagtctctttctatcttttacttagccctatgagtatattcaactgtttttctcgt

SEQ ID NO: 2196 - DNA, 313 bp, Gossypium hirsutum
  Clone ID: uC-gsronu33B082e09b1
caaccgcgcctaataaccgctcggatttttctcagacgtgaaaaaaatggggctgtctttcaccaagctattcagccggctatttgccaaaaaggagatgcgtatactgatggttgggcttgatgctgctggtaaaaccaccattctttacatgctgaagttgggagagattggcactaccattcccaccatcggcttcaatgttgtgaccggtgaatacaagaacatcagcttgactgtttgggatgttggtggccaggacaagatccgaccattgtggagacacttttttcaaatcatgcccggccttatt

SEQ ID NO: 2197 - DNA, 502 bp, Gossypium hirsutum
  unsure (1)..(502): unsure at all n locations
  Clone ID: uC-gsronu33B082e11b1
cccacgcgtccgcttccacttaaaagcaagttagctagctagggtctttgtgagccagacagatgggttcaaaaagaacggcatcactagccctgttctttgcactcaacatcctcttcttttccctggtgagtgcttgtggttcctgcccttcccccatccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcagcttgcttcttaatgtctgctcaaagaaagtaccctctggcttccaatgtcgctaaatcagntctctaaattctttctcttc

SEQ ID NO: 2198 - DNA, 302 bp, Gossypium hirsutum
  Clone ID: uC-gsronu33B082f02b1
gaaattcggtgagttaacaatggaaaccaattgtctttcgaagctaaatcggaaacctctgcttcaacatcaatcccacatgcagtagctgaaacagcttcctcttctactgttccactgtgagattcttttggcttatgaaacagggagaagggaaaaggggttttgattatttaagttactgaattagtttagctagcctctgatatagctatgatcaaaggccaaaactttggctactgtatcatttaaacagtctggttttgctcactgaatgtcttattagatctcttctatccaaa

SEQ ID NO: 2199 - DNA, 227 bp, Gossypium hirsutum
  Clone ID: uC-gsronu33B082f03b1
cccactcgtccgggtttggctccaggaagaccagcgccgccatccgtacagctcttagccacgttgagaacctcatcaccggtgtcactaaaggataccgttacaagatgaggttcgtctacgctcactttccgattaatgcctccatcactaatggcaacaagtcgatcgagatccgtaacttccttggcgagaagaaggtccgtaaggtggatatgttggaaggt

SEQ ID NO: 2200 - DNA, 613 bp, Gossypium hirsutum
  Clone ID: uC-gsronu33B082f08b1
cccactcgtccgattggacccaaattcttgaatgccagcgttggtttcggcggatcctgtttccaaaaggacattctgaatctagtttacatctgtgagtgcaatggccttcctgaggtagctgagtattggaaacaagtcattaaaatcaatgactaccagaaaaaccgtttcgttaaccgcgttgtgtcatcgatgtttaacaccgtttcaaacaagaagattgctattttagggtttgctttcaagaaggatactggtgatactagggagaccccagccattgatgtatgcaaagggctattgggagataaagctcggttgagcatattcgatccacaggtcactgtggaccagatccaaagggaccttaccatgaaaaaatttgactgggatcatccccttcacttgcagcccatgagtcccacaactgtgaagcaagtcacttgtgtgtgggatgcttatgaagctacaaaggatgctcatggaatatgtattctaactgagtgggatgaattcaagactcttgacttcaagaggatatatgacaacatgcaaagccagcttttgtcttgatggccggacattgtaacgtggacagctgaggagatgg

SEQ ID NO: 2201 - DNA, 451 bp, Gossypium hirsutum
  Clone ID: uC-gsronu33B082f10b1
gtcatgtgagaaacgtaatgatagagaatattgataaagttttggagagaggtgatcggttagaattgctggttgacaaaactgccaacatgcaaggaaatacctttcgcttccgaaagcaaactcgccgttttagaaacacagtatggtggagaaacgtcaaacttacggttgctctaataatcctcctcctaataattatttatgttgtgctggcttttgtttgccgtgggatcacactaccttcatgcctaaaatgaggtcaagagcttgagattcaaactccttcggtacttgccccctttcctcttgcttatagttttatttgtttgtttttagttatatataatatttatattgagttgagttgagttgattttattgcttatttatccaatgtgaagagctagaaatgctatgcttggtcctgtgttaccatgtttttttagga

SEQ ID NO: 2202 - DNA, 446 bp, Gossypium hirsutum
  Clone ID: uC-gsronu33B082g01b1
aaattgtgaaggagaacttcgactttaggcctggtatgatcaccatcaacctggacctcaagagaggtggcaatggtcggttcttgaagacagctgcttacggacactttggaagggacgacccagacttcacctgggaagttgtgaagcccctcaagtgggacaagccccaatcttaagttcagccctgctgcctgtctcagtgcctgcttatccatagtactgaataatattgccttgctgctcacctatactctattttcatccccagaatgcttctaatctcattcatatagtgccctattcattatctttttttttttttctattttctccctttatttgttcttttttttttttgggtattctgaagttgtgtcctgtatcaatgtcgtgttgcaaaaatgtattgagaattttgctttaatatattaatggcacttgaa

SEQ ID NO: 2203 - DNA, 399 bp, Gossypium hirsutum
  Clone ID: uC-gsronu33B082g02b1
gccgttgctttacacttcccttctctcacctcttccagaagccagaagtcagtttagtagcaatggcgtatgctgcgatgaagcctaccaagccgggtttggaggagccccaagagcagattcacatgatccggatcactctctcctctaagaatgtgaaaaacctagaaaaagcttgtgctgatctggttcgcggtgcataggataagagactgagggctaagggaccagtatgaatgcccaccatggttcttcacatcactaccaggaagtctccctgtggtgaaggaacaaacacatgggatcggtttgagcttcgtgttcacaagcgagttattgacctattcagctcccctgacgtggtgaagcagattacatctatttccattgaacccggtg

SEQ ID NO: 2204 - DNA, 527 bp, Gossypium hirsutum
  unsure (1)..(527): unsure at all n locations
  Clone ID: uC-gsronu33B082g04b1
cccactcgttcggttctatatgatcatgcagtgcctgggtgctatctgtggagctggtgtggtgaagggattccaaggagataaccgatatgagatgttgggtggtggagctaatgttgtgaaccatggctacactaagggtgatggtcttggtgctgagataattgggacttttgtgcttgtttacactgttttctctgctactgatgctaagagaaatgccagagactcccatgttcctatcttggctccacttccgattgggtttgcagtgttcttggttcatttggccaccattcccatcactggaactggtattaacccagcaaggagtcttggagctgccatcatatacaacatagaccatgcttgggatgaccattgggtgttctgggttggacccttcattggagctgcacttgctgcagtttaccaccagataatcattagagctattccattcaagaccagagattgaaatgattaaatctgngtgtgtgtgtgtcgtgggatcctcatctactttt

SEQ ID NO: 2205 - DNA, 550 bp, Gossypium hirsutum
  Clone ID: uC-gsronu33B082g05b1
agactttctttggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccatggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagcccagtgtggcccgaataaatgtttgtttactcagtttctttttcag

SEQ ID NO: 2206 - DNA, 330 bp, Gossypium hirsutum
  Clone ID: uC-gsronu33B082g06b1
cccactcgtccgcccacgcgtccgtctcaagggccattactctcctctctgagaacaatcctctcactggtagcaagggtgagatcaggaagcaatgcaatcttgcaaacaagcttcactaaaatgcctcgccaaagagaaagccgagagtggccgaataaaatggttgcttacttgtttcttttccaagagacaagtttgttaatgcgcagcgagtaatggcgcaatggtactagtttgatacgatcgacccattgcatttttttttagcataagccaggttgccttctcttgatgttggtcatgggcgtagtggatgtagggatggat

SEQ ID NO: 2207 - DNA, 126 bp, Gossypium hirsutum
  Clone ID: uC-gsronu33B082g08b1
aaccaccactacctcacccttgaagggtgggttttttttattacggcacctccatatccttcggagtagcaaaacatataggcctgtatccaagcacagctaatcaaaacttctaagaccacgata

SEQ ID NO: 2208 - DNA, 434 bp, Gossypium hirsutum
  Clone ID: uC-gsronu33B082g09b1
ttgtttccctttagaactagcaatattagagatgaaatgatacataatattcatacacagataaataacttaaacatgacaagaagatgtgttattcaaaatctgtaaattatgaattattatacgatgatgacatgactattagcagaacatggcatagatacacaaattactaggtaacattttttcttttctaggaaattgactcattatttgcatgatttggccatttgaacgagatgaaatatttgttctagtgttgcccatttcatatgttttgccaagatcaattgcttgacatagaatagttaagaaagcgataagatatatgctttaaggatcttttagtcttgtgtttctatgttatatttgctacattaattgcttgtgtgatgctttctccatttttgcacgagctggtggaaattgttatg

SEQ ID NO: 2209 - DNA, 400 bp, Gossypium hirsutum
  Clone ID: uC-gsronu33B082g11b1
ttcttccacacacttgctaatattgctacttggagtggtggctattgccactccctctcctggcaccttggagtcaacgtacatcgggaagcgcacctctgacggctaggatcgtaagcagatgcagccctggcttaatgaccacccaagagactacacctgggaaggccacagccacgaataatatacggaggatcgcgatttctaaccaactgaagaaggaggagactgtagcttgggtccgctcgaaatagcccttcatagctagagatgcctgaagcccatccaccaatgtattgaacctagcaagaaggaaaagcctgagcctaagcctccagttcttacaccaccaaagacagtgaagcctgcccccaaccaccattatatgatacccccacga

SEQ ID NO: 2210 - DNA, 557 bp, Gossypium hirsutum
  Clone ID: uC-gsronu33B082g12b1
ggatgatggctactttggcggcggctgcagctcgtagagcagctactctagctcgaacaccccttccatctcaacccgcttctctcattcctcgccgtggtcttgccggcgccgcagatcaccatggacctccaaaggttaatttttggcatgacccaatgagcccatctaaatggaaggaagaacattttgttatcgtctctttaactggttggggtctgcttttctttagtggatacaagttcttcactaaaggcaaaggcaaaaaggaagagaacgcggtggaagcaacacactaacgaggttggagtttttattttatttttataagatctcaagtaataatgtatgggtggaactttcatgtccttgggatgcttttattggcaaattattcagttttcttgttcatcatttcttttatgacccattagtaaaacttggaggtccgctgtacctggttctgtgggcataggatgtaacagtttcttgaaactcaaaatccgtctgttgatggatttgaaaagctaataatgaagtctgcttttgtgcatgct

SEQ ID NO: 2211 - DNA, 402 bp, Gossypium hirsutum
  Clone ID: uC-gsronu33B082h01b1
atattcttcaatggctacttcttcatcatgttcctcgttgaaacaacacttccttgtatttctcattgtaataataagaagcattattaattcaccagtaaatggatgtttcacatcgattttcagctttggtgattcattaactgatacaggcaatttacttgagatttcaatttcagaacccaccaaaactcctcattctgcttttcttccctatggccgcaccttctttcaccatcccaccggccgattctgcgatggccgcttggttatagatttcctcgctgaaactttgggattttcctttttaccaccattttatggatctaaaagtggaaaatgggagatattccaaaagggagcgaattttgcagtggcgagtgctactgcactgaattcgtc

SEQ ID NO: 2212 - DNA, 430 bp, Gossypium hirsutum
  unsure (1)..(430): unsure at all n locations
  Clone ID: uC-gsronu33B082h02b1
gttgatttgtaagcaaattttggtaaagttcttaaatattggagtttagatcttctttgagagtgccgctatgggagtgaagggttttgttgaaggaggcatagcctcaatcgtggccgggtgttcgacccacccgcttgatttgatcaaagtccgaatgcagctccagggtgaaagccatgttcccaatccggctgttcaagcactccgccctgctttagcctttcagacaaccactactaccacctgctctgctatccacatgcctcctccgccggcgcgtgttggacctgtggccaccgggatcaagatcttccggaccgaaggcgtcgctgctcttttttctggcgtctctgctaccgtnctccgccagaccctctattccaccacccgcatgggactctacgacatcctaaaacagaagtggact

SEQ ID NO: 2213 - DNA, 445 bp, Gossypium hirsutum
  Clone ID: uC-gsronu33B082h05b1
cgtttttgttccaacggacaatgctttctccagccttaaatcgggcacattgaattcactcaccgatgaacaaaaagtggagctggtgcaattccacatcgtcccaacatacctcacctcgtctcagttccaaaccattagcaatcctttgagaacccaagctggtgatagtggcgatggcaagttccctctcaatatcaccacttcggggaactccgtgaatataacaacagggttgacaaacaccagtgtttccggcactatttacactgatggtcagcttgctgtttatcaaatcgatcaagttcttcaaccattgcaaatatttgcacctaggcctccagctccagcaccggcaccggctaagtcgaagaatatgaaggctaccaccgttgctgatagccccgatgttacccctgctgattcctccatagcggtccccttg

SEQ ID NO: 2214 - DNA, 365 bp, Gossypium hirsutum
  Clone ID: uC-gsronu33B082h07b1
aaaatagatagagagagaaagagagagacaaggaagctttactgtgtttggacaactgtgtcaactcggacgattccttgcctccttttacactccccccccactccctgattcgttctctttattgaactcgtccacttgagattttatttctgtctttttttcttcgaaattaaagttcaatcggcatttctttgttacttttccttcagatctcggattttggttttctgggcttcctttctgtttatgggtgctaaagatggctcatttaatgcagtgtagggatagatcttcattttcttctgcgatctgttgtctgggattttttttctttgctcttttctcttttctctttagcttct

SEQ ID NO: 2215 - DNA, 537 bp, Gossypium hirsutum
  Clone ID: uC-gsronu33B082h08b1
ctgatatcttgtcgaatgtgaagttcatacaagaaaagcgattaattggaaaatactttgaggagataagccaggatactggaaagtatgtgtttggcatagatgatacgttgaaggctctggaaatgggtgctgtagaaacccttattgtatgggaaaatctagagatcaataggtacatgctaaagcacagtgtaaccggagaaattatcataaaacacctgaataaggagcaggaggctgatcagagcaacttccgtgatcctgaaacctctgcagagttggaagttcaagaaaaaatgcccctgctcgaatggtttgccaacgagtacaagcgcttcggttgctctcttgaattcgtcacaaacaaatcccaagaaggatcacagttttgcagaggcttcggtggcattggaggtatcctccgctatcagcttgacataagatcattcgatgagctatctgatggagaagtttacgaggattctgaatgataaagcactgcttaaagatggtatgatggctcgagagcctata

SEQ ID NO: 2216 - DNA, 187 bp, Gossypium hirsutum
  Clone ID: uC-gsronu33B082h10b1
ggattctgatgccgaaggcagcaagatggaggaagttgattaagcctaacatgtttttatatgaactctaatcagtagatttatcgtacttttgaagcatctgttagcttgttttacattttgtttggtgcttttgttagttattttcgagtacttttaaatgataagtgctgtttttttctgggat

SEQ ID NO: 2217 - DNA, 483 bp, Gossypium hirsutum
  Clone ID: uC-gsronu33B082h11b1
ccctctcgtccggcttctcagcctcatcgcagtgtctgtactgctgatggtaactccagtcattggataccgtccatggcctcacttaaaacccaacagctccgatttaacgtttggaagctccaagaaattcgagggctcatcagagttcgtccaaatgagataccatatgggaccagttctcaccgccaacatcaccgtacacatagtttggtacggccgatggcaaaaatctcagaagaagatcatccgtgagttcatcaactcaatctccgccgttgatgccaagcgcccttctgttgccggctggtggaagaccgtacaactttatacggaccaaacgggcgccaacatttcccatactgtgcatttaggggaagagaagaacgaccgattttactcgcacgggaaaaaactgacgcgcttgttgatacagtcggtgattaatagcgcggtgacagcgagtacaaagccggtgccgat

SEQ ID NO: 2218 - DNA, 211 bp, Gossypium hirsutum
  Clone ID: uC-gsronu33B086a03b1
ccctcgcgtccgaagaattgctacttatgaaagagatggaaagctaaagagtctgctaaagaaaacatatttgagacgttgggttggtgcactagatactggaggaaatgaagctgaagctttgccaaatagcatggatttcgttaggtatcagtaaatatcatggacatttgaattgcactggatgtatcatctgatttttagatagatt

SEQ ID NO: 2219 - DNA, 94 bp, Gossypium hirsutum
  Clone ID: uC-gsronu33B086a05b1
gtttagtcttgacgttaccctttgctcccttttggcagaagccaaaagtttgatgttaagaacaatggctcatgctacaatgaagccgaccaaa

SEQ ID NO: 2220 - DNA, 92 bp, Gossypium hirsutum
  Clone ID: uC-gsronu33B086a08b1
tggttttgctagcgttgaaaccatgcttgagaaatggaaaagtaaggagggcaaagagatagaagccgtccaagagttcatattatttactt

SEQ ID NO: 2221 - DNA, 349 bp, Gossypium hirsutum
  Clone ID: uC-gsronu33B086b03b1
atgtcgtcatggaagcaatgtaaacccatgttggtgcgaagcatgtgtaattgatttgggtcaaggcttgaggagagcgtatagaagaccctggctagtaatctatttttttaatatctttattttttgttaattcttatttctttttattatttttttcttttctaaataaatatttttatattcttttcttttttctataaacttttttttatcatttctattttttttcatattttttttttttattttttttttttttttttcataattcttttttttttttttatattatatatttctacttttttttaattttttttatatttccttttttatattttctttt

SEQ ID NO: 2222 - DNA, 164 bp, Gossypium hirsutum
  Clone ID: uC-gsronu33B086b04b1
ccctcgctaccgatgattggaacaccagaagcccttgatctccgaggaaaggctgctgtagctcaagcagccctggcatataggctctaccagacgaaccccgtcaggtccaagatgggaagctttggcgtagaagggtgccaagaaactgaggttcctctttt

SEQ ID NO: 2223 - DNA, 58 bp, Gossypium hirsutum
  unsure (1)..(58): unsure at all n locations
  Clone ID: uC-gsronu33B086b05b1
gtgaattgtaagcccaccagnagttgctagggagaaagcctatttttaacagatccac

SEQ ID NO: 2224 - DNA, 126 bp, Gossypium hirsutum
  Clone ID: uC-gsronu33B086b06b1
cccactcggccggtgttcttaagttattcttgaaaagaaaaatattaaagtttacagtgcctttttaacacctcacaaattttcactattttttaattcacttttctacacttaaccttttctttt

SEQ ID NO: 2225 - DNA, 355 bp, Gossypium hirsutum
  Clone ID: uC-gsronu33B086b08b1
tattagatacgagaaaattatctgtttactttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttagagaaacaaagttaacgtccgcgggattgtaacataaaagtttttttatggggtcactaaaattaaataaatgggccggggttaaaaaacgcgagaaatggaaaaacctgggggtaaccaaaaaaaaattcctggaaaaaaaacccctttacaaaaagaggggaataataagaaaaaaggcccaaaacaaatccctcttt

SEQ ID NO: 2226 - DNA, 145 bp, Gossypium hirsutum
  Clone ID: uC-gsronu33B086b09b1
ctcacgcgtccgcggaatcttgaagttggcattggtgctctttttgaggacggagccaagctcctcgactatgctgattaaaattaacatatcaacaactgtataggcaaatttaagataacataaaacaatacttatacaaata

SEQ ID NO: 2227 - DNA, 205 bp, Gossypium hirsutum
  Clone ID: uC-gsronu33B086b10b1
cctcttagttcttttcttccccattcctttctcaatctggttcatgtctcctttcaatcctttgttgagtttcagcataccccgggacactcattaccaggtacatctcttcctttctttttagagtttttgttgccaaaatatgcacaagagcgtttgcggatcttggtgtgtgtttgaacatgaaacttttggatctgcttca

SEQ ID NO: 2228 - DNA, 92 bp, Gossypium hirsutum
  Clone ID: uC-gsronu33B086b11b1
gtaaaagcatttcatcgtcagccaaaaaaagggaattttagtcttcaggggaacgatcgaacgatgccgtacctactaccacacttgcactc

SEQ ID NO: 2229 - DNA, 87 bp, Gossypium hirsutum
  Clone ID: uC-gsronu33B086c05b1
ttttcctatttatttgtgtagacagatacaatgatgtcaattaacaaagggaaagaaatagctgtatgttcttcgggaccggatgtt

SEQ ID NO: 2230 - DNA, 71 bp, Gossypium hirsutum
  unsure (1)..(71): unsure at all n locations
  Clone ID: uC-gsronu33B086c06b1
atgcgccctcgtgngcgcccacgctgacgttttgctaaaacagaataagtttacgccgcctatttttttta

SEQ ID NO: 2231 - DNA, 177 bp, Gossypium hirsutum
  unsure (1)..(177): unsure at all n locations
  Clone ID: uC-gsronu33B086c07b1
tgatactctgcctgttgatggtgcagaatgggtggacttgtttgtgtgtgtgtcttttattttttctttttgggtgtttttattttttttttttttttttttttttttttttttttttttntctctccttccttcttctttttttttttccttttcttcttttcttttcttcctctc

SEQ ID NO: 2232 - DNA, 106 bp, Gossypium hirsutum
  Clone ID: uC-gsronu33B086c08b1
tattaacacttgtatgaatgaccagaaggataaactctggccaatgttgcaaaagcttggtgtcaccatgaaggctgatgagaaggacttgatggggaagccccta

SEQ ID NO: 2233 - DNA, 109 bp, Gossypium hirsutum
  Clone ID: uC-gsronu33B086c10b1
taataaaaaaaaagaaaaaaagtttaaacaaaatggaaaggtgaaaaattctcttttcatcgatcgccaaaaagcaaccgcgaacccccgtcgatcgcaggagagaggg

SEQ ID NO: 2234 - DNA, 411 bp, Gossypium hirsutum
  Clone ID: uC-gsronu33B086c11b1
tacttaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtcccactttccctcaacttgcttcttaatgtctgctcaaagaaagtaccctttgtcttccaatgtcgctaaattcagctccctaaaatctttctttttttaaggctgc

SEQ ID NO: 2235 - DNA, 123 bp, Gossypium hirsutum
  Clone ID: uC-gsronu33B086c12b1
tgcttaggttggtccctcagtttttgcttgtaggggctggtgaagcctttacatacataggacaacttgattttttcttaagggagagcccaaaagggatgaaaacaatgagtacgggtttat

SEQ ID NO: 2236 - DNA, 175 bp, Gossypium hirsutum
  Clone ID: uC-gsronu33B086d01b1
cttgggtatccattttggcttcttgcagagcctccattgacgagcagctaaatcaacaatgggtcactctaacggatggaactctcacccgaaaacctacggccctggatctcgctcctgccgtgtgtgcggcaacccccatgccattattaggaagtatgggctcatgtgttgc

SEQ ID NO: 2237 - DNA, 131 bp, Gossypium hirsutum
  Clone ID: uC-gsronu33B086d03b1
atctcatactttctcttctatcaggcaacccattttgattctttttttttgttaataagaaagtttctttcactgaaggaattaaatcatgcttatctaaaattggacatttctctatttttactttcctt

SEQ ID NO: 2238 - DNA, 208 bp, Gossypium hirsutum
  Clone ID: uC-gsronu33B086d05b1
atttattttaaaaaaaaaaaaaaaaaaaaaaaaaacattaataattagaaagattttaaaaaaaaaaaaaaaaaaaaaataaaaaaaaaaaaaaaaaaataaaaaaattgggggggccgttttagaggacccaagttttcttcccgtggcttgcaaaaaatttttttttttttggggtaacttaaattaaatcaatttggccgcgttt

SEQ ID NO: 2239 - DNA, 209 bp, Gossypium hirsutum
  Clone ID: uC-gsronu33B086d08b1
ttcctcgcgtccggggagcttcgatttcgtatttgtagatgcatacaaaagcgactacctaatattttacgagctgacgcttaaattagttaaggttgaaggaattgttgcattattaaaacacatatttttttgtttttattattttatctactattatatcatttaatatttatcttcatttcatattaatttttttttctttttct

SEQ ID NO: 2240 - DNA, 177 bp, Gossypium hirsutum
  Clone ID: uC-gsronu33B086d09b1
tgatttcgttaacgagatcctgacccgattagctgaagctgttaactcaaaaggtagctcagaacagaggttgatggagtacattcttttatttcttaaatctatttttaatttattattaaaaatattatacattttttttttttttttatcaatatttttttttttttttattat

SEQ ID NO: 2241 - DNA, 298 bp, Gossypium hirsutum
  Clone ID: uC-gsronu33B086d10b1
tgctcctgctcacaaagtgatttttcagattgaagccatggctgaagatgtgcaacctttgttatctgaacttcgtgatagtggtctgctttaggaggttgagaattttaccagatgtataacacaagttctttgctgattcatgtctaattcttttttttttttttttttttattttttcttaaatcttttattatttttctttctttttatttcttccttttttacttattttttattatttcctctttcactttaataatattttattttttatttttcatatttttttcatttt

SEQ ID NO: 2242 - DNA, 302 bp, Gossypium hirsutum
  Clone ID: uC-gsronu33B086d11b1
ttctacgcgtccggtttggaggtcaagtgaccgatgaagaatttgaaagcttaaacaaacggaaaccttgttctggatataaaatcaaggagatgaccggtagtggtatttttgcagccgatggagaaaatgacgaatcagaacctggtagtgcaaatcctactccaaacaacaaaacagcattactaatgttccagtaatctttagctggaattagttacatttcgttttgcctaggaagagagaattacatccaaatagtcaacttctcttcctgaggtggcgaagttgtgttaattgtg

SEQ ID NO: 2243 - DNA, 255 bp, Gossypium hirsutum
  Clone ID: uC-gsronu33B086d12b1
tccctcgcgtccgcccacgcgtccgcccacgcgttcgtgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgcggatcaaactgttcttgtgatccatgcaactgttgaaaagcttgatgaaagcccta

SEQ ID NO: 2244 - DNA, 79 bp, Gossypium hirsutum
  Clone ID: uC-gsronu33B086e01b1
ctggtcttgtgggcggacgcgtgggatatgcaccgggcacattttgtattcatggccatcgatcactagagctgagcaa

SEQ ID NO: 2245 - DNA, 128 bp, Gossypium hirsutum
  Clone ID: uC-gsronu33B086e02b1
agctggtgtggcttttatcaaagcattcgtcctacacagatgggactatcgctgaatattgatatgtcttctacggctggcattgagcctttgcctgttattgattttgtaacacaattgctaaaccg

SEQ ID NO: 2246 - DNA, 119 bp, Gossypium hirsutum
  Clone ID: uC-gsronu33B086e09b1
gatgacttctataggataagactcccatctaatgttttgaatccgcctgggagggattttattatttcatgagggaaagcaagatgttttcctagagaaagtttgtattagcattttgt

SEQ ID NO: 2247 - DNA, 149 bp, Gossypium hirsutum
  Clone ID: uC-gsronu33B086e10b1
ttctacgcgtccggaaaatatctcaaatctcctcctcctcctcagaaatcttagtatcatcaccatggcctcaaatcccaaggtcttctttgacatgactatcggcggtcagcccgctggtcggattgtgatggagcttctcgtagact

SEQ ID NO: 2248 - DNA, 114 bp, Gossypium hirsutum
  Clone ID: uC-gsronu33B086e11b1
tcctattcatgacagactaggaggtgaaaattatgctaataaaacagatgtgcactgagacttcttcttcaagttccagttattgaaggtaattaatgagaaatgattttaatt

SEQ ID NO: 2249 - DNA, 320 bp, Gossypium hirsutum
  Clone ID: uC-gsronu33B086e12b1
aatgtatgcaatggccagctttaatgcaagcacttgcattaagacccggtggaccaccggcgtttcgattgaccggaattggaccacctcaaccggatgatactgatgcgttgcaacaagtggggtggaagctagctgaattggccgaacgcattgggatcgaattctagttttggggatttttggctaattattttagttaatcttattacttttatttgttttatttttttacttctctttttttgatgaattatttttttttattttctttttctttctctatttcattctcttttaattctcttttttttattata

SEQ ID NO: 2250 - DNA, 58 bp, Gossypium hirsutum
  Clone ID: uC-gsronu33B086f01b1
atgttcttaagtgttgaaccggtctgtgttggactgagttaggtgaacgatatatttt

SEQ ID NO: 2251 - DNA, 121 bp, Gossypium hirsutum
  Clone ID: uC-gsronu33B086f03b1
cgatcttgaacttcaaatcagacgatgccagtcactgttatactgttgctgttaggaattgcctgtggctcggctgggaagcttaaccccctttcttactatttttatttcttttaatttc

SEQ ID NO: 2252 - DNA, 101 bp, Gossypium hirsutum
  Clone ID: uC-gsronu33B086f04b1
ccctcgctatcgcccacgcgtccgtgagaaacctgtcctcaaggctggtaatgcttatcacaagtttagagagaagaggaactgctggcctaaggtgcgtg

SEQ ID NO: 2253 - DNA, 321 bp, Gossypium hirsutum
  Clone ID: uC-gsronu33B086f06b1
gtcttaattagttgcccccggatcatcataaggaattagatacctagttaaagaagatggcgtcctttaacggaagagtatttttcgtgtattttgctctttttttttttttctctattattttcttttttttttctttttttttcttttttttatattttttttttttccattttattattaatatttcattttttcttttttttttttactttttttctttttcttctttttttttttctacttttttttttttttattttattttttttttttattcctatctatcttcctttatttctttttttttttttttttttt

SEQ ID NO: 2254 - DNA, 149 bp, Gossypium hirsutum
  unsure (1)..(149): unsure at all n locations
  Clone ID: uC-gsronu33B086f11b1
taataccactctagagtggtattagctgcgaatttgttatttattactttctggcctttccctttttgacagcatgaaactggatccttatttttattatatatatatatgngcgngcatgcaaataagatgtgtattttccctttcaa

SEQ ID NO: 2255 - DNA, 353 bp, Gossypium hirsutum
  Clone ID: uC-gsronu33B086g05b1
tcattattcaatcagatcacgacaatgggtattcacttgaacacaatcccgcaatccacaatcacaaaatcccattaccacacccacaaaatcttcctcttttgcaattatatcctcctttccgccgcttccagctgcatcttcctaaccctcgccctccgcctctgtccttccctctccggcttcttcttaatcctcctccacatcataaccatcgccggagcaatctcgggttgcgcagctgcttcttcgggtacaaacggatggtacgccacacacatggtggcaacggtgttgacggccatatttcaagggtcatgttcagtgttgattttcactaagacaagtgattt

SEQ ID NO: 2256 - DNA, 147 bp, Gossypium hirsutum
  Clone ID: uC-gsronu33B086g07b1
ttggtcgcgtgggggagaatcaaacgatgacattggaaatataatgaaattttatcacaaatttcaagaaataactaaagtaatttatgtttctgacatccaatttttatttatttcttttctttatttaaaaattactctaatttt

SEQ ID NO: 2257 - DNA, 178 bp, Gossypium hirsutum
  Clone ID: uC-gsronu33B086g10b1
ttcttccgttctttcctcagccagaagggaggctcctccgacaagagaaaaatggaggagcagaagcctaaggaacagagacccaaagcaaatgagaataagcctgtcatgacagagtaacagctgcttttgtttagtatgcatggcaagatgtcggactgtttactttcacttttct

SEQ ID NO: 2258 - DNA, 194 bp, Gossypium hirsutum
  Clone ID: uC-gsronu33B086g12b1
cagttatcttactgcattactcaatttgtcgagaaagactgcaagcttgctgacactgttatacggggcttgctgaagtactggccggttaccaatagctcaaaagaagtcatgttcttgggtgaacttgaggaagttttggaagcaacacaatttgtgtagcttcatttgcgtattctattcttttattccat

SEQ ID NO: 2259 - DNA, 54 bp, Gossypium hirsutum
  Clone ID: uC-gsronu33B086h11b1
tctttcgcgtccgcccacgcgaccagtggtcggcatcattttttaatgaaagcc

SEQ ID NO: 2260 - DNA, 73 bp, Gossypium hirsutum
  Clone ID: uC-gsronu33B086h12b1
ctcacgcgtccgcccacgcgtccggtggccgggatcatcttcaatgctatccttgcctctttgagctccagag

SEQ ID NO: 2261 - DNA, 301 bp, Gossypium hirsutum
  Clone ID: uC-gsronu33B087a02b1
cgtttccatttcgaaaaaaaaaagaaaaaccacagaagtagaatggcttgtattgcggtcggtgacacgattcccgatggtactctctcatatgctgatgaggcccatcagattctaaacgtgtccgtatactcccttgctgccgctaaacaggtcattctctgtggagttcccggtgcttttacccccacatgcagcttgaaacatgtgccaggtttcattgaaaaggcagaggagctcaagtcaaaaggcattagtgagattatagtcatcagtgttaatgacccatatgtgatgaggg

SEQ ID NO: 2262 - DNA, 458 bp, Gossypium hirsutum
  Clone ID: uC-gsronu33B087a03b1
gtgtaacgtcatgaagaggagcggcggaggaactgtaaggatgacagttaccttgtccctttaagttcatggaatagggaattttctgaagctcgtgagaatgttgtagaaggcagtgttagcgacagcggtttggcagccaccgggaagagaaataataatatccaagctcggaacagaagtgctagatagtatgtgcaagtagctgttcattgcaattggagttaacaaaaaagtatttgaacatggtaattttagtggacaatatcaaagatgctttggaaattcgaatcttggcagatattgttttctcccacttgcccccccccttttctttttttaaatgcttggttggaatgatgggccctgtatcggttttccttcatcaatttcttataaaatttggaacaaaattatgtattatagggttggcattaaaaatttaaacttttttgggc

SEQ ID NO: 2263 - DNA, 241 bp, Gossypium hirsutum
  Clone ID: uC-gsronu33B087a04b1
ccctcgctttcgcccacgcgtccgcccacgcgtacgaccgcgcttccgggatttccgcatgatgtttcggcgaatatggggtccacgtcgctgattcatcatcatctaacactggttaaaatggacaaaccatcggcacttgtgcctatcaatgccaaatcttaggcagatcttgttccataactgggccttggaacaagagttctatgtgacaaggcttaagcgttggtagtgcagactg

SEQ ID NO: 2264 - DNA, 139 bp, Gossypium hirsutum
  Clone ID: uC-gsronu33B087a05b1
ctttcgatgtatgacaacaaacactaacgatatttttgggcttgcactgagctacaagtctggcactattcctaattgtgctattgcagccagaaacagatgcttgacagacgaggacagcaagataggcgggctctag

SEQ ID NO: 2265 - DNA, 342 bp, Gossypium hirsutum
  Clone ID: uC-gsronu33B087a06b1
ggctgactgaaattagagtaattgagaaaaacgcaatggctcaaatgatgttgatgatggcggtccttgcgatattggggacgaagatagcgacatttacggctgcggatccgacttgtttgcagagcttgatgtcttgtgctccttacttcaacaacgccactctccaactgaaaggcgattgctgtaaccctctcagacaagccgtcgctactgaacttacttgcctttgcagcctcattaataactctactttgcttagtttcttttcaacatcaacatccccatccctgcagctcttaggatcactcgtggcttgcgggtcactgtttagatgaacgg

SEQ ID NO: 2266 - DNA, 284 bp, Gossypium hirsutum
  Clone ID: uC-gsronu33B087a07b1
tttgtttctcccgacaatgtgttagtagctgaattaaaagccaaaccattattgattcaccaaattcgtgaagctcagaaagtcgatgatgaattggttgcaaaacgggctgagtgtgttccgaacaaggaatcagagtttcaaattgatgatgatgattgtttgaggactcgtgagcatgcgaaagctcataggttagctagatacgctaagtttgatgattgggatcattggaacatgtaagggcacgatttgctgcatcacggctagttggggaaaagagc

SEQ ID NO: 2267 - DNA, 256 bp, Gossypium hirsutum
  Clone ID: uC-gsronu33B087a08b1
tcgttttagaaaaggaaaatcctttttccggatgccataaatattcaacgcgattcagattttaaagcttcgagaaaacagaggaacaacaacaacaaaagagaatataacgcgctttttagttcgctgttgactgaaaaactccgttcatttcttcgatccgatcgttattctcagacgaaggtcaaattttccgacgtgaggatgccagagattcagttgggtgctcatactgtaaggtcctatgggggttaaa

SEQ ID NO: 2268 - DNA, 382 bp, Gossypium hirsutum
  Clone ID: uC-gsronu33B087a09b1
ctttatttcccagctatataacacttggttttttgtccctacttggatcacacaaataatcttctcccaactctctaaacgaaacccttcccttgagtttttttttttccattctcaatattaaacatgttggttaactcttcttcatgctgccgaaaacgtcagtccaagctaagacataacgttcgtgttccaaggctcaacaggttgagaagattaaggacaaagaagatgggggccgtcgggattaaaacagatatggaaataaaaaacttgaaactgtacatggagaattagattatcataccagagaacaagaagcctgggaagaaaggccctctttttcaccagggagaaccaaacccctgtgggctcagctcag

SEQ ID NO: 2269 - DNA, 379 bp, Gossypium hirsutum
  Clone ID: uC-gsronu33B087a10b1
gatttctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcatatataacaggcctctgtaatgatatattgccaaggattggttgcctgcaaggtctatattatgccctctgcctg

SEQ ID NO: 2270 - DNA, 155 bp, Gossypium hirsutum
  Clone ID: uC-gsronu33B087b02b1
ccctcgctttcgatggtggtggaggggcacatgcaggtggatatggcaatggagaaggagctggaggaggttttggtggtgcaggctgtcatggtggtgtgctctttgttttttggtttttttctttttttcatcttttttgctatatccacttt

SEQ ID NO: 2271 - DNA, 435 bp, Gossypium hirsutum
  Clone ID: uC-gsronu33B087b03b1
tggtgttgtaatgttggtatggattactgactttgagaccaaaatctccccaccctggcctcgaacaatcagtcccgaagcagatcttgcattttgctgatcaaaggccgcatcaaagtagactgagattctcgtacatctctcaacagttcgcaggacaccatttcctgccaaatgatccaaagcccgcaacagaaaagtcagcactgttcgtttgtcccgcgactaaaaacccatagcatccacgaaaaatatgattacagtcctcctcttccagtttgcatcgaggacatcgagcatctacaactgttcgtttgatcttcagattagcaaaagtaggaatgtaattccaagagattccccatattgtaactttgattttcggaggaaatttggtaaatccatagttttttggaaaaaaattagtctcggttt

SEQ ID NO: 2272 - DNA, 236 bp, Gossypium hirsutum
  Clone ID: uC-gsronu33B087b04b1
aattcatttattatgctgatgtctcttgtttctattgtgatagttgggatgatttgatgctctagtttcattctgaatttgctattaaaaacattgtgtgtaatttcgtgacgtataacttaataaattcaagttctacgtttgtgttttttgtctatacatttgtaaatcgcctattgttgtggttcaaatcacaattttttatgccaagtccactctcaacagcatgcacttac

SEQ ID NO: 2273 - DNA, 275 bp, Gossypium hirsutum
  Clone ID: uC-gsronu33B087b05b1
catgaaggcttcaattcatttatgctgatctgggggatgcaaaagctgtgaataaaatattttcagaaaatgcatttgacgctgtaatacactttgcggctgttgcatatgttggggagagttcacttgatcctctcatgtattatcacaacatttcttcaaacaccttggtggcgtttgaggcaatggctgctcacggtgttaacactgtgatatactctagtgcatgtgccacatatggggagcctgataagatgccattcacggaagaaacc

SEQ ID NO: 2274 - DNA, 86 bp, Gossypium hirsutum
  Clone ID: uC-gsronu33B087b06b1
gcccgctttcttttttttaaaaaaaaaaaaaaaaaaaaaaaaaaggtaaattttaaaaaaacaggcgggcccacacccaaattccg

SEQ ID NO: 2275 - DNA, 442 bp, Gossypium hirsutum
  Clone ID: uC-gsronu33B087b07b1
cccacgcgtccgcggacgcgtccgcccacgcgtccggcagctggtaggcaccaagaagtcggccataagagccttttgcaaagcgatgctctttaccagtatatattggagactagtgtatatccaagggagcctgaacccatgaaagagctcagagagttgaccgctaagcatccatggaaccttatgactacatcagctgatgaaggtcaattcttgaacatgcttcttaagctgatcaatgcgaagaataccatggaaattgtggttatactggttattctttgttagccaccgccctcgctttacccgatgatgggaaagatcttggccatggatatcaacagagaaaactacgagttaggattgcctgtaatccgaaaagctggcgttgcacacaaaattgaattcaaagaaggccctgcctgcctgttcttgataa

SEQ ID NO: 2276 - DNA, 400 bp, Gossypium hirsutum
  Clone ID: uC-gsronu33B087b11b1
atttgaatagtttagattacaagaatggcaggggaattagtattgttggatttctggccaagtccatttgggatgagatccaggattgctttggctgagaaagggataccatacgagtacagagaagaagatttgaggaacaagagtgatttgttgctgcagatgaaccctgttcacaagaaaatccctgttcttatccataatggtaaacccgtttgtgagtctgtcattcaggttcagtatattgatgaggtctggcatgattaagctcctttgatcccttctgatccttattaaagagctgttgccagattctgggttgatttcgttgacaggaagatttatgacctggggagcaatatggcagcgtactacgtcaggtatagaagccctgtgggca

SEQ ID NO: 2277 - DNA, 268 bp, Gossypium hirsutum
  Clone ID: uC-gsronu33B087c03b1
ctcttctttgaactcaaagtcccagttaatattagaattatgggtgttgtcacttatgactatgagtctacctccccagtcgccccttccaggcttttcaaggcctttactgttgaagctccgaaagtttggcccacggctgcacctaatgcagtcaagagtattgaggttgaagctaatcctagctctggaagtatcgcaaaaatcaactttgttgaaggcctctcattccaatatatgaagcaccagataggaggacctgatgaaa

SEQ ID NO: 2278 - DNA, 350 bp, Gossypium hirsutum
  Clone ID: uC-gsronu33B087c04b1
ccctcgctgttcgcccacgcgtccgctgattttggttattcaaatgaaatgtttgaaaaagacatggaaacttggcgccagcgggtagagaattattggaatctcttgagtccaaagattgaggccaacactttgagaaatttgatggacatgaaagcgaacatgggatcttttgcggcttctctaaaagagaggaatgttcgggtgatgaatgtcatccctgaggatggaccaaacacacttaagttgatatatgacagaggccttattggcactactcataactggtgtgaagcctttttcacatacccttgaacctatgatttactccatgcttggactgccttttt

SEQ ID NO: 2279 - DNA, 346 bp, Gossypium hirsutum
  Clone ID: uC-gsronu33B087c05b1
cccacgcttccgcagaatatgaaggaagtcgctgcttttcttggacatgtcggcagcaaaacttcatgtggctatggagtcgctaccgggggaccattggcttggggtctttgctacaacaaagaaatgagccctagcaaaatatattgcgatgattactataaatacacctatccttgcacaccaggagtctcatatcatggcccgaagaagaagcccgtttcaaggtccgtcaaagccggtctccagttccccgttggtaggatcggccgctatttgaagaaaggaaggtattcacagcgggtcggaaccggagccccagtttacttggctgcaggtcttgagt

SEQ ID NO: 2280 - DNA, 476 bp, Gossypium hirsutum
  unsure (1)..(476): unsure at all n locations
  Clone ID: uC-gsronu33B087c09b1
ccctcgcgtccgaaccgtgaagcagcccggtctcgatatgtcaacagtgcaaagtgaactagatttgtcatacaggcaacgctatcaaggtgttaccatcccagaggcttatgaacgtcttatactcgacacgataagaggtgatcagcagcattttgttcgtcgggacgagttaaaggcggcatgggagatttttacgcctcttctacacagaattgacaacggtgaaatgaagccaattccataccgaacaggcagccggggtcctgcagaagcagatgagctctcggctaaagccggttatgttcaaacacacggttatatttggattcctcccaccttatagaaacattatatatatttatatatatatagctntgcgatatcctatcaccattgccatagaaagaagttgaggtttgtaacagatacaataaaatgcttagcctaagagctttgtaactttttcctttaaa

SEQ ID NO: 2281 - DNA, 276 bp, Gossypium hirsutum
  Clone ID: uC-gsronu33B087c12b1
tcggttctcaagaatggaggatcagagaaaaatgtaacggcatttgggcttttaatgtaaaatttgtatgattttgtgaacaaactcgaaaaaaaaaaaccagtgttgtacaacatgtgtttcattgtttgacaaagttgaaactcaaacatttgttttgctttatatatttgttttctatagtttaaaaaaaaaaaaaaaaaaaaaaaaaaaaaaaaaaaataaaaaaaaaaaaaaaaaaaaaaaataaaaaaaaaaaaaaattaaaataaatag

SEQ ID NO: 2282 - DNA, 453 bp, Gossypium hirsutum
  Clone ID: uC-gsronu33B087d03b1
gatgaatatcgggagctggtgggcctgatgaagaagataataggtggccgccatggttgaaacctttactgaaagaacagttctttgttcagtgtaaacatcatgttgattttcacaagagtgaatgcaatatgttctgcttagattgcgttaatggcgctctctgttctttctgcttagcgtatcacaaggatcatcgttatatccagataaggaggtctttataccacgatgtgatatgagtattttgagatacaaaaatacctagacatatcttgagtccaaacttatataatcaacagttgctaagatcgttttttttttattaaagggcacatcccatgcctggaaattgtttttcctatcacttgttagggtttttttttctatccttttaattttcttctctctttttttttcttggtttcatgtattgttttttctctaaatatt

SEQ ID NO: 2283 - DNA, 250 bp, Gossypium hirsutum
  Clone ID: uC-gsronu33B087d04b1
aatatacttaaaatagatagcaatataaagtatcaaatatggggggaaagtgaagatgtagccatttgtaattgtaattgtaatgcaatataatgcattgaaagaataatagggtcttagattagaatatcatagggtaggaaagctttgtgacttgtgattttgagtgcaagagatatgctattgctaaagccctttttgtttgtatgtatgtttttagtggtctaagaaccagtatccggctatcaca

SEQ ID NO: 2284 - DNA, 332 bp, Gossypium hirsutum
  Clone ID: uC-gsronu33B087d06b1
cccacgcttccgggtcgatgttggcggcggtactggagctacgcttaacatgattgtcaccaagcacccttctataaagggcatcaactttgattcgcctcatgtcattgaggatgctcctgctcatcctggtgtggagcatgtcggtggagacatgtttgaaagtgttccaaaaggtgacgccatcttcatgaagtggatatgccacaaccggagtgatgagcactgttccaagtttttgaagaagtgctacaaagctttgccggacagcggaaaagtgattgttgcacaatgtatttctcccagatttcccataccctagactggccacg

SEQ ID NO: 2285 - DNA, 386 bp, Gossypium hirsutum
  Clone ID: uC-gsronu33B087d07b1
tcggttattctctttgaggaaaccctttatcaaaaaaccgcttcgggcaagcccttcgttgatgttttgaaggaaggtggtgtcctccctggcatcaaggttgacaagggtacggctgagcttaatggaacccatggcgaaactttcacccagggtctagatggccgtgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttggccccattggttgagcctgaaattctttgttgacggattcacattgacatttaaaaagtgt

SEQ ID NO: 2286 - DNA, 259 bp, Gossypium hirsutum
  Clone ID: uC-gsronu33B087d08b1
ggctgacccccaattgaagcactcttgagcagcaacagaggcttcattcagatcacatatcagcagccatggtgaagtattcgaaggaacccgataatcccaccaaatcctgcaaggcaaggggctctgatcttagggttcatttcaagaacacaagggagacagctttcgccattagaaagttgccattggttaaggctaaaaggtattcggagggatgttatggcccacaagcaagccataccgttccgacgctttt

SEQ ID NO: 2287 - DNA, 348 bp, Gossypium hirsutum
  Clone ID: uC-gsronu33B087d09b1
gacctgtttgctaaaaggaattcgccggtggctcatgctgttggattttgggattaccattcttttattttggctgcttccatttatgagcctttgggttttgggactactggtggtaagcatatgcaaatgaaggaagtcgcggcttttcttgctcatgtcggcgccaagacatcttgtggagatggtgtcatagacggaggaccgttggcttggggtctttgcttcaagagagaaatgagtcctagccaggattactgtgatgattactacaaatacatgtatccatgtgcccctggagctcaatactacggccgtggtgctttgccaatttactggaactacaac

SEQ ID NO: 2288 - DNA, 378 bp, Gossypium hirsutum
  Clone ID: uC-gsronu33B087d11b1
tcgccctcgcgtccggccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggagaagcatgggctacggaatgaccgaaa

SEQ ID NO: 2289 - DNA, 357 bp, Gossypium hirsutum
  Clone ID: uC-gsronu33B087e01b1
gcctcgcttccggccacacgtccgttcctcaactgatacacaatctttataaagaatccagatgaaaaaacacaacaaaactgaaccattactgattgaatctcatgacaaaatcaagacaagcaagacacagttaaagattggaacatagaaaggacctagaaacacgcccaacttactaataagtaatgaccctgttgatcttcaatcagatatcaactctctcgacatcttccagtacaagggtcttcgatggctttcccaacagatcagtatactcctggaatggagaccttgtgaaacgagtctctctccagaaatccggtgtcaagaaaccatatgttttcagaagacatt

SEQ ID NO: 2290 - DNA, 217 bp, Gossypium hirsutum
  Clone ID: uC-gsronu33B087e02b1
cccacgcgttcggcgagaatcacattagagaaagctaggagtgattctttcattgttttcttgttgctcgggaatgctacggtggcctatttggtgaacttggcaaatttcttggtcaccaaacatacaagtgcacttacattgcaggcgctgggcaatgccaaagctgctttagcagcattcgcgtcggttatgatctttccggaatacgatcacc

SEQ ID NO: 2291 - DNA, 393 bp, Gossypium hirsutum
  Clone ID: uC-gsronu33B087e04b1
ggataacgaaggagacagtatgcttgttggggatgtcccatggcacatgtttgtgtcgactgtgaagaggctgcgtgcgttgaagagctccgagttatctgcccttagccttggaagcaataagcaaggaaagctacaggcttgaagctctctaaagatcctgatcacatttcaaagaaagagactttgaattatgtttcgcgttttcacaattttctcccctattttggaatgcaacttattgcactcaacagtataaatatatatattttaagcggcttattgggaaggttctgatgtcttttcccttaaatgcttaatagcaactatctcgagtttgttatgtaaattttatacttttaactttgcattgaagtatccatcttgaatgct

SEQ ID NO: 2292 - DNA, 329 bp, Gossypium hirsutum
  Clone ID: uC-gsronu33B087e06b1
cccacgcgtccgaatgttttcattgcgactccatgaaggtcaacatccttttagcctatcgaacattgcgacggtgatgaatattgctggaaaattgaagtctaggcatgagtttgcccctgagaagttcgtcgagactatgcacctcatggagcataggtatggagataaagactttgtgactagcaaagattgtagccttttgtctcccggaacatactacctcaccgaagtcgattctaagtaccggagattttacgcatagaaggacgggaactgtactgggaatgagaagggttcctgttgtcaacggtcactgaagaagaaca

SEQ ID NO: 2293 - DNA, 391 bp, Gossypium hirsutum
  Clone ID: uC-gsronu33B087f01b1
cttttaaatgtctccctaacccctgcccccctttaccctcacttccgtctctctcttgtttcctcctagcccaaaaaaaaaaaaccctctttcctttctctcgttctttttcccgttcaatcatgtcttgcttcattagcaaatatgccgatgaggtggctaaaaacgctgcttacattggaacccctggaaagggtatccttgctgctgatgaatccactggcaccatcggcaagcgtcttccaagcattaatgtagagaatgccgaagataacaggcgtgctctccgtgagctcccattcacaactccaggagcctcttcagtccctagtggtggtcattctctttgagggaacccctcattaaaaaacccggttcgggccaagccctc

SEQ ID NO: 2294 - DNA, 237 bp, Gossypium hirsutum
  Clone ID: uC-gsronu33B087f05b1
cccacgcgtgcgctgaaatttgtctctgactgaatattcctctgtcatagtgtgtattaggaattgtctcccctttcaaatgtcctataagtatataccttctgaggatgtccttatccctgtgagaatctcccaatttttaactgtttggaatttgtttgaggccgctcattgaacgactacgatctggagttggaatgctggggtttcctcgtccgttgcctccgatgtggtgcc

SEQ ID NO: 2295 - DNA, 356 bp, Gossypium hirsutum
  Clone ID: uC-gsronu33B087f07b1
ccctcgcgtccgcccacgcgtccgcccacgcgtccggcctcgaatgaaggatcaaaagccgaaaagaatgaatggaaattactcagaagaaactccaatccctctcaggcagaggttttcaaagccttcgtcactcccaaacaacaagagaacactttcggtgaggagtggtcaatccagtccaattgcaaagaagaaacttgcttcagggataatccatggcgttatgcaagccatgccacagataaccattcctcgaaggtctcgtttgagtttggtttccaagtcatctgtttcttctccgagctcaatggataaacaaaaagggatattcattgaaggtgatataactggac

SEQ ID NO: 2296 - DNA, 429 bp, Gossypium hirsutum
  Clone ID: uC-gsronu33B087f08b1
aatattagttgctctactctaccatcttcccaatggagacttcaaaatattttccgagcgtagagacactagatgaaggttaccaaaagacattcaaaaactgcgatgaactgctgccaactctccctcaaaccaaaggttggtggttcggccagcttttccaataccatggcttttggatatcaggtttttgtataagaggaagcatgttgaaccatgaccacttcaagcctcgatccacagacatcgtcgtcgcaacatcccctaaatgtggcaccacctggctcagagccctcgttttctccattatcaacagagcttcctttgatttcagcgaccatcctttgcgcaaagcaaacccacaagacttagtcccattcttcgaaaaaattattcataaagatgggtcaacttccttcgtcgatggga

SEQ ID NO: 2297 - DNA, 272 bp, Gossypium hirsutum
  Clone ID: uC-gsronu33B087f09b1
tgtacccaaccctacatgagaagatgatgagggaggcgaaagtgctagggcgtttgcaagggtccatgtggctggaacaacagcaattggtgagctagcactttagagccatcgacttctaactgtattgtccttgaagtgggaacaacataaaagcaggatgaggtgtctatgtatgggactaatggaaatgtttgcgtactgtttgtttttctctgttaaaaccctgcatcaatgtggtttgttggtaatagcttcattgaagatttatt

SEQ ID NO: 2298 - DNA, 313 bp, Gossypium hirsutum
  Clone ID: uC-gsronu33B087g02b1
ccctcgctgtttgctcctaaaccttaacatcttcattccccttgctcttcaagctttaataacttgtgggaaaaaccctccacctggtttcatttgtcctcctctttaagcgccacattcattacttattaggctatccgtcacactttctctcccgacgcacaagtaaaaagacagtcagatagtcagttcagcttttaggcagggttgccaacttggtcacctattcttaactgttccattaactaccaaaaaacccgttgaaattgtgaaaagaaaatctgtacttttccgtcattaggtttggagttgg

SEQ ID NO: 2299 - DNA, 368 bp, Gossypium hirsutum
  Clone ID: uC-gsronu33B087g05b1
cccacgcgtccggatgaaaagagcattgatccagggaattttgaacgccactggggtattttttattttgatggacaggttaaataccctctcaaccttggaactacaaacagtggagcattaattcctgcaaaaggtgtacagtacttggaaaggaagtggtgcgtgatgaagccttcagccccacttgatgacccacaagtggcacaaagtgtgagctatgcatgtggccttgctgactgcactagcctcggttatgggacatcttgtggaaacctagatgctaggggaaacatttcttatgcctttaacagttattttcagaagaataaccaagttgaaaaaagctgcgaatttcaaatgttttc

SEQ ID NO: 2300 - DNA, 239 bp, Gossypium hirsutum
  Clone ID: uC-gsronu33B087g06b1
tggtaaggttttcaaactacaaaagttgttcccttaataggtaaaaatttatatctgacattcattgtgatgctttagtctgaaaatagctgtgctacaccattctttacagtttcaaacttactatcaatgacataatacatcttaacatctttggaatctggtcactgtttctgtttgagtcctcacatttttgcgggatcctatcactgtatagtcaagagtttgttgtcaatgtg

SEQ ID NO: 2301 - DNA, 243 bp, Gossypium hirsutum
  Clone ID: uC-gsronu33B087g09b1
ccctcgcgtccgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgcggctttcttcccccttctccttcttctttttttctcttttctctcttctctt

SEQ ID NO: 2302 - DNA, 306 bp, Gossypium hirsutum
  Clone ID: uC-gsronu33B087h01b1
ccctcgcgttcgcccacgcgtccggttttcctcatttccctttactcgttgaccgaaatttctcgactcaccgtgttcacaacctctagatctgttacttcctaggcccgatttcataatttcaagatctgcttccagcatctaaacgcgaccgtttccggaactcaactcggagattcaatttttaagggtttcgaatttggatgtgcttgtcttttatttggtctactggaaatgtcgattttgcccaaaggtgattcagttcatattcgagaagtttggaacgataatctagaagaagagttt

SEQ ID NO: 2303 - DNA, 296 bp, Gossypium hirsutum
  Clone ID: uC-gsronu33B087h02b1
aatttattatattaaaaaaaaaaaaaaaaaaaaaaaaaagggaaaattttaaaaaaaaatgggggatatcaaacaaaatttccaccttagaaataggggggccgcgtgttctgttccgaatgtatctttcccttatatgcaacgccatatctttttttttgtggcacctaacttaatttccttggccgggccttcccacccccaggactgggatacccctccctttccccaacttaatggttttgaggcacttccccttttcccgggctgggttcttggcaaaaaggcccggcccg

SEQ ID NO: 2304 - DNA, 130 bp, Gossypium hirsutum
  Clone ID: uC-gsronu33B087h03b1
gtatactacttgtaataaaattttgttcctactgtcccctgcaatggtttttacataggcatcgttgtttcagaaccccgatggacggcctgctggccggtatgcgttgcaattggcatggtacatatag

SEQ ID NO: 2305 - DNA, 277 bp, Gossypium hirsutum
  Clone ID: uC-gsronu33B087h07b1
ccttatccaaaatccacatctttcattctaatatgcaaaaaagaaaacatggttgtttgatatctgacaaattttccacctaggaatcagtgaagtgtgtgttctgttctgtctgtatctttttcttatactcattgtaactttggtctggtctcaaaaatgggaaggcaatcttgttgttacaagcaaaagcttaggaaaggtctttggtcccctgaagaagatgaaaagcttttaaggcatattacaaagtatggccatggttgctggagctcca

SEQ ID NO: 2306 - DNA, 445 bp, Gossypium hirsutum
  Clone ID: uC-gsronu33B087h08b1
agttaaaccagctgaagctcaagctgagaatactactaccgagtaaataagcttgtaagatggggaatcaatggaagcttgtgtagtgggcttactgttagctaagtttgcatgttgaaatcaattagtttcaattctagttgaataaggatgtgatagtattaaggtggatgaggcttgggactggggcatggaaatgacccaccaatgatagcttgcctattggctaaactaacatgcaattggcatatggcagggagagagagtttagagaaggttcaagcaggcattttgggggggggggggcatttttccatgttcaatctggtctctgtatgggtggttcctgggtcccaaacagggtcgtttaatttagtggttgggcttgcatggttttattagaaagaggcattttggatgttgtctttttcaagttatattatta

SEQ ID NO: 2307 - DNA, 520 bp, Gossypium hirsutum
  Clone ID: uC-gsronu33B089a03b1
cccacgcttccgcccacgcgtccgctttgggtgacgcgggtggaatgaattggacacttggttgtttgtttttgatcggacattgcttgtcttggtctggatggctagtgttacaagcaccggtgctgaagaagtacccggctagactctcggttacgtcctatacatgtttctttggtctcattcagttccttgttattgctgcggtttttgaaagggatgctcaagcttgggtttttcactctggtggtgaactcttcactattctctatgcgggagtggtggcatcggggattgcatttgctgtacaaatatggtgcattgacagaggtggccctgtcttcgttgctgtttatcaacctgttcagactcttgttgttgctattatgtcttccgttgctttaggtgaagagttctatttgcgaggtatcataggggcagtgctgatcataacgggattatatttagtgctatggggtaaaagcgaagaatgacaattcgcagctcatgaaaaagccgc

SEQ ID NO: 2308 - DNA, 541 bp, Gossypium hirsutum
  Clone ID: uC-gsronu33B089a04b1
cccacgcgtccgatttgctttcttctcaaagtttgggctgtcatcaatgcttcatgggtcaggctactgtatcccaggtttctgtagctgttcccgttggaaacgacatttctctgaggagatctgtagctaacaggaacattataagctttggtaacaagtcatgggcttccaccttggcttttgatttgaaatcacgaaatgcacagaagaacaaaccgtacatagtatgcctgtcagtgcaacaagccagcaaatccaagattgcagtttcacctttggagttggaaattgcaaaagagcccccactaaatacattcaagcccaaggagccttacacagctaccatcgtttctgttgagagacttgtcggtccaaaagctccaggcgagacttgtcatattgtcattgatcatggcggtaatgttccatactgggaagggcagagctatggtgttatccctcctggtgaaaatccaaagaaaccaggttctccccacaatgttcgtctgtattccatagcatcatccacgtatggaga

SEQ ID NO: 2309 - DNA, 524 bp, Gossypium hirsutum
  Clone ID: uC-gsronu33B089a09b1
gttttctctgtttgccatttgccttaatcatgggcgtctttctttaaaacctcttgctatttaatttccgactaaacttgcgctgaattccatggctactgcagaggttgtatcagctcagactgcaatccatgaggagaaacctgaagaagtggtcaaggttggagaaattgcaacagaagaggtaccggctgttgctcctgcagcagaacctgttgctgaagaaccaaaggaagcagtgcctgaagcagcatccggagaaccccaggctccagaaactgaagccacagttgaaactgaatcaaaggaggtggttaaagagcccaaggctgtgactgaggagccagaagttgagaaaaaagaagaagagacttctaaggaaacggtagcagagccagttgccgaggagtccaaggagtccaaggagacttctgagccaacagttgaagaaaccaaagaaagcacagagtctacagaagcagcagcagcagcagcagcagcagcagcaaaagtaaaagcagaag

SEQ ID NO: 2310 - DNA, 125 bp, Gossypium hirsutum
  Clone ID: uC-gsronu33B089a11b1
ttgtctgtggatacctaggcacccagagactaggggggctttataaagaaaagtgtgattcttgatcggaagggataacaaagacatgcctaatcctataagtttagattcaaaaaacagaacag

SEQ ID NO: 2311 - DNA, 334 bp, Gossypium hirsutum
  Clone ID: uC-gsronu33B089a12b1
atcttagctaatacggctatatatggggcggtttataaaaaccttggtggtgtggtaaagcctagctaatgaccctgcaccagaagtgcggaaataggtttgtgcagcattttgttcagcttattgaagttcgtacatctgttatggagccacatatgaagaatgcaattgaatatatggcgcaagaaaataaggacactcatgattatgtggccacttgaagcatgcgaattttgggtgcacggaatagaattggaacaagacaacatagaccctatgatatatgcctagaaatatggactacaactccctggactgcttcagccaatgctga

SEQ ID NO: 2312 - DNA, 453 bp, Gossypium hirsutum
  Clone ID: uC-gsronu33B089b01b1
cccatgcttacgtgaaattgaagggtctgcctcggggtagggggcatagggctactctgctgaaatgagctctgctggtaacctagccacgggggactacacagctgctgccggaaaaagttgccgaacaacactccgattttgtcatcggattcatctcagtcaaccacgcatcttggaccggggcacctgtaaatccagcattcattcaggcaacccctggagttcaaatggtaaagggtggcgacaccctcggccagcaatacaacaccccgtattcagtcatctttgataggggtagcgacataataatcgttggtcggggaatcattaaggcagcgaacccagcggaggcagctcgtgagtaccgtctttaaggatgggaagcatacatggctaaatgcacttaagagggtatcttatcttttaatatgttacgaccttataacataa

SEQ ID NO: 2313 - DNA, 472 bp, Gossypium hirsutum
  Clone ID: uC-gsronu33B089b04b1
gcatattgtacaatactctgaaatcttcaatccggagtgcctaagtagattcatgagatcaaggacttccttctgactgctacaaggaaagatgcacgctctgtaaagatcaagaagagcaaagatgttgtcaagttcaaggtccgctgctccaagtacttgtacacactttgcgtgtcggatgctgagaaggctgacaagttgaagcagtcccttcctccaggtttgagtgttcaagacctgtgaaaatatggcagcctcaggtttgtcacctgatttataggtgatgaaagctagattttagttttgggtttattgtatttctggtcattctgcaacagtgaagctcaattttctgtaattggatctatgtttttttgttgattaaggattttagtgatatatgcacttttcaattacaatgaatgttctttttaatgaaaaacacagaaaaatttgatggtgcttcgct

SEQ ID NO: 2314 - DNA, 590 bp, Gossypium hirsutum
  Clone ID: uC-gsronu33B089b05b1
cccacgcgtccggcaaattcccttcttttcccctgcacccaagcctaaaaaatcatggcgacagctcaaatcagcaaaaagcgaaagttcgtcgctgatggagttttcttcgcggaactcaacgaggtattgaccagggaactggctgaggatggatactctggagtcgaagtcagagttactcctatgcgtacggagatcatcatcagagccacccgcacccaaaacgttctcggtgagaaaggtaggaggattagggagcttacctcagtggttcagaagcgattcaagttcccagaaaacagcgtcgagctttacgctgagaaggtcaacaacagaggtctttgcgctattgctcaggccgagtctcttcgctacaagctactcggaggtcttgccgttcgcagggcctgctatggtgtattgagattcatcatggagagtggtgccaagggatgcgaggttattgttagtggaaagctaagggcacagcgtgccaaatctatgaaattcaaggatggatatatgatctcttctggtcatcctgtcaatgagtatattgactctgctgtcagacatgttcttttgag

SEQ ID NO: 2315 - DNA, 560 bp, Gossypium hirsutum
  unsure (1)..(560): unsure at all n locations
  Clone ID: uC-gsronu33B089b06b1
atatgcactctaaacaacccatcttttctttcccaagtttatgccctttctgggattgataaaatctaccaagcttatcatttttggaaatggggagctttgattcttgccctactggcctccttatctaccataatcaatagactcaagattctggttatcagattccgacgaaaccattctttaccatctcgacctcttcttatgacacagattttgatactgactcggagacttcatcatgttcatcatcggacaacgaagtagaatatgaggagccctcggcttctcaaaactggcgacaagttgatgaggattttcgagtgagaggatcgggtcattttattgacgatcaatggcggaacagtggctccaccctgcgaaagaggagaagcagcatcggcgatctgttttcgtgggctgaagagctaaccagcggaaaaagcgtggtgaagctgtgggacaacttaggattagggttccgtttggacctcgatgaaagcgacaacgttntagatgtttacgacatcaacaaagaaacaaaatcaagtcaatatttg

SEQ ID NO: 2316 - DNA, 327 bp, Gossypium hirsutum
  Clone ID: uC-gsronu33B089b08b1
cccatgcgtccgtcaaagcaattaatgagaatgaagaggaaagttttagaagtataatggctgaacctactcaaggagtttttacatttgaaatgcttcagccccatttctgtgaattggtggtatctgaggatctgaatgcttatgtagaaaactttgaaaaatgggttcacgagacaaaatttagaattatgcgaccgaacacaatgaacaaatttggtgctgttttagatgactttggtctggaaaccatgcttggcaagttgatggaggactttatccgacctatattcaaagatttcttttttgatggggggggagctactc

SEQ ID NO: 2317 - DNA, 106 bp, Gossypium hirsutum
  Clone ID: uC-gsronu33B089b09b1
gtgttactcgccattttgtaaactatgatgggtggctaaagataaattcattaaatccatcctcaaattgcaataattttagattgttgctcctttatgctgtctt

SEQ ID NO: 2318 - DNA, 477 bp, Gossypium hirsutum
  Clone ID: uC-gsronu33B089b11b1
cccacgcgtccgcggacgcgtgggcgaaccagcctttgtcttctctctgtccttcactttctcttcatttcttccctcacaaacaagaaaattcaactcagtaaagtaagggtttcttctttcttctttttaatacctttggaaagtgggaatctgggaaacggctctagatccggacagaaaccatggcgggtcataggtttgacgtcacatggaccttctctctggtagctctcttcttccttcgagcccattggttctacctccctggtgttgctcctgaagatttcaaaaagggagatccattgttggtgaaagtgaataagctgacttcaactaaaactcaacttccttattcctattattccctacccttttgtcggcctgagcatatagttgacagtgcagagaatcttggggaagtcctccgtggtgatcgtatcgaaaactttccctatgtcgttaaaatgagagaac

SEQ ID NO: 2319 - DNA, 390 bp, Gossypium hirsutum
  Clone ID: uC-gsronu33B089b12b1
accaacaatggtggtaccactgtagggaggtgtaaaataaagattctgctgagtaatactcagctggacaatctcatcatgtgagtagagttaattcagacaaatcgacctatcagagtggttctgattctaagaaggaacctgcagtacctaaagatggaccaatggcaaatattgcagcacaaacatttactttcctagagcttgccaccgtcacaaagaactttaagccacaatgtctattacgagaaggtgggctcggacgtgtttacaagggccgttttgagagtaccggacaggtagttgctgtaaaacagctcgatccaaaaggtcttccatggaatccataatttcttcgttaagttcccatgcttagcctcttacaccacc

SEQ ID NO: 2320 - DNA, 556 bp, Gossypium hirsutum
  Clone ID: uC-gsronu33B089c01b1
gttaacatcaaaaattgcgtttgttactttgaatgcgctgaacgagtttggtcccaagtgttccggtgttgattggaggcagaagttggagacccaaaggggtgcagttttggctactgagttgaaaaataatgcaaataagttggctaaatggactgctcaagcgattttagccagtgctgatttgatgaaattgggatatgtgacaagagtgcatcctagggatcattttaaccatgtgatattaggtgttgttgggtataaaccaagagattttgcttcccaaattaatctgaatacttcgaatatgtgggggatcgtcaagtctattgtagacttgtgtatgaagttgaatgaagggaaatatgtgcttgtgaaggatccatctaagcctcaagttaggatttatgaggttccagctgatgcttttgagaatgattatgttgaggaaccattgccagaagaaaacaggttcagccaccaagtgaggatgctgaaggtgtggaggctaatgggactacaactgacgataaagagattgaggcacaaacttagt

SEQ ID NO: 2321 - DNA, 413 bp, Gossypium hirsutum
  Clone ID: uC-gsronu33B089c03b1
gattttcttaatcatggcttatcatcgtttcccttggtttgtgttaccctatttattaatcactttgtcatcgatgagtagcaacatagtcttggttggtgctcggcatcttttggagacatctgtgccggagattcctaaacccgagttgcctgagatgtcgaccttcccaaaggctgaacttacaaagcctgaattgccggaaatcccgaaacctgaaatacctaaaatgcctgagttgccaaaacctgaattgcctaaagttccggagttgccaaagcccgaattgcctgaggtttccaagtttctgaaagttccagaattgccaaaaccagaattacccaaggttcctgagtttccgaaggttccagagttgccaaaccctgaattacttagaattcttgagtggaaaa

SEQ ID NO: 2322 - DNA, 357 bp, Gossypium hirsutum
  Clone ID: uC-gsronu33B089c07b1
cctccgaactgagcaatacttccgctctatttaaaaaaacaaaggggttcctaaattatctagaaaccaccgcccagccctgcctctaatcacccgaaccactgcccaatcgcccacccatacctcctttccctacaacgagccctcgcttttcacaccaccgccccttctctctcctactctgccaccccaaccacatacgcccggccttctccgccgtccacctccggcactccatccagtctctctaagcctgctgagtacttgatctccaaggtcgatgacctcttgcactgggccccccgagtctccatctgacccatgactttcggcctcgcttgctgcgccgtcaaaatg

SEQ ID NO: 2323 - DNA, 469 bp, Gossypium hirsutum
  Clone ID: uC-gsronu33B089c11b1
tgcctatgcgttcgatttatcctagattgtcactcagatatctttgtctgggttggacaacaagtcgataccaagaataaattgtaggctttgactattggtcagaaatttcttgagcatgattttctcttagaaaaattatctcgtgaagctccgatatacatagtcatggaagggagtgagccaccctttttcacgcgctttttctcatgggactccgcaaagtcttctatgcacggaaattcgtttcaaaggaaacttaccatagtgaaaactgggggtacaccaacagtcgataaacccaagcggagaacgccagtatcatatggtggaaggtctagtagtgtgccggacagatcacaacgttctagaagtatgttcttcagccctgagcgagttcgtgtgaggggaaggtctcccgctttcaatgcactagcagctgcatttgagaaccctaatgctagaaacc

SEQ ID NO: 2324 - DNA, 459 bp, Gossypium hirsutum
  Clone ID: uC-gsronu33B089c12b1
agtttgccatataatcatataaccaggctcgggcggggtactataaggccaccgcagtgccgaaaatcgccttgggaacaagccaagaggctgctcagcctgactgcatcaaagcccttgtggtcgagtttatcaccactttcctctttgtattccgtggagtaggagctgccatggccgccgatgagtcgggggcaaatgcgctggagggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcattttcagctgtttgtatacttttcaagtatcttaccggaggattgaacacttcggttcacacattagcaagtggaatggggt

SEQ ID NO: 2325 - DNA, 432 bp, Gossypium hirsutum
  Clone ID: uC-gsronu33B089d04b1
tctttttgcgtcctgaagaagaagcaacaaatggtggggagagcaaagctgcttggcggagccatgtatgagtatggacgaggcaacgaaaaacaagcactagaaatactcggtccagattttgatgcttatagttttaagattattggggcatctgatgaacagcttgatgtatttaatgaagtctggtacactatgttgctgaatactggacaagttaccaaagcaattgaattaatcgagaaacagataccgaagagggaaggggcttctttcctgtggcgtctgctggagaaaggttataagctgactggcaggcaggaagccgcgactattggtgagagggccagactgttggaggcagcatattttaactagcctgaatgtgcactagtagctacatatatgatatagcatttgtttaaagaacag

SEQ ID NO: 2326 - DNA, 346 bp, Gossypium hirsutum
  Clone ID: uC-gsronu33B089d05b1
caaaagagacgaaaacttgagtatcagaaggtgaagggtgagacgcgcaagatggcgatcgggactgggatgaaacgtaccccctgtatgaatctcgtgatagtagctatattgaagaagggaaaaggagcactgaaaatggacggacagataggtcctacactaaaaggagaaggcagcctaagcattgaaacctccccaaggtagatggaaaagtgaaggtagaggatgagcggaacaagcgattggatactgggggtgaatccaatggaagaaaccaaagggaatcactcctgtgcaagcttgctactgcaggggctaataaagacccaatatatgaagtgaa

SEQ ID NO: 2327 - DNA, 571 bp, Gossypium hirsutum
  Clone ID: uC-gsronu33B089d08b1
tgtgtgaagaaaatccagtgggctgagcctgggacagaatttggtcggcggaggagtgcaaggcaagagagctgtgatgtcttctctggcaagtgggtttttgataaccaatcgtatccgctttacaaagagtctgattgcccctacatgtcggaccagttggcatgccataggccataagcatggaaggtctgatctgcaatatcaatattggagatggcagccccataactgcaatttgaagagatggaatgtgactgaaatgtgggagaagttgagagggaagaggctaatgtttgtgggggattctctaaacagaggtcaatggatatcaatggtgtgcttgttacagtcagtgatcccggcagataagaaatccatgactccgaatgcgcagcttaccattttcagagcagaggaatataatgccacagtggaatttctctgggctccacttctggttgaatctaattctgatgatccagtgaatcacagattgtctgaacggattatccgtcccgattcagtacttaagcattcgtcacagtgggagcatgcagatatactaatt

SEQ ID NO: 2328 - DNA, 519 bp, Gossypium hirsutum
  unsure (1)..(519): unsure at all n locations
  Clone ID: uC-gsronu33B089d09b1
gcctggcctcaggagctactccgatattgccgaggctgcaaaaaaggtaggatttgagattgtgaaggagaaggatctggccaagccaccgtctctcccctggtggactaggcttaagatgggtagaatcgcctactggaggaaccacattctcgtcattgtgctggctgccataggcatagctcctaaaggaaccgttgatgttcacgatatgttgttcaagaccgctgattatttgaccagaggtggggattctggaattttttcccccatgcacatgattctcctcagaaaacccaaggaggctccttcaaaatcctagacaatttctggaggtaacaccatgttgcagcattaattgtgttccacctcttgttactttacccttcttaatattttttttccttaaatttaatttccaaagtttcttctttcccccccctactttaatcaatcatcatgtacctccttttttgtttgatttaagttcgaanttgttgatttgggtnttaaattttt

SEQ ID NO: 2329 - DNA, 541 bp, Gossypium hirsutum
  Clone ID: uC-gsronu33B089d10b1
cccacgcgtccgcaagaagaagcaacaaataatgcaaagagcaatgctgcttgccgaagccatgtatgagtatggacgaggcaacgaaaaacaagcactagaaatactcggtccagattttgatgcttatagttttaagattattggggcatctgatgaacagcttgatgtatttaatgaagtctggtacactatgttgctgaatactggacaagttaccaaagcaattgaatcaatcgagaaacagataccgaagagggaaggggctcctttcctgtggcgtctgctggagaaaggttataagctgactggcaggcaggaagccgcgactattggtgagagggccagactgttggaggcagcatatttcaactagcctgaatgtgcactagtagctacatatatgatatagcatttgtattaagaacagattgaatcaccgttccagtcaccaccataatgaaactagaatgtaacatgtcctttaaatttgcatatttacattacatcgtctgatatgtaatacgggtaaattaagcta

SEQ ID NO: 2330 - DNA, 62 bp, Gossypium hirsutum
  Clone ID: uC-gsronu33B089d11b1
ttattttatgacctctcacatggtgtaacaaaaaaattacatacgattgaaatttttttact

SEQ ID NO: 2331 - DNA, 268 bp, Gossypium hirsutum
  Clone ID: uC-gsronu33B089d12b1
ttgtttttggtatgcgggtctaagaaatatgggtggggttaatacaacatgggggctgttcaagaaatggcatgaggtactggtgctaaggatctataggcggacggcttaaagtccattcccgtgtaaattggggccatgagcatgatggatttggtaccaagacgaatgaccacgtgtatacaacagaccttggtaaaaatttggccgcttttatagtgttcgaaagaagtctaatgtaatggcatactatttttgtgatcccact

SEQ ID NO: 2332 - DNA, 547 bp, Gossypium hirsutum
  unsure (1)..(547): unsure at all n locations
  Clone ID: uC-gsronu33B089e04b1
agaaaataaaaaaaccagacatggcttccaacactggtgcgtccgttgaacttcttcgtagcttgaactagntgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagctcatttccactgtttcctcagcaatgtttgggtttttctttacgtgttctttttttttctgcgcttgtttaattaggtattatgatatgtcaagggttagataaaatggtaaaggtt

SEQ ID NO: 2333 - DNA, 528 bp, Gossypium hirsutum
  unsure (1)..(528): unsure at all n locations
  Clone ID: uC-gsronu33B089e05b1
ctttcccaaagcaattacttctcattttcaagaacgttgtgttttaaaggcttcttggtgtattctttgaagatattaatcacgaaaaatggcgctgggttctttcatcggcaggggtctttttgcggcagagttcatcctctctgcttggcaagagttcaatgaatttggcgtcgatggtggtccagccgctaatgagctgaggccaaagttcaacgtcttctcaaagactgggtcgtctcacacagggttgcaagtgcctgaatttgatatcaagtatgtagttgctgctgctgtagcctttaaaggtgttgggagtattctctttacctttggcagcaccgtcggagcttatcttctgggtttgcaccaactcggtcttactcccattgtttatgacttctacaattacgacacggaaaagaaagaagtttgtcttctttttacaaagttntcacagaacttgacgcttgtaggggcattgctgttcttcattggcatgaagaactcagtcctcacaagacaact

SEQ ID NO: 2334 - DNA, 574 bp, Gossypium hirsutum
  Clone ID: uC-gsronu33B089e06b1
tgctcgcctcctgcaccgccgcgccttactggccgggcccacccaggccggtcaaccggaatcctcgtacttatctgctgtttcgttgaccggaagcagttttctttggatatttcaacgaagttaggaagcagtttctctttggttccgttcattattgtggttgcattgtgcacaattttggctatggtagcgacgttaccgcttgcacagctattcttctttcacattctactcataaaaaagggaatcagcacatacgattatataatagctttacgggagcaagagcaagagctacaaggtgtcggtggccaacagagtccacaaatgtcccctgccagctcgcttactggattaagtagtgctagttcgttttctactttccaccggggtgcatggtgtacacccccacgcttgttcctcgaagatcagtttgacgttgttcctcctgataccggatctgtaagttcgttcgggaaaaaaatggtccgggaggaacccgataagaagaagaatccaggtgcagttaagatcagtccgtggacattggcacggttaaatgcggaacatg

SEQ ID NO: 2335 - DNA, 520 bp, Gossypium hirsutum
  Clone ID: uC-gsronu33B089e07b1
atatattaatgctgctactcctccggctaccgctcctcacattcccccctcgacccaccacgcctccgttttttcgtacgctcaaatacatctttctttcgtctcatttaaaatgccttgggggttccatattcagagcttgaccaacgttttctgtaatccctcccacccagttacagctttctttcctctttagagcctcctttgctcgaacatgagcataagtattctcttttttaggtataaaatgaaaccatatctcttgaaatctgtcttttgtgctttgaatgtctttaataattgctccaatggccgattagtcaatctcgaaactttggcatttctttataacagtttttgagtcgttcattactttcattttgtttaatcccatgaagattcctaattttattgcttgtaaccctgcatgagcctctgccatgaacggagtagctatattggaatgagtgaccactattcatgctaagatcttcccctcttcatttcgtacaagcaaccc

SEQ ID NO: 2336 - DNA, 536 bp, Gossypium hirsutum
  Clone ID: uC-gsronu33B089e08b1
tccacgcgtccgcccacgcgtccggtcctttggactggtttccttgcaacagttgtcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaacagaggagctctatttactgccctggtggtaatatatgcccttacgtcagggattgcaggctacgtagcaacttctttctactgtcagcttgaagggacaaactgggttaggaatctgttattgactggctgccttttctgtgggcccttggttcttacattctgcttccttaacacagttgccattgcatacagtgcaactgcagcactgccttttggaactattgtagtaatagtcctcatatggacactcgtgacatc

SEQ ID NO: 2337 - DNA, 504 bp, Gossypium hirsutum
  Clone ID: uC-gsronu33B089e09b1
tggtgatgagttctttgcattcattgttgatggcaaagtttcaaaagcttgtacggttctcttaaggggtgctagcaaggatctcctgaacgaggttgaaagaaatttgcaggatgccatgtctgttgctagaaacataattaagaatccgaaacttgttcccggaggtggtgctacagaattaaccgtttctgccaccttgaagcagaagagttcatctgttgaaggcatagaaaagtggccgtatgaagctgctgctcttgcttttgaagccataccacgtactttggcacaaaattgtggagttaatgtgattcggaccatgactgctctgcaaggaaagcatgcaaatggtgaaaatgcatggattggcatagatggcaacactggtgccattgctgacatgaaggaaagaaagatttgggacgcatacaatgtgaaggcgcaaacatttaagacagcgatagaagcagcatgcatgcttctacgaattgatgacattgt

SEQ ID NO: 2338 - DNA, 439 bp, Gossypium hirsutum
  Clone ID: uC-gsronu33B089e10b1
tcgtgataaactcccaggacagcataagaaagagggagaggttaacaccccaccaccagctgctgctgccccaactgagaacgaccaccatgagggagagacaaaagagaagaagggatttttggagaaaatcaaggagaaaattcctggttaccactccaaaacagaggacgagaaggaaaaagagaccactgctccccattaatgaatcaatataatgcatttcaagtaaaagatgtctatgagattgtgtggtttattaatttgttggaactgtttgttctctgtatttctttttggggttgcatacatcatataaatttctgcgtctgttttcatgattgtaagtaaaaagtaaaagggtatgtatatttaatgtttttaatgttattataataattaagaaatgatggtactatttcctttttatcaaaaaaca

SEQ ID NO: 2339 - DNA, 364 bp, Gossypium hirsutum
  Clone ID: uC-gsronu33B089e12b1
ttatttgttctacgcagtcccaacaaatataggcggagaaactacaacatgggcggtggtcttcaaaaagcatgatataaggatgctaaatatagcacaggcgaatgggggacagtccactccctaactcataggagtattgagcatcaatgatttgctaccaaggtgaacgattaatttccaccacaaaaccctggaaaaaatatgtccactataatagtgatcaaaagaaatctaatggaatagatatacatctttatgagcacactataagtacagaccaacggccaaagaactgggaccacaatagactgcactatagaataagctatgctgcaccgtcgaataaggagtactgcgactc

SEQ ID NO: 2340 - DNA, 438 bp, Gossypium hirsutum
  Clone ID: uC-gsronu33B089f01b1
tttcaactcaaagaaaactcccaagtaatattagaggcgtgggtgttgacacttatggcggtgagtctacctctccagtcgcccctgccaggcttttcaaagctttttctcttgaagctgacaagggttggcccaaggctgctcctcaggcagtcaagagcgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgaaatca

SEQ ID NO: 2341 - DNA, 315 bp, Gossypium hirsutum
  Clone ID: uC-gsronu33B089f02b1
gccaaatccaagaaggccacggtcaccaccatgatggtggtgtgttttttattgatgacttcccttttaatcttggaacagcccaataaagttgttgaatccaagacatagtctttctatgaataagacatagttttagtacatgtagccaaatctgtctagagaactcgcattcaataagatttcaacttctttctttcttatgcgcttttagattgtagatggttgaacaactgtgaccgatcttgatgtacttttattattttcaataaaagatctcgtttgatgactattgccaggaatcatctggcgacc

SEQ ID NO: 2342 - DNA, 552 bp, Gossypium hirsutum
  unsure (1)..(552): unsure at all n locations
  Clone ID: uC-gsronu33B089f04b1
ctcataactcctcaaaagtcttcttcaatggcagggcgggttctagtaaaggcttggggcttattttctcttggtttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtactgtcaaaacaccgacgccgagaagaaaaccaatctgtttgaaatccaagccatcactcgccgccatgtntcgctcgatatagcgt

SEQ ID NO: 2343 - DNA, 445 bp, Gossypium hirsutum
  unsure (1)..(445): unsure at all n locations
  Clone ID: uC-gsronu33B089f05b1
aaataactcaaccatgaaaagcctctctgtttcaggtgggtttttgcttactttggggcttacttctggaaattgggttattacaaatgctgcacctattcgtgaaaaaccagatatgtgtgagaaagcatttcctgattgctgctgcctaaaagataattgcgatattcgttgtgtggatatatatggaaaaagtgcttttggatattgctccactttaaaagaagaagatgatgtttgtgtctgtcgctaccattgttagttttgtttattctttttaaaggctactaccttattccacctttagtaaattgatttctacataagggatcaattgaaaccctaaatcaaaaaatgaataaaagctaaacatcctctctcctctctcgttttcatatcatatcatatatatatataattaatataaattatggtcctnnnnana

SEQ ID NO: 2344 - DNA, 545 bp, Gossypium hirsutum
  unsure (1)..(545): unsure at all n locations
  Clone ID: uC-gsronu33B089f06b1
aaaaattctaaaaaaaaatttaacaagaagagattgtattcaaaaagaaaaaaaggagaggaaattggatgcaccaaaaacgattcagcatgaaatggaagcaatacgctgaagatctgtttgtgagaatcggaagaggaccagttcacttttacgaaatctgcttgatgttattgaggaagtacagatagcacggttagaaattaggggtctgattcttactagcttccgttctccatctgatcacccgtcaagagggacaaccagaggaaatgtctttaatcataaatttactgccagagagagtagaaaatttaaaggtgcctagccaagagatgttctgaagggaagactaatgttatgaaaaagattaagtttccacagatggagtagaaatctgctagtaaaactgttcaacgacaagcaaagaggcagcactaccttgtcctctaagagaaattttggaaaaggagaagaagagctattttaaatatattatcgttggagaatgtgaagattntgacatttttcaatcacaagatgag

SEQ ID NO: 2345 - DNA, 566 bp, Gossypium hirsutum
  unsure (1)..(566): unsure at all n locations
  Clone ID: uC-gsronu33B089f08b1
gtgaagatgatcaaaaaagatgaaggacgcagggagaagtgggttctaagaagggccttcgatgatgaagagcatccctatctgccaaagcatatcctctacagacaaaaagaacagttcagtgatggtgttggttatagttggatcgatggtctcaaggcccatgctgcccgacatgtgaccgataagatgatgttcaatgcttctttcatatttcctcacaacacaccaactacaaaagaggcatattactacaggatgatttttgagaggtttttccctcagaactcggcaagattgactgtccctggaggagctagtgtggcatgcagcacagctaaagctgttgagtgggacgctgcctggaaaaacaaccttgacccttcaggccgggctgccttgggggttcatctctcagcttatgacgcagagactcccctcagcaacaagccatccaaggttattgatagtataccacggatggactntctggagttgccatacagagttaatgcctgcctactggaagacnnacagatgtatganatatttataaaatgagtagg

SEQ ID NO: 2346 - DNA, 544 bp, Gossypium hirsutum
  Clone ID: uC-gsronu33B089f09b1
accacgcgtccggaaaaatgggaagcaatcaggctgcagtgtctttcttaaccaacatcgcacgcgcagcttttggcctcggtgccgctgcaactctcctcaatgcctccatgtacaccgtggacggtggcgaaagagctgtaatctttgatcgtttaagaggagtgttggacaaaacggccgaagaaggtacccactttttggtcccatggctgcagaagcctttcatctatgatatacgtatgaagcctcacaccttctcatctatttccggaaccaaggatctccagatggttaacctcactcttcgagtcctttctaaacctaaggtggataagcttcctgaaatttatcaacgccttggtctcgagtacgatgagaaagtgcttccctccattggaaatgaggtgttgaaagctgtggttgcacagtccaatgctgatcagcttctcaccgagcgcccccaagtgtctgcattgtcctgtattcactgacacagcgtgcgagggactttaacattgagctagccgatgtagcgattaca

SEQ ID NO: 2347 - DNA, 551 bp, Gossypium hirsutum
  Clone ID: uC-gsronu33B089f10b1
gtgtgaccctgtgacagagatgcttttcattggtgggggtagattaaagagtggtgcaacaaatggtggtcgaactggtttcttcaactcaattgtgttgagacctggagatttttgtggagaggaactgcttgcatgggctttgctaccaaaatccaccctgaacttaccctcttcaacaagaacagtcagagctttagttgaggttgaagcatttgcactacgtgctgaagatctcaagttcgtagcaaaccaatttagacggcttcatagcaagaaattacagcataccttccggttttactcccaccattggaggacatgggcagcctgcttcatacaggctgcttggcgtcggtacaaaaggaggatgatggagaacagtctgatgacagaatcactttctttggatgagaaagaggaagatgagactgggcaggagaaagagaagaatttcatcgtaggctccaatccttctcaggcaaaactgaaccttggagtcacaatattagcatcgaggtttgcacacacactaggagaggagctcaaaa

SEQ ID NO: 2348 - DNA, 455 bp, Gossypium hirsutum
  Clone ID: uC-gsronu33B089f11b1
tttttagcagcttaggtaaccagttcgcaggggtggggaagaattagaaggaggcagataatcccaccaagtcctgcaaggcaaggggctatgatctcagggttcattagaagaacacaagggagactgcgtttgctatcatgaagctgcctcagggtcaggctaacaggaatttggaggatgttatggctcacaaacaggccggacccttcagactcttctgtggtggtgttgaacgtacagctcaggcaaagaacaggcattgtaacggacaaggacagtggcctgtaaaatctgccaaatttattctagatttgctgacaaacgctgagagcaatgccaaggtcaagggattggatgcggatgcactctatatatctcacattcaagttaaccaggctcagaaacaaatgccgcatacataccgtgcccctggaagaaataatccttacatg

SEQ ID NO: 2349 - DNA, 315 bp, Gossypium hirsutum
  Clone ID: uC-gsronu33B089g01b1
cccacttttcctaaagcccttcattactacaaagaagggtgggagattaaaaacaaaaggtgccgtatacatttaactcaattgtgcagtccaacaccttacaattggtcaaaattgcagaaacatcaagcaaagatggactcaccatcatttgttcgaaaagaggaggaaatttgttcttgcatggtcactccaactggctccagactgtacctgcgaaacctgagggaatcatgttcaacttcgttcccattacttctctatctgactgggattacaggaagcgggtatctcagtcatgcaatcaacttgtat

SEQ ID NO: 2350 - DNA, 352 bp, Gossypium hirsutum
  unsure (1)..(352): unsure at all n locations
  Clone ID: uC-gsronu33B089g02b1
cccacgcttccgcccacgcgtccgcccacgcgtcctagaagattcgtgtgctcatgggcgagcagataagctcaacttttatgcaataaacagttgttttctggaattggttctttcaatcagttgtggataatatgaaagaaccatccttattttggaagaacaatgttgtttcagctcttaaattttaaacacatatcagaagtatgtttggcananaaaaaaaaaaaaaaaaaaaaaaaaaaaaaaaaagacattaaaaaataaaaaaaaaaggaaactcatatacaaaaaagtgctgtttttgattttgaaaggcgaaccccaacatggttatagtggagggttgttt

SEQ ID NO: 2351 - DNA, 92 bp, Gossypium hirsutum
  unsure (1)..(92): unsure at all n locations
  Clone ID: uC-gsronu33B089g03b1
aattctggtacacctccgnggacccccccaccataaccccctctacccacccctcctcctttttttcctaccccctcatcctcccctcccac

SEQ ID NO: 2352 - DNA, 547 bp, Gossypium hirsutum
  unsure (1)..(547): unsure at all n locations
  Clone ID: uC-gsronu33B089g04b1
cccacgcgtccggcagtcgcaagaactgctgtatcgtcggctctgctcttcatgccgggggccccccctttttaacttcgatttagacgaagcaaatcaggatgtcgacggcgcgcctatgttgatgcactggaggagaacgtgcgttgtgcgggggcgacgtagcctgattcgtctgcggcggaggcgtgcgagggagccttgctgacgtgcggcgctggggcaaaaggctaggttttttcggatgtgtgctgttagggctagctgtagaacccttcgatcaacaaagatgactggagatgcaagtgaggaagctgttcccgagatcaaatatgttaggacttcaaattcagctgaagatcacagcggttgggttttatcaaagcaggagtagcaagcggcaacttcggcttccggaccgagcagaaaaggccctggtctttagtacaaatctctctcattctgatttatggtgctcatttttttccttttggccttctggtttggaatattcaggactctagtattggtacatantgtatataag

SEQ ID NO: 2353 - DNA, 58 bp, Gossypium hirsutum
  Clone ID: uC-gsronu33B089g05b1
cccacgcgtccgggctatgcttatggccttatctgggtaatgaagaatccttactgag

SEQ ID NO: 2354 - DNA, 526 bp, Gossypium hirsutum
  Clone ID: uC-gsronu33B089g06b1
cccacgcgtccggagagtgataaatggatttattggggactttcttgctgggtttgcgtgattgactaggctcctgctgcaagctttcctctccattaaaaatggaaataaatcaagccaacgcaagctcccgcctggtccacgccggattccaatcttcggcaacctcttcgatcttggggataaaccccacaggtctttggcaaagtttgctcggattcatggccctgttatgagtctcaaactcggcagcttaatcaccgtcgtcgtctcctcggaaacaacggccaaagagatccttcaaaaacaggatcttatattctgcaaccgaaccattgtggatgcagttcgagccagccaacactatgaatttgggctgccatggttgcctgtgtcgccgctttggagaactcttcgcagagtcagtaatacccatattttctctagtctgaaactcgattccaatgaatacctgcgtcggcacaagattcaacaactgattgctaaagttggcgaaagtcgcctt

SEQ ID NO: 2355 - DNA, 559 bp, Gossypium hirsutum
  unsure (1)..(559): unsure at all n locations
  Clone ID: uC-gsronu33B089g08b1
cccacgcgtccgcccacgcgtccgccttactcgccgtggcggaaaacgattcctgggagtttctattatcctctttctctcaaaaccctaaaccgtcgccaatcataataatcagattcttaaaatttgatgtgatgaagagggcaatgccatgggatgatcatgatgaggcaaatgattcatcatcttctgacgaatcttcatcttcaaatccggactctgaagctgaagatggacctcccaacaccaagcttaagaactcatcacaagcaaaatctaggaaacaaaaaagtgctgctttggattttgaagcattgaagcgacatggctataatgagnggttgtctgtcctaaatgtacctcctccaaaagagaagccagactggtcttggtcaactggcagagaaagcagtgaaatcagggagattaaagaatctttcgaggacagacagaaaactagagccgcaatattggatgcagaggagctggttaatggacaaacctcgaaaggagaacagaatngttncttttcacagaatgagaagcggaaaagagaact

SEQ ID NO: 2356 - DNA, 468 bp, Gossypium hirsutum
  Clone ID: uC-gsronu33B089g09b1
cccacgcgtccgcaattatcttcttctcctttgctgtcccgctctaagaatttccgggcttaaaaagctatgtctcagactgttgttctcaaggttggtatgtcatgtgagggctgcgttggagccgtgaagagagttttggggaaaatgcaaggtgtggaatcatatgaagtagatttgaaggagcagaaagtgactgtgaagggcaacgtccaacccgatgcggttctacaaactgtgtcaaagaccggaaagaagactaccttctgggaaggagaagctccggcagaagccgagacaaagccggccacggcttaaaatgtcttaagcccttattgattgattgattgaacatttcaaactatcctattcctatgaactgtagaattcttggatgattgtgatttacttcctgtgttggtaactaaaaacggaagatgatttcttatgaaatttccctacttttta

SEQ ID NO: 2357 - DNA, 513 bp, Gossypium hirsutum
  Clone ID: uC-gsronu33B089g10b1
atcatcaacccttcatttgatcatcatcatgggcatcatttgatggagttcggtgaggtggatgtatggaacaattcaaatgatcaagcaacaaccaacttagaagccaaaaaaccattgccaagataccgagcttcctctaagaaagctttcaaaaagaaggagtttcagattagcgataataataaccataggagtgcccaaatgactgctgcttctgcttcattgccggtcaacatccctgactggtccacgattctcaaagcggagtacagggaacatgggaagaccgatgaagatgctgtcgacggctatgactacggtgatcgcgacggaagggttccaccgcatgagtactaggctaggagacgaggagcttccttttctgtccatgaaggaattggaaggactttgaaaggaagagatttgcgtcgtgttaggaatgctgtctggaaaaaacaggttttgaagaataacccacaacatcataaaacaacaacccaggtttatttc

SEQ ID NO: 2358 - DNA, 391 bp, Gossypium hirsutum
  Clone ID: uC-gsronu33B089g11b1
ttctttgtgaatccaatcaaatagaagatgtggggagagttaacgaggcggatcactgcttgaacgtctgcgaggaggtctgaccaggccacctccgctatagactctagttcttccatagacggctacgatgcttctgattgtctcagatccaataactcctgctcctcattatccttctatttcgcttatcaaatcgttcatgccaccagaggttttgcttctgagtcactcaccccaaaaagtgaccacagggtgattactgatgttccaacaacagtggctgctattaaaaaccccagttctaaaatagtttatgatgaatacaaccatgaactggtgtcctcctggtgaccccaacaagctgggcattaggctattttgtgctgac

SEQ ID NO: 2359 - DNA, 96 bp, Gossypium hirsutum
  Clone ID: uC-gsronu33B089h01b1
agctatcaaagaaatatacattaaagccaaaaaatgggagcaatgtacagagtatatgtgcattgtgcaaatttataaaaagaacaaccacaaatt

SEQ ID NO: 2360 - DNA, 312 bp, Gossypium hirsutum
  Clone ID: uC-gsronu33B089h03b1
tcgtcatttagaacgccaaaatcctccttcacaagggcgtgttatactaccctatcggaggggtcaaccatctccaaaagtgcccccatctcctacaccaaaaccttcacgacacccggggcattcactggacgcactgatagtcaacatccctccctccaccatccatatgttgaagagatcaattcataatgaatggctgcattttgacatgataggtgactgactattggcatcaaagtaaagagtgtggcatttgaataacttgacacctacattgtcactattgatgtttgtgttgaaagactctta

SEQ ID NO: 2361 - DNA, 323 bp, Gossypium hirsutum
  Clone ID: uC-gsronu33B089h04b1
gtcttcaaaagaactgagggcctagtgcaggcttaatataaactaactggggataaaataatcgacaaaagtgtttatggaacatataacaacaaatccagttcatcttccaaatacaaacaaacacgagccctcaaaataaataatgaatcaagctgcaaaattaaggggtatcatgggtatttggccacgtcttatcatacagcaatcatttctgggttttctctgatttcatcctatttggaaagtgtggcatcatcacggaatacggttaaagcacttctcataagtcttagttcaggattacttcctatgagtcttca

SEQ ID NO: 2362 - DNA, 521 bp, Gossypium hirsutum
  Clone ID: uC-gsronu33B089h05b1
cccacgcgtccgcccacgcgtccgctgcttcgaaggccgaggaagggaaacgtgctgggcaacttctaaatccccttctaagacaaaggctaaagcggcggctaaaccaaaggctgctcctaaggctaaatccaccgcaacgaagacgaaggctgtggctgctgtgaagccgaaggcgagtgcatctgctaagccaaaaaccgtagctaaatcgaaggcgaagccaaaggaaaagccggctaaggcttcgaggacttcaacaaggacttctcctgggaagaaggcggctgtccctaaagctactccgaagaaggctgccgcgcctaaaaaggctccttcgaagagtgctaagccgaaaagtgtcaaatcaccggcgaagaaagctacgacgaggaggggaaagaaatgagaagggaggctagtcgaaaaggggtagtattgtaaattgcagtgatgtatagtgggtggatatggatccacgtatactcacgagatataacattcagatctcttttttaata

SEQ ID NO: 2363 - DNA, 556 bp, Gossypium hirsutum
  unsure (1)..(556): unsure at all n locations
  Clone ID: uC-gsronu33B089h06b1
ctctttcattcaatacccaccctctgatcattaccggaagccctcttgtactacccgcgggcccaaccttggttactctccctccctctccctctttttcaagttcaacacttttcaactggttcggttttgtaagtaagagggaaggaaaggaagaagagttttctttttatttatgattttcctgtatttgtttgtaattattaaaacttagattcagatgacagttttttccacttatagaagttaaagcttcttcagatctatgaagaaaattcccactgattttcttcctttattttctttgctccgttaaactgtagtgtaaattctatttctttgggtttttgaagatgatccttgaaaagaatccatttttctctttcattttcactccaaaaatatctctgtttttctcgagagaattcgagttccttttcactctctttcacttggggtcttgagagagagttcgaaacattntaaagaaaaaaaactttcttttttttttgaatctcctcaccccactatgggtcttagttaaaattttcagatc

SEQ ID NO: 2364 - DNA, 360 bp, Gossypium hirsutum
  Clone ID: uC-gsronu33B089h08b1
tcctttcgtccgattcatcaacgatcctcatggttgttggatctaaatctttggtgtgggaatgaattacacaaatagttaacagtttagcttaagttaatgcttcaccaagttcaggaaattgatctgacaaactcaagtgaaatcttaattgaagcacatttcattctagttatgtttatgttttctttatgtttgatgtgtataacaagtaaggtgaaaataaagagttttgtaagagaaaattcaaccttgaaatttactaaattctatttatattacatataaatttgtatgccaatgtatcatttacctgctttacaaagtcatgaatgaagtagaaaaataagtgatgaaaat

SEQ ID NO: 2365 - DNA, 416 bp, Gossypium hirsutum
  Clone ID: uC-gsronu33B089h09b1
ccatttcttccctaccccgattccctttatttggtcgcgccaatttaaacaaattgggaggcctctacatctcctcaaagggtacagattcttcttctcttatagttaaaaagctgtcatttttcaaccaaatccaaaccctaaattgcgtctctcccaatttcttcttcactttgagggtttcttgcaatagtttatagagaggtgagaccaagtaattttgggttacaacatagaaaccaaagtaactaaaaaggtggatatatatgggatattgggtaaccgagattccaagctaggcaaatcaagcatacccaggagacgacaatgggttaaaagaagagaaacatgggtggatatacttggtgtcatcctcaattccgtttacatgttaagcattttccacatctacttca

SEQ ID NO: 2366 - DNA, 305 bp, Gossypium hirsutum
  unsure (1)..(305): unsure at all n locations
  Clone ID: uC-gsronu33B089h10b1
tttattgcctaggcgaaaggctatagatgcagaggcgaggcaatttaaanaagggagggaaatattaacctgggcaatagcagtgcatggtggtgctggtgtccaccctaatcttccttaagaaagacaagaggaggcctaaagactactcactcggtaccttgatattggaatctctggtcttcggtttaacctacccgccattgacattttaaagcttggcctaagagaattggaaaccaatcctctggttaacttccggcgtggatctttcctcacagacaaaggaaccctggaaattgaaa

SEQ ID NO: 2367 - DNA, 331 bp, Gossypium hirsutum
  Clone ID: uC-gsronu33B090a04b1
gggtagaattctcttcttcctttgcgttgtgttctttgttggtcaatcgccatggcttcaaaagcggatttttgaaggaacttaagcatttgcaaaaagaaccacccactttttgaagtgctggtccagtagctgcagacatgtcttattgtcaagcaacaatcatggtgcccttagatagcccttatgctggaggtgtgtttttagttactatccattgtccctccataatatcctttcaagcctcctaaggttgcgtttaggaccaaggtcttccatcccaacatcaacagcaatggaagcatttgtcttgatatcctcaaagaacaat

SEQ ID NO: 2368 - DNA, 560 bp, Gossypium hirsutum
  unsure (1)..(560): unsure at all n locations
  Clone ID: uC-gsronu33B090a05b1
ccttcttgtccgcagaactcaacactcccatcaaggcggctgtaagattcttttctgactaatattttctttctgatctttcattttcccgagaaaatatacttatgggttcaaaacaaagatgttggcatcgtcagaaaacctagcgaacatcgaaacgtcgacgtttcgttccctcttcgacgatccttggatctccgaatccttttctcgcgacacacaaactttgacgatagcgttacaaaagtcaatatccgattcctgcaccggctccatcgcttcgccggtgcctgaaccggcacccaaacagtaccgaaccgccggtccaccgcctaccgggaaagtttccaaacgtaagcctcgcgcctcgaagaagtctcgaactacctttatagcggcagatccagccaatttcaggcagatggtacaacaggtaaccggaattggatttggtgacngaaagatgacgactgtgagtccgatccttaaaccggagccttaaagacccngcaaccggttacctaacggtactgngcctggatatttacctacgttggaca

SEQ ID NO: 2369 - DNA, 497 bp, Gossypium hirsutum
  Clone ID: uC-gsronu33B090a07b1
ttttcgcgtccgctctaaggaggacgaaatgaaggcagaaatatgaacagattgggctgcccttgaaggagtatctcgtgtcaatacccttttgaatctcccaaggttcgatcctggaaagtaatgttctgatgtaggaggttcaaagccaggcttcgacatgagaaaggttcggttactactactattactttgagatttgctgagataaattattgtaatatttatattcatttttctacagagtggaaaagaggggcattgatttggtttggtttggtttgatgttaaaaaatggagcaagcagacccggctgtattagtgtgtctgggaaattgtcctttctatctatagtctgttgggtagaattggaatttttgtaaatccagctcttcccttcattaatattgttattgttaaatttgtgttccaccttcaactgttcatgtgtgaattgtttggtagtcattggattattgttttaaatgttacttttg

SEQ ID NO: 2370 - DNA, 490 bp, Gossypium hirsutum
  unsure (1)..(490): unsure at all n locations
  Clone ID: uC-gsronu33B090a08b1
cctacgcgtccgcccacgcgtccgcggacgcgtgggccagttgtgccggactcaccgcacctgctaattccgcaaccatgatgtcctcaaacatatccgattggagctcccctgatgggaaacttgattggggcattcaaggagatgagttaaacaagcttaggaagtcagcttccttcgggttccgtaacaccccaacaccaaccccaaccccaaccccatccaacatcaacgagccagatgtctcgtgggttcattccctcgttaaagatgttacacccgcctccagcggctcgatgcagcaacagcagcaacaatacaacatcggtaaaggtgttcgagaaaggcttccaccatgggtggaacaaatgtacatagaacaagagcagatggtagcntaaaagagaccctttttgctcattgctttaaatctaacttccattcagttggtaatagtaattccgatagtagcgttagtccatggtagaat

SEQ ID NO: 2371 - DNA, 379 bp, Gossypium hirsutum
  Clone ID: uC-gsronu33B090a10b1
tgaatctctcttcttccttagcgaagtgtcctatgttgttcaatcaccaaggcttgaaagcggatgatgacggaactcacggattagcagaaagatccacccacttcttgtagtgctggtccagtagctgaagacatgtttcattggcaagcaacaatcatgggaccctcagatagcccttatgctggaggtgtgtttttagttactatccatttccctccagattatcctttcaagcctcctaaggttgcgtttaggaccaaggtcttccatcccaacatcaacagcaatggaagcatttgtcttgatatcctcaaagaacaatggagccctgcactaaccatatccaaggttctgctctcaatctgctcgttgctga

SEQ ID NO: 2372 - DNA, 275 bp, Gossypium hirsutum
  Clone ID: uC-gsronu33B090a11b1
tttgtttaccctttgcataacttaagtaagcctggatgattattttggatgtgttgttggctatttgtagttcatttgaagaattactgcttttgaaaagattttaatcttatcaatcattttaatttagtgctatacaacaaaagcttaaaaccctactaaaagtaccaaagattatacaaccatgtctacaaacaatacaaccaaccgaataaaagccaaaaaaaaacactcccacgtcttaagtccccgtatctttaccaaccttgctctta

SEQ ID NO: 2373 - DNA, 503 bp, Gossypium hirsutum
  unsure (1)..(503): unsure at all n locations
  Clone ID: uC-gsronu33B090a12b1
cctacgcgtccgcagaaaccgaaatggaagttaggggcggcgcagactccgatccggaaactatccgttctcagttccttcaactactccgtaccagacgaaatgctcaacttcctttgactgtggaacctgcgaaacctgtggttaagcctttgttccaagacgttaccccgccaaccttcagtgaggcaatggaatcttgtccaaaggctaacattggaaaccttaaggaactgctcaaagaggaaaatctgtatctccatactgaggctggagatcaaggaaaattgcccgtgttgattttaagtacgaaaggaaacaatcaagaaaagaggcctgctgttgtttttctgcatagtactcataagtgcaaagagtggttacgcccattgcttgaggtaatctgaancaaacctttgaatttgccgatatcttcttattgtctataaattaagttgtcttcttttgtaggcttatgcttcacggggatatgtagccattgg

SEQ ID NO: 2374 - DNA, 555 bp, Gossypium hirsutum
  unsure (1)..(555): unsure at all n locations
  Clone ID: uC-gsronu33B090b04b1
ggtgaaggcaatcactacttacgctaccgggtaatggcctcgtgctacagaattcactttcctgagcacttgaagagccatcgctctcatgacatagtcctactttgtgttgactgtcatgaagtcgctcatgctgctgctgagaaatacaagaaacagattgctggagaatttggaattccactttatgtccgtaaggtggttgattcaactcaagcgcctattgtatctgggtcatctgagtcaactaactttgctgattcaggtgtctcaccactacaattgcgaacagctgccaaggctcttttgcgtcatggacctgaaatgcctcccagccgccgtgatgaactgacccagattgttatgagatattatggaggacgggaaatctccaacgaagatttagaaagagccttggtagtgggcatgagtcctcatgagagaagaagactcgagaagaagaaaggcttatctttaaaacagtctacaagaatccctcnctgtaaagaacaagaaagtaatgatgcaactaggatcttatctaccacatcagat

SEQ ID NO: 2375 - DNA, 503 bp, Gossypium hirsutum
  unsure (1)..(503): unsure at all n locations
  Clone ID: uC-gsronu33B090b05b1
cccactcagtcgtccacgcgtacggacggataaaggataacagtagatatgctaaccaccactggcttactttttcactttatcaatggaggatcaagaaacttacagtgctcacatcatttgcatccattcattgcaaacagaaaaatacaactacaatttgcgtcacatatattatcgaatatcgagtctatctgaaggaaaatagatgtgaaaatcaacgaattggaactatctgggtacccaatctcttaaccttttgattaaaggctgatgattgaaaagatcttgtcgatcatgacttactgccattatggacactgctatcgtgggagatgccatcgtgcctcgtctactctacccattttagtcctgctgttcttggcgctgcattgatgttgcttgccttatcatctntaatcaaaattgagatagatatggaaagtactggcgacagtatgacatggctagttttgctccagcattggcaatactagtggttg

SEQ ID NO: 2376 - DNA, 386 bp, Gossypium hirsutum
  Clone ID: uC-gsronu33B090b07b1
tgatctgcacccatcaatctgtctgatcggtggcgccaggttcttcgatgggctcttggatctgttgaaattttcctaagcaggcattgccctctatggtatggctttggaggtggtcgtcttaaatggcttcaaagactagcatatataaacaccattgtctatcctttcacatcccttccactcattgcctattgttcactaccagcaatctgtcttctcacaggaaaatttatcataccaacgctctcaaacctggcaagtgttctctttcttggccttttcctttccattatcgtgaccgctgttctcgagctccgatggagtggtgtcagcatcgaggacttatggcgtaacgagcaagtttgggtcatcggtggcgtttc

SEQ ID NO: 2377 - DNA, 508 bp, Gossypium hirsutum
  unsure (1)..(508): unsure at all n locations
  Clone ID: uC-gsronu33B090b11b1
ttttccttatgcaaatcctgatggagatttgggggtacttattggtgactggtgcaagaccagccacaaggcactgcagcaaactttggactctggaaaatctcttccctttccccatggagtccttataaatgggcagactaaaaccacctttactggagaacaaggcaaaacttacatgttcagaatctcaaatgttggattgtccacctcactgaacttcaggattcagggccattcgatgaagttggttgaggtcgaaggctctcatgtaattcagaacttatatgactctcttgatgtgcatgtgggacaatccgtgaccgtcttagtaaccttgaatcaaccaccaaaggactactacattgttgcatccacaagatttacaaggaccgttctcactgcaacngcggtgttgcactatgcanactcgcaaaccccagtttcttgaccgctaccagctgctcctgcttacaaatatctattggcaatgcagcaggcaagacat

SEQ ID NO: 2378 - DNA, 505 bp, Gossypium hirsutum
  Clone ID: uC-gsronu33B090b12b1
gtttttctgccagaccagcaacgtctcatcttggggggaatgcaactcgaggacgggcggactttaaccgattacaatatccagaaggaatcgactcttcatctggtcctgcgtcttcgaggtgggatgcagatcttcgtcaagactttgaccggtaagacgattactttagaagtggagagctcggatacgattgataacgtgaaagcgaagattcaggacaaagaaggaattccaccagatcagcaaaggttgatttttgctgggaaacaactggaagacggaaggactttggctgattacaatattcaaaaggagtccactcttcaccttgttcttcgtcttcgtggtgggttctaagccttaaggtctcccttaatgtgggtttttctggttttacgtgaaggactgcgccctgtaatggccttttaaataatttctagtctttgcttaccggttgcatctatgtatggtttctctttgaatggaatttgcatatttacct

SEQ ID NO: 2379 - DNA, 466 bp, Gossypium hirsutum
  Clone ID: uC-gsronu33B090c05b1
ggatttttcaaagaagggttcttggaagaaggcgggggtttttgcataccaaagtgtaggtgtggcttatggggatctgagtacttccccactttatgtctacaagagcacatttgctgaagacattcaacactcagagtcaaatgaagagatctttggtgttctatcctttgttttctggactcttactttagtccccttattcaagtacgtgtttgtggttcttcgagcggatgacaacggagagggagggacttttgcactgtattctttgatatgccgacacgcaaatgtcagtcttctgcccaacagacaggttgctgatgaagcggtctctacatataaacttgagcacccttcagagaaaaggagctgttcaagagtaaaagtgtaccttgagaagcataaggcgttgcacactgctttattaatcttggttttcctaagaccttgtatcgtgattgga

SEQ ID NO: 2380 - DNA, 226 bp, Gossypium hirsutum
  Clone ID: uC-gsronu33B090c06b1
accccctctgcggctcacatttcattggggggttttttgaaaccagtacggggttaaaaacctccattcacggctgcactaaagatcttttctttggaaaagattttcaacatgcgacaagcttatgatgacacttaggctgatctacaccatacctataattgattcccctacttctgcacaaattctcatacatcttcccaaggatcttcctggtactaaaatt

SEQ ID NO: 2381 - DNA, 393 bp, Gossypium hirsutum
  Clone ID: uC-gsronu33B090c08b1
cccacgcgtccggcaaaggcgagacccgattttgccgggtttcggaacacccaaatccccccgaatctctttcaagtcaaaccaccgtcatctccgccatggacttccaccgtaacccttccacaaactctgcctcttcttccacctcctccacttcctccgccgctgctcaccaccaacctcctccttcctccgccaccgacaacgatccgatgcattcatggtgggaatccgtctccaaacaacgttcccgcatcctttccctcgccgctctcctcccttccggtggagtcgccgtttcttccttggctgattctgaccgtcccgctgtctccctactctcgtcgcccttcgcttactctttgatttcctccgccctttcttctcctaaat

SEQ ID NO: 2382 - DNA, 453 bp, Gossypium hirsutum
  Clone ID: uC-gsronu33B090c11b1
gttaaatcccagcagaacaatatacagaaaggtggaagatgagttcgagggaacctagtttcgaagaattgttggaggagaagaagcgtgtcaggaaccctcttgtccctgtcggtgcacttattaccgctggagtgctcactgcggggttgatcagttttagacaaggaaattctcagttgggtcagatgctgatgcgagctagggtggtagttcagggagctacagttgctcttatggttggcactgcatactactatggggataatccctggaaatcgagttagaacactcggtttcatggttgcaaccattatattgtttttattttgatatgcaatttctttttatagctatagatgttgaacaaaagcatcataccaagaaagcaaatgccctcagattgatatagcttgcgaataaattaaatatgctctatgcatgtcttattct

SEQ ID NO: 2383 - DNA, 465 bp, Gossypium hirsutum
  Clone ID: uC-gsronu33B090c12b1
gctttttagcattctaaagaggtcatcgtaaattgtggtacaaagcgctaaccgaggggggagccaagtggaagaagaagcgtatgatgaggctgaagaggaagctcctaaagatgagacagagatccaagtagatgcgccttggactgaattagttttgccctgcaatcccttggcttcataattatcctgcatatgtgtgatgaagttgtgaagattgaatggtgttttcaggcaaccttatctgatttggcttgtatatctaggttaaagacttaagactgtgtgagatgtttgcatagttctattagagtttgtgcttgggatgcctggtatgctctgtgaaacactgtctcttaacgttctgagattttgtggttgacggttaattcttattatatggctataataacctagatagagtgtttccttttccatttaaaaaaatattcatgatgaatgggg

SEQ ID NO: 2384 - DNA, 576 bp, Gossypium hirsutum
  Clone ID: uC-gsronu33B090d07b1
tttcttatattcaagacgaattgggccactccagttggcattagctaggaactgaaaacatcagctatgtccactgtgatgtaacatgtgaatccgatgtcgaaaatgccgtaaacttagcggtatccaagtatggaaaactcgatatcatgttcaacaatgcaggcctcattggtgacggtgaagtcagagtgacagacgccagcactgacaacttcaagagagtgttcgatatcaatgtcttgggtggtttcttgggagccaagtatgcagccaaggtcatggttccggccaagaaaggttgcattctcttctcatcgagtatttcttcaaaaatcagcatcggtctgccccatgcatacaaggcatcgaagcatggcgtcgtaaggttgacgaagagcttggctgtggagttaggtgagcatggaattagagttaattgcatttcacctcacgcaactgtgaccccattgttcctaacaacactggggatgttcgataagaagagggagaggagatgattgcgacttcagcagtgttgaaaggcaccgttttggagcctgaaattttgacatg

SEQ ID NO: 2385 - DNA, 573 bp, Gossypium hirsutum
  Clone ID: uC-gsronu33B090d08b1
tttgttctgcaacagaaagatcatcctaaattgaaacgaatgggtgatgacttatttgtagagcatacattggcacttactgaggccctttgtggctttcagttcatactgactcacttagatggcagacaacttctcattaaaacccaacctggggaagtcgttaagcctgatcaattcaaagcaataaacgatgaaggaatgccgatttatcagaggccatttatgagaggtaaacttttcattcacttcactgttgacttccctgactcgttgaccccagaccaatgcaaggcactggaggctgtgcttcctcccaaggcatcggttcagctgactgacatggagctggatgagtgcgaggaaacaaccatgcatgatgttaacattgaggaagagatgcgtaggaaacaggctcaagctcaacaagaagcttatgaggaagatgaggacatgcatggtggtgcgcagagagtacaatgcgctcagcaatgataaaaaagccgaatgttcgagacacagacggtggttttggccgatggaatgtactgtggttaaaaaaaaaaaaaagac

SEQ ID NO: 2386 - DNA, 530 bp, Gossypium hirsutum
  Clone ID: uC-gsronu33B090e05b1
atttatttcaacgaaaatatccacaggtatttgagcggatttttactttctccgggtgcacagatccattttcacctatggctccagtagcagcaacatcttcagattctataaagcctagagatgtttgtgttgttggtgttgcacgtactccaatgggtggatttcttggctctctgtcatctttatctgccaccaagcttggttcgatagccatagaagctgctcttaaaagggcaaatgttgatccatcacttgtgcaagaagttttctttggcaatgtactcagcgcgaatttgggacaggctccagctagacaggctgcgctaggtgcaggaattcctaactcggtcatatgcaccactgttaacaaagtttgtgcatctgggatgaaagcaacaatggttgccgcacagagtattcagttgggcattaatgatgttgctgtggctggtggcatggagagcatgtctaatgtacctaaatatttgggagaggcaaggaaaggatctcggcttgggcatgatact

SEQ ID NO: 2387 - DNA, 556 bp, Gossypium hirsutum
  Clone ID: uC-gsronu33B090e07b1
cttacgcgtccgggctttgtcaaacggtgggttcgggagggaagccgccggattatccggcgtcataccggagggtttggttccagcttggtactggactgaccagttcgccatggaagttatttaccacaaccgtgtcttaagccacgagtgccggacgacggagccggattccgcgatggcgttttacatcccgttttatgccggactcgctgtcggaaaatacttgtggcttgggtatagttcgaaagatcgtgatcggtactgtgagatgatgttggaatggataaaggatcaaccgtactggaaccgttccgacggctgggatcatttcatgacgatgggtcgtatcacgtgggatttccggcggtctaaaaacgaagattggggttccagctgtatttacatgccgggtatgaggaacatcacacggcttttaattgaacggaacccttgggactatttcgacgtcgtcgtcccttacccaaccggattccacccaaggtccgattcagatatcgtccactggcaaaacttcgtccgtaaccgccgccgt

SEQ ID NO: 2388 - DNA, 462 bp, Gossypium hirsutum
  Clone ID: uC-gsronu33B090e08b1
agcgctttctctcatattgctccctgctgatagggttagaaagggtttctgtaggaatttattagttttgaaaacatggcaggcatttctttcagggttcttatgagagttgtgaccatctttgctcttatttttgctattgtctcacccaaagttgaagctcagtctgctgcacctgctccttctcctacaagtgatggaacttcaattgaccaagggattgcttacgttctgatgcttgtggcactggtgcttacataccttatccaccctctagacgcatcctcctacaccttgttttaaatcatattattcattttggtaacagagtactatatggataaatctatcaagttcctttctttttccctttctttttgggtgatggatgtagcggttaacggtttgcattggttttgagagattgattgattaatgtgattcctgaaatgatagcctact

SEQ ID NO: 2389 - DNA, 571 bp, Gossypium hirsutum
  unsure (1)..(571): unsure at all n locations
  Clone ID: uC-gsronu33B090e11b1
gttccagtcattcgaataaatctagaaatcaagggagaagacagagaagagagagctgagagagatcggatcagagatgtcatcacacaataacaattcaacttcggccaacgatcccagacaaccgtcggcggcaaagccatacgtggcgcagcctgtttcgccgcaagatctccctgtcgattattccggttttatcgccgtgattttcgggattgcaggcgtcatgttcaggtacaagctgagctcgtggctagcgatcatattctgcgcccaatcacttgcgaacatgaagaacgttgagaacgatctcaagcagatctctatggctatgatgtttgctatcatgggattagttacaaactatttcggaccagctcgaccaggaaaacagagttaaagataactccaatgatgcggttaagtttctaatttcattttgcacgatgatatcagatcatgaagtttagataaattgtgaccttattcaagaacaattttgtcggataattattttctatatgactaatngggttatatttataaaattgaaaatcctacttttagagcc

SEQ ID NO: 2390 - DNA, 499 bp, Gossypium hirsutum
  unsure (1)..(499): unsure at all n locations
  Clone ID: uC-gsronu33B090e12b1
tgttagatgtacccagacctgaacgttgccgaggggaccacaactgagactctgggtcttggtgtancaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttggttatgtgtttttagaataaagtagccatggcttgtcgtaggttttgcctggtgccgccacgggtacttggtgcttgccaatagatagagtgaagtactaatatttacttgtttttctgtccagtgtgagcatctctgctatctcaggatatattgtgactatctcataattaatgtaaggaagtgagtcagattcctaatgaatgagacgaagctcctatttcgtttaaaacaattgggcccttatttcatgatcgg

SEQ ID NO: 2391 - DNA, 511 bp, Gossypium hirsutum
  Clone ID: uC-gsronu33B090f04b1
gtttatgtctggctttacagcacgatggaaatattattttatctggtcaatttcagaggcctccattcttatatctggcctgggtttcaggggatggacagaatcttcaccaccaaaaccaaaatgggatcgcgcaaaaaatgttgacatcccaggggttgagttagcaaagagtgcagttgtgttaccacttgtctggaacatacaagtcagcacctggcttcgtcactatgtttatgagagacttattacaaaggggaagaaacctggttttttccagttgctggctacacagactgtcagtgctgtttggcatggattatatcctgggtacatgcttttctttgttcagtcagctttgatgattgctggttcaagagttatttatcgatgggagcaaccttcaaatgtaggtcttgtgaagaaaacacttgtcttcatcaacttcgcttacacactgttgattctcaactactccgcttgcggatttctggtataagcttgcatgagt

SEQ ID NO: 2392 - DNA, 489 bp, Gossypium hirsutum
  Clone ID: uC-gsronu33B090f06b1
cctattcttccctccttcactttctctgatcttctttctttgccttcgccacaaacttgcaaaaagagcttcgcttttcatttttttcttacgaaaaacaaaaaaagaaatggctaataatttgatgcgggccgttcaatacagtaaatatggcggaggagccgatgatttgaagcatgttgaagttctgattcccagtgcaaaaaaggatgaagttctgatcaaattagaggcagctagtattaacccaatcgactggaaaatacaggaaggggtagcccgcccatttttacctcgcaaattcccccacattcctggcaccgatgtagctggagaaatcgtacaagttggatcaggagtccaaagtttcaaagttggggataaagttgttgccgtacttggtaatggaggtgcactagctgaatatgctgtggctaaggaaggttccacagttccaaggcctcctgaagtatcagcccctgaagctgc

SEQ ID NO: 2393 - DNA, 541 bp, Gossypium hirsutum
  unsure (1)..(541): unsure at all n locations
  Clone ID: uC-gsronu33B090f07b1
cctacgcgtccgaaaacacgaccctcttgaaaggtgccataactagtagcaaccaagaactcgatgacgcgtcagctgccaagttgaagaaagctttgaagagcaagaaggggctgccattaaagataaagctcgatactaaagtggaagcaaaaatgggagcattgaagacaccaaaggtcgggataagggttgtttgtgaagggattaaagctaccggcccgaaagcaaaatcagcaaccacagcttcaacttctaatgcaaaatgtaaggttgatttgagactcaagatctggaaatggactttctgatcgacgagaatattttgagaaagagaaacaatggagaagaaaaaggtttgntggttattttattttattacttttgttatgggtgtttttnttttaaaaggtgtgtcggtatttttttagggagggaatatgtttgcaaattgggtgatttgattgtatagggtatagaaaaatgtaatggatacgctaattcttttcttttcaaatatattttgattttcattttgtgt

SEQ ID NO: 2394 - DNA, 274 bp, Gossypium hirsutum
  Clone ID: uC-gsronu33B090f09b1
tcgcttaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggtttttctgctatgtcagaatgtattatgatatttaagaaagtttgtttttctattg

SEQ ID NO: 2395 - DNA, 448 bp, Gossypium hirsutum
  Clone ID: uC-gsronu33B090f10b1
agggctctacagcgctgaagaactaggagtttatatgtaagattctttggagcgagatacatgatttactttactggaaattgatcatgttagaattgtgttgcaccacaagcataatggtgatcgctcaattattgtgatcatgcttttatcattggatgcatactgtagctccttttaagagcaaaaagcaaatatcatatgtaacaaggcctagtaaatttttttagattgtagatgactgagaaagttctaattggatattacaatgtattgaaaatcagtaagaggaagagttcctggttaacattggtaagagccactcatgaaaagcatgcccatctatgtgtttacataacatatccatatatcattgacctctaaatgagtatcacagattcagagtagatgtgtctagtgcctcctttttttaatcagttgtcactag

SEQ ID NO: 2396 - DNA, 452 bp, Gossypium hirsutum
  Clone ID: uC-gsronu33B090f11b1
gccagccagccctcgtttccctcattttcctcttcattttctcgggaaaaaagaagcatgggaaaaggtcctggtctctactccgatatcggcaaaaaggctagagatcttctttacaaggattaccaggttgaccacaagttcactgtcactacttacacttccaatggagtcgcaatcacatcaaccgggactaagaaaggtgatttgcttttggctgatgtaaatactcagctcaagaacaagaacatcacaactgatgtgaaagtcgactccagatcgaatcttttcaccactgtcactattgatgaacctgcaccaggattgaagaccatctttagtttcgttgttcctgatcaaaagtctggcatggtggaactgcaataccggcatgaatatgctggcataagcactggcattggattgactgcaaagcctcttgttagcttttc

SEQ ID NO: 2397 - DNA, 452 bp, Gossypium hirsutum
  Clone ID: uC-gsronu33B090g02b1
agctgcacgcctggcgtaccggtcactgaattcctcgacccacccacgcggtttcgtaaagcactgatccgaccaagaccgatgcttgctacctcttcaagcattggtgcgctatactaacttatcatgctcggggtcatcaatctcataggaatgctactcactctactggcgccagaatcaaagggcacatcacttgacgaactaacaggtgaaaatggagatgaaaatgatgaaaaacagattcaaatggatccttcaaggactgttcccgtctgaatctcaccactaatttgaagttcttaccaagtttcatgtcgcttcctagttactttcgtatttttttcttgctggttttatgttcaactacatgtatattgtgtgaatgtttgctttcactcgggtcgttggggaatgttcattttcttttaattttcatatagttgaatggt

SEQ ID NO: 2398 - DNA, 448 bp, Gossypium hirsutum
  Clone ID: uC-gsronu33B090g07b1
ttgatatagctatatcctctatgacaacaaaagctggtattaattctaacgtaaatgaagagaacaaggggaagaaagatggtgaggaggaaatgaatcaaagtactagttgtgaaactgatctcactgtacttttaaatgcatggtattctgccggcttctatacaggaaagtaccttgtggagcagagtattgctaagagaaggcagtgataagcaattcttattatgcaatgtggactgctacagggcgagatcccagatatcagtcgtcctgcacattgcatggaatccctacatttatttggtaggcaagaaaggaacgtgagaatgtatgaccaagatacgaagtgtattagacatgcttggattgtgcaacatattcaagaaattattcagattacggttgtatggtttaaggaacagctttgctgatgatcttgttaata

SEQ ID NO: 2399 - DNA, 519 bp, Gossypium hirsutum
  unsure (1)..(519): unsure at all n locations
  Clone ID: uC-gsronu33B090g08b1
cgcctctccaccaacaacacctaacctccaactagagtcaaccgccgtcacttgctgctcctcacttccctctccttatcttcattctcagtctcagattcggtggccactgctcgtggccttctccagatgcccccacctcgccttactaacaggtattttttggtgagggctggggagtcccaatatgagagcctcggaataatcaacaccaaccctgtagcaaaaacttctgttgatagtgggttatcagacaaggggaaaaaccagactctgaaatctgctttggaattgaaggctatgggggcctgtgaaaggaattgctggatttggccttctattactcaaagagcttaccaggctgctgagatcattgcagctgttaatggtgtcagtcgtagttatatagttccagagtacagcttcctggatgctcgtggactgggagcatatgaaggcaaggaactggaagccatntcacaagtttatgaatcggatagcatatcttctacaatcaag

SEQ ID NO: 2400 - DNA, 563 bp, Gossypium hirsutum
  unsure (1)..(563): unsure at all n locations
  Clone ID: uC-gsronu33B090g10b1
cttaatttccgggaaactttttcttttcccgttggtaaattctcttctcagggaactcttttttcccccgagaaaatcagtagttcagtacccttttttttgcttaaaaaagcactgaaaaatggatgattcaatcggcagtagtggtacaactttgcacataagaaaaacacccaaaaaatccaaatccaagaagaacaataagccaatcaaagtagtgtacatatcaaaccccatgaaagtagagatcagtgcttcaaacttcatggccttagtgcaaaaactcaccggccaagacgctgctgaacttcccgaagatcccaccctattcaccgacgctgatgaatccgtagtcgtttccgccgaagacggaggcgatcaaagggtacccgacgctgcaaaaaccacaaacactgccgctgccgccgaccatgcccgggtggtcctccaacaacagtatcccgccattaccgatgataatattaatgctcaaggcgtncccttcgatatctacgacgacgacgtctttacaccccagatgatagagaatttactgggtaata

SEQ ID NO: 2401 - DNA, 445 bp, Gossypium hirsutum
  Clone ID: uC-gsronu33B090g11b1
tctatttaacaggcccaaattacgtgctagatgggggggctattaggacgttagcggtgacatagttccataatctaaccatggtacaacctttctatgcagtcaaatacaaccctaaccctgctttcctcaaacaaatggcagctcttggcacgggctttcactgtgcaagccttcatcagatctaaaccattttaacgcttggggctccacctgatcgaatcgttttctcaaacacatgcaaacccgagtctcacatcaagtatgcagctaaagttacagtatacttacccacttaccactccaactgtgacctctaaaagataaataagtggtcaccgaaatgctacctggtgatccaaatcaaaggcctctaagccactggttcataattaatgttcagttccaaactcagctcacatcctgaggaaattgctccccttct

SEQ ID NO: 2402 - DNA, 312 bp, Gossypium hirsutum
  unsure (1)..(312): unsure at all n locations
  Clone ID: uC-gsronu33B090h02b1
aattctatataaaaataatccataaacctatatagggtggttttattaaaaaactgatgagaacaataaaaataaaatnaagatctattaccttctctattccaaacacaactaatattattctacccttccacttaaaaaatcataccttttatgacttggtacttttaacccaaccaatttctacaattataatatcttgaaaacttttccttgtcactaaaaacattgtaaattataacatactttataaaccctcacatatctcctgtttaattcttccccacttatcaaattcttttactcttctcc

SEQ ID NO: 2403 - DNA, 534 bp, Gossypium hirsutum
  Clone ID: uC-gsronu33B090h06b1
ctttcttttgggttcaaatgcagtcctcttccggtgttgattttaattcgcaggtggaggaattgattcctgaacaacaggtttgtcttatttgtctcaatggggttccatttgtccttaagggatagctgcacatgtaattactattttagccagtgctgcttaattcataaccactttttatgtatgccactccactgataagttgttgaagaggcttattgttaacttttaatcctcacaagtttatccagctagtgtataatctatcacctgtgtgattctgccaatgatcatatgcaagatcatagcttggctcaaaattgccttcactaaatggcttcttaggattttcccaggagcgcctgaagaaactgagggcataacatggaaaaagtgaacttgggaatattactgctgatatggtcattggtggaatgagaggaatgactgggttgctttgggaaaccttattacttgacccagatgagggaattccctttagggcttgtcaatccccagtgtaaaaactat

SEQ ID NO: 2404 - DNA, 441 bp, Gossypium hirsutum
  Clone ID: uC-gsronu33B090h07b1
ttttatttgaatttttattggacaaagaaaggaggggtagcaagatgatgctcagggttaaaagggttccgactgttgtttcgaattaccagaaggatgagacggaagagactgctcgccgcagcagtgggtgtggaaagaattgccttagaagctgctgcatcccaggagcaaagcttcctttatatgctttcaggaaactgaacaatattgagagtgaaaaagttgtgcttggaattgagaataaagatccccctggtgcttttcttgactcgctcattcttggggagtgggaagatcggatgcaaagagggctctttcgctatgatgttactgcctgtgaaaccaaggggattcctggtgaatatggcttcattgcccagctgaatgagggtcgccaccttaagaagaggccaactgagttccgtggtgataagggtc

SEQ ID NO: 2405 - DNA, 465 bp, Gossypium hirsutum
  Clone ID: uC-gsronu33B090h08b1
cttatttctaaggaccacgaacgtgcatacttggactctgctgattgggcacttggaaagcaaggtgttgagaagcccaaaggaccacttgaagccctccggcccaaattgcagcccacacaacaacaaacacgatacaggaagtctccttgtgccccatctgatggtgaagttggagggagtgctcaaccggaggatgaaaccaccaacgaatgagaaactgctgccaatcttctaaacttgtgaggactattgatagttattctaatacctcgacaggtaatgagtaattttcaattgttcccatgaataaagcttgttaaagatgctttgatcttagtcaagatttacaagttacaacattaatgcagtcgactatattatgggaactgaaatgtatgttgtgccaatgtttttcctgatgtggaacatacaagtaaatcacttataaaatgatttttcgct

SEQ ID NO: 2406 - DNA, 420 bp, Gossypium hirsutum
  Clone ID: uC-gsronu33B096a01b1
cgcgcgttctatgttacattctcaaatatcccaaatcgagaaatgtgactctctcttgttcaaagcagcttcctttcaccttcaacacccctctgcaaattccattccaacttgaacccactaaaaccctcttttttacttcccaaatccctttcccataaaaagtcgctgtgtttgtcaccaaagtatgccactgctattcgtgcttccatgattgaagctccagtgctttgggctggtcggctttgtatttattatgctcttttgaagtctgggttagctggatctcaggctaacccacttgtttcagggttggaggagaatggtgatagtgttggcgaatctggtgatttgggtatctctaagtggttggacaatatccgagggaaaccagacaaggaagcagctgacaaagaaagc

SEQ ID NO: 2407 - DNA, 347 bp, Gossypium hirsutum
  Clone ID: uC-gsronu33B096a03b1
aacaaaaaaaaaaaaaacacaacaaaaaaaaaaaaaaacaaaaaagaaaacaaaaaaaaacaaaaaaaaaaaaaaaaaacaaaaaacaaaaaaaaaaacaaaaaaaaaaaatcaacaaaacacaaaaaacaaacaaaacaaaaacaacaccacaaaaacaaaaaaaaacccaaacaaaaaacaaaacaaacaaaaacaccaaaacacaaacaaaaaaaaaaatacaacaaaacaaaaaaaaaaaacaaaaaacaaaccacaaaaaacacacaaaacaaacaacaaacaacaaaagaaaacaaaaaataaaaaaaaccaccaaaacaaacaaacaacaaaaataaaaa

SEQ ID NO: 2408 - DNA, 282 bp, Gossypium hirsutum
  Clone ID: uC-gsronu33B096a07b1
atcggtccgaagagctttacagcccaaaatcttatttccgggaaatccaccgataatcgacgaactctctctcgatctcacctaagattcgccgataatcgaaattttaaaaataacccgacaacaacaaagatgaagaaagaagacacagtgaaactcattagcgctgaaggaatggaattcgttatagacaaagaagctgctatggtttctcaaacaatccgtaacatgcttacttctccaggtggctttgctgtggcggcgcatggtgaagttcttttc

SEQ ID NO: 2409 - DNA, 126 bp, Gossypium hirsutum
  Clone ID: uC-gsronu33B096a11b1
atctatagtgtctcactctctccgtgcttcactcccgcttctcctttccctcttcaaagaaaatgcgtgagatccttcatattcaaggtggccaatgcggcaaccaaatcggagccaagttctggg

SEQ ID NO: 2410 - DNA, 316 bp, Gossypium hirsutum
  Clone ID: uC-gsronu33B096b01b1
gattattttcttttcggatgtatgaaaatgatggaacctcggcactgacattcgtggagctgagctgcttctctagctgagaatgtaaccccacctcggactaatgggagcaaccttcaacacatgctcgtggacgacaaaaaagtaagcaaagaagaaactgaggaggtgtgatgaatatcaattttgtggttaagaaatctgattgtaaagggtttagcttcaataaggattcttaattcttggtttgttcttctaattttagatatgatggtttttgctcgatgcaatctataatccgattccccttttttgt

SEQ ID NO: 2411 - DNA, 420 bp, Gossypium hirsutum
  Clone ID: uC-gsronu33B096b03b1
agacatccccaaaaatcccaaatcgagaaatgttactttctcttgttcaaagcagcttcctttcaccttcaacacccctctgcaaattccattccaacttgaacccactaaaaccctcttttttacttcccaaatccctttcccataaaaagtcgctgtgtttgtcaccaaagtatgccactgctattcgtgcttccatgattgaagctccagtgctttgggctggtcggctttgtatttattatgctcttttgaagtctgggttagctggatctcaggctaacccacttgtttcagggttggaggagaatggtgatagtgttggcgaatctggtgatttgggtttctttaagtggttggacaatataccagggaaaccagacaaggaagcagctgacaaaagaaagcttgtcagcaaat

SEQ ID NO: 2412 - DNA, 547 bp, Gossypium hirsutum
  Clone ID: uC-gsronu33B096b09b1
ctctttcagacatccccaaaaatcccaaatcgagaaatgttactctctcttgttcaaagcagcttcctttcaccttcaacacccctctgcaaattccattccaacttgaacccactaaaaccctcttttttacttcccaaatccctttcccataaaaagtcgctgtgtttgtcaccaaagtatgccactgctattcgtgcttccatgattgaagctccagtgctttgggctggtcggctttgtatttattatgctcttttgaagtctgggttagctggatctcaggctaacccacttgtttcagggttggaggagaatggtgatagtgttggcgaatctggtgatttgggtttctctaagtggttggacaatatacgagggaaaccagacaaggaagcagctgacaaaagaaagctggtcagcaaatggcatccgaccacgaaaggtacacttaaaaggaactacagggtaccttccaaatccgaaggccgacgactacttaaagcagtggcgtctcttctgtcagacgatgaacattttactgatg

SEQ ID NO: 2413 - DNA, 64 bp, Gossypium hirsutum
  Clone ID: uC-gsronu33B096b11b1
cccatcgtccggtccatcttctcctagatctcatggtgagagtgagggttacaatagtccagat

SEQ ID NO: 2414 - DNA, 315 bp, Gossypium hirsutum
  Clone ID: uC-gsronu33B096c03b1
gatcattttcttttcggatgtatgaaaatgatggaacctcggcactgacattcgtggagctgagctgcttctctagctgagaatgtaaccccacctcggactaatgggagcaaccttcaacacatgctcgtggacgacaaaaaagtaagcaaagaagaaactgaggaggtgtgatgaatatcaattttgtggttaagaaatctgattgtaaagggtttagcttcaataaggattcttaattcttggtttgtttttctaattttagatatgatggtttttgctcgatgcaatctataatccgattccccttttttg

SEQ ID NO: 2415 - DNA, 98 bp, Gossypium hirsutum
  Clone ID: uC-gsronu33B096c05b1
cccacgttttcgcacaagaaaaaaataaaaaaataaatagagggggatttttaaaaaaattattccaatatatatacaggaataaaagaattaaaagc

SEQ ID NO: 2416 - DNA, 95 bp, Gossypium hirsutum
  Clone ID: uC-gsronu33B096c07b1
cgagtcctgaagaacacagatacatagaaccaagaaacagaaaaacatgggttctgaaaagcaaggctccatatggctatcaggacttttgtctc

SEQ ID NO: 2417 - DNA, 316 bp, Gossypium hirsutum
  Clone ID: uC-gsronu33B096c09b1
gatcattttcttttcggatgtatgaaaatgatggaacctcggcactgacattcgtggagctgagctgcttctctagctgagaatgtaaccccacctcggactaatgggagcaaccttcaacacatgctcgtggacgacaaaaaagtaagcaaagaagaaactgaggaggtgtgatgaatatcaattttgtggttaagaaatctgattgtaaagggtttagcttcaataaggattcttaattcttggtttgtttttctaattttagatatgatggtttttgctcgatgcaatctataatccgattccccttttttgt

SEQ ID NO: 2418 - DNA, 291 bp, Gossypium hirsutum
  Clone ID: uC-gsronu33B096c10b1
agtataaaaacatctacacacagtgaaattagagtaattgagaaatacgcaatggctcaaaagatgttgatgatggcggtccttgtgttcttgttttctactaatggtgatcatctttctactttatttcttttttttttaatatcttcttctactttatctttttttttgttcgcgtgttgatcttttattttttgtgtctactttttctttctgcattgttgtttgcttttattaacgttttctttatttttgttttgtttttttattttatttttttttttttttttt

SEQ ID NO: 2419 - DNA, 55 bp, Gossypium hirsutum
  Clone ID: uC-gsronu33B096c11b1
gaaatcctgagaagatcactatcacaaacgataagggtcgtctgttccaggagga

SEQ ID NO: 2420 - DNA, 72 bp, Gossypium hirsutum
  Clone ID: uC-gsronu33B096d04b1
acgcccacgtgatcgcccacgcgtccggtttcttcataacacggtcagatttagacaccgatttctgctttt

SEQ ID NO: 2421 - DNA, 117 bp, Gossypium hirsutum
  Clone ID: uC-gsronu33B096d06b1
ctcacctgctatacacgcctaaatgccccctttcaatcatgggattcattacgaaggatcgaacggcgcattgacgccgcgccagcactggtaagaacccatatttttcctctatac

SEQ ID NO: 2422 - DNA, 82 bp, Gossypium hirsutum
  Clone ID: uC-gsronu33B096d07b1
gccatcatgtgcaagtatgaacaaactcagactgtgaaactgcttaatggctcattaaaccagttatacgccgcccgatggt

SEQ ID NO: 2423 - DNA, 277 bp, Gossypium hirsutum
  Clone ID: uC-gsronu33B096d08b1
cccactcgtccgcccacgcgtccgcaatctttgccatctccaccgttcaccagaaatcatgacagaagaatactgcccccaccaccaggacggacaccaactagtgaagcgcatagcgatagccattgtcgggttattgatagtttgtgccatagaagtcctcctggtatgggcatttcttcaccctttcatgcccagattcctcttccaagacgtcaccatatttgctttcaaccttagtactgtcccacactagcttactttaatttcttttata

SEQ ID NO: 2424 - DNA, 59 bp, Gossypium hirsutum
  Clone ID: uC-gsronu33B096d09b1
cccattctaacggaaaatcatgcttattataagcctctacttcatattattgtactgag

SEQ ID NO: 2425 - DNA, 78 bp, Gossypium hirsutum
  Clone ID: uC-gsronu33B096d11b1
gaacatcaaagaactgtttatgatgaaagtaattggagtgatttggactttgtctatgccaagaaaatgactggatgg

SEQ ID NO: 2426 - DNA, 129 bp, Gossypium hirsutum
  Clone ID: uC-gsronu33B096e05b1
attaaactaaccactcccacattaaatattgttgctgaaacaatggtgtttacagatctgacaggtaagcttgaggcagatgcagagattaaggttcctactgagcaggtacatgaaatgtttgaccac

SEQ ID NO: 2427 - DNA, 80 bp, Gossypium hirsutum
  Clone ID: uC-gsronu33B096e08b1
cagctacggtaggacaaagcgggtcgggtaagtcaaccatcatcgtattaattgagagattttatgatcctcttgaggga

SEQ ID NO: 2428 - DNA, 155 bp, Gossypium hirsutum
  Clone ID: uC-gsronu33B096e10b1
cctactcgtacgcccacgcgttcgcccacgcgttcgaagaaaatttttaaaaaatattttcatttttttaaaaataaaaaaatataaaaaaattaaaattaataattttatataattaaatttatttggtttatcttttttgagatttatatttt

SEQ ID NO: 2429 - DNA, 531 bp, Gossypium hirsutum
  Clone ID: uC-gsronu33B096e12b1
tttgtttttcatactcatttagcccctttcattagcatcaaaatcactccagttttctttatcactgaaaaatgtcttgctgtggtggaaactgtggctgcggtactggctgcaagtgtggcagtggctgtggaggatgcaagatgtatccagacctgaacgctgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagaggcgcctttgtctttaagaaataatatgttttgttgtttatgtgtttttagaataaagtagccatggcttgtcgtaggttttgcctgttgccgccacggttacttggtgcttgccaatagatagagtgaagtactaatatctactggttcttctgtccagtgtgagcatctctgctatctcaggatata

SEQ ID NO: 2430 - DNA, 104 bp, Gossypium hirsutum
  Clone ID: uC-gsronu33B096f01b1
ccccaaacacatgtattactgggaggatgctcaaaatgtcgagttcgcattcttgcacaaacaatcacccggaacaagccccaacacatacggcatacacattc

SEQ ID NO: 2431 - DNA, 56 bp, Gossypium hirsutum
  Clone ID: uC-gsronu33B096f02b1
ctcttaattgtaatcccactacccccaatctcatagcggggggaatttttaaatgg

SEQ ID NO: 2432 - DNA, 110 bp, Gossypium hirsutum
  Clone ID: uC-gsronu33B096f09b1
ggtactacacaaatgactcgagacatgattgagagagaggcaatatattatgaaactgattctctctgttttcttcttgaggtcattcatgtgtatttatatccagtttt

SEQ ID NO: 2433 - DNA, 368 bp, Gossypium hirsutum
  Clone ID: uC-gsronu33B096g02b1
gcgctttttttgttagctcgtgatccgatcattccacgcacggaccggccgttcaaaacgagcatcgtcttcgcacacgaagaaggaaccagcgtgcttttcaaagtgttgtcggcgttcgcgtttaggaacatcagtttgacgaagatcgagtcacggccacaccgtaaccggccgatccggttagtcgacgacgccaatgtaggaacggcgaagcatttcgaatacatgttttacgtggatttcgaagcgtcaatggcggaggtcagagctcaaaacgcgttggcggaggttcaagaattcacctctttcttgagggtattaggcagttacccaatggatatgacgccttggtgcccatccagggg

SEQ ID NO: 2434 - DNA, 58 bp, Gossypium hirsutum
  Clone ID: uC-gsronu33B096g04b1
gaagagatttacaccaaccaaagctgcaaaagtctctgggggaatctacagaacaagc

SEQ ID NO: 2435 - DNA, 114 bp, Gossypium hirsutum
  Clone ID: uC-gsronu33B096g07b1
cttgataacttcaaagaactgagacaaatagaggaagggggtatttggccaacaaaaacgaagcattttctccccaaaagacgaaggaagccaggtggttaattccacgaaaat

SEQ ID NO: 2436 - DNA, 100 bp, Gossypium hirsutum
  Clone ID: uC-gsronu33B096g08b1
gtctggtactggatcttttgggattgttttccaggcaaaatgcttgtaaacgggtgagaccgtgtctataaagaaagttttacaggacaggagattcaaa

SEQ ID NO: 2437 - DNA, 57 bp, Gossypium hirsutum
  Clone ID: uC-gsronu33B096g09b1
cctactcttacgcaaatgagaactcagaaggagaagcgaggttttttaaaaaggctt

SEQ ID NO: 2438 - DNA, 270 bp, Gossypium hirsutum
  Clone ID: uC-gsronu33B096g12b1
gccaatgcttcttttaagctgtgcaccgcttcctgtttttcctaacttggtcaaattgaagatacactgttctaatgatctacgcccatactatgatcaatgggaaaagggacttgaaactttactctcaagtttgcctgaactagaaaaacttgagtttaatcaggaagctctcatctctctgcctgagaaagctccttcttgcttgttgtctaaactcaagtccataaaaatttcagactttacagattaaagagattgtattgttaa

SEQ ID NO: 2439 - DNA, 343 bp, Gossypium hirsutum
  Clone ID: uC-gsronu33B096h02b1
cccactctgacgcccacgcgtccgatgccgtctctctttttacctatcaccggcacataacgttacttactttgctttcgcttttttcaaaaatgttgggggctccgatcaaaatatcttcttcgccttcttgctgttcttcttttgaaaatagaaaggcgatcatgttgtcgccggtttgtttagataaatcgaggtcttttcagtttcttttctcgggttctaaattgcggtgctccaaaactttggataccaagcagctcttcagcgccaagttcaaggtcttccgaggatcgaaatttcgaggtttctgtgactccaagacacaaggagttgccgatta

SEQ ID NO: 2440 - DNA, 120 bp, Gossypium hirsutum
  Clone ID: uC-gsronu33B096h04b1
caaagactgcggtgtattatattttctactgcttttctgcgcttccatgcctactttctcttctgtgtctccccgcgcttttgcagccatggttcttgaggctactatgacatgcattga

SEQ ID NO: 2441 - DNA, 375 bp, Gossypium hirsutum
  Clone ID: uC-gsronu33B096h07b1
cttcattatacttcgtgatcccctgcacttgctcctctcacctaccaccggcacatcacttcacttcctttgctttcgcttttttcaaaaatgttgggggctccgatcaaaatatcttcttcgccttcttgctgttcttcttctgaaaatagaaaggcgatcatgttgtcgccggtttgtttagataaatcgaggtcttttcagtttcttttctcgggttctaaattgcggtgctccaaaactttggataccaagcagctctccagcgccaagttcaaggtctcccgaggatcgaaatttcgaggtttctgtgacttcaagacacaagagttgcagattagaaggttggtcgcctttactagaaaaggcattact

SEQ ID NO: 2442 - DNA, 108 bp, Gossypium hirsutum
  unsure (1)..(108): unsure at all n locations
  Clone ID: uC-gsronu33B096h08b1
gtagtgacacacgatttactaagactgttctcaccggaactgcagtgtggcattacgccaactttaacgctccagngnctggaccggttacagttgatcctgcaaatg

SEQ ID NO: 2443 - DNA, 142 bp, Gossypium hirsutum
  Clone ID: uC-gsronu33B096h10b1
cccacgtggccgcccacgcgtccgcccacgcgtccgcaagttcttttcattttcgagaacattttttttaaaggcttcttctatatattctatgaagatattaatcagaaaaatggcgctggtttcttttattggcagggtt

SEQ ID NO: 2444 - DNA, 129 bp, Gossypium hirsutum
  Clone ID: uC-gsronu33B096h11b1
gcggcgtgtcacagctggcgaatgaagctcatggtgaggaagcgtttgaaggactgttgcactatcataacaccagcccggctggagcatatagatcatgagcctcataaagccgaaccaactaaatca

SEQ ID NO: 2445 - DNA, 141 bp, Gossypium hirsutum
  Clone ID: uC-gsronu33B096h12b1
cccactcgtccggtttcctttctcgattttctatttagggaaacatgatgcagatcttcgctaagactctaaccggcaagacgatcactctcgaggtcgagagctccgatacgatcgacaacgtgaacgccaaaatccaaa

SEQ ID NO: 2446 - DNA, 350 bp, Gossypium hirsutum
  Clone ID: uC-gsronu33B098a02b1
gaaaattttgacctcaatgattgaggtggtgaagatggatgatatttacacagcaatggagaggctggagaagaacgatgttcgatacagattcgtcgtggatgttgctggaagcaagcttgatcaatagagccaaattaaatacaaacacaaactctctttaatcaacaaagaaatactacatgtttaaacatatgcctgtttgttgttgctctgttttctctcttgtgttcaacatgccttatggtaataaactaaaacatatatgtacgagtgtaaagattacttaaggtactattaattattagataggatgaaaaatatatataaaagagaaatatattaatatg

SEQ ID NO: 2447 - DNA, 541 bp, Gossypium hirsutum
  Clone ID: uC-gsronu33B098a03b1
cccactcgtccgcccacgcgtccgtgaatcttgaacggggagccatatatggaaggaggtgaaagagggagctcagccatccctgaatctgtgatgaattcagtgaagacaacgctagtaaacgttgaaaacctaaggacccatttgctcgaattcttgtccctctctgaccccgatgtccttgctcaaatgccccctcttcaacgcgctcaggctttcttcacccttgccaaagccaccactactcttttcgctttgaagttgagatgcagtggagtgcacccagatgaacatcctattaaatcagagcttgagagattaagcttgtatcaagagaagctagagcggttcatagacttaagtaaagcaccgttgcgaccttcaactaccttgaactctcaggccgcaacccgtttcattgagcattcgttaccagacctgacccctgtgcagaggcaaagtatgaggcaaatcagtaaaggggaggggcgaacgataaaatgttctggtagtaatgttaaaaagaagagaaaatatcaat

SEQ ID NO: 2448 - DNA, 357 bp, Gossypium hirsutum
  Clone ID: uC-gsronu33B098a04b1
ggccaatgggaccgaaaaccctttgcaatgcatgcggagtgcggtatatatctggcaggctctttcccgagtaccgaccggcggcgagtccgacgtttatcccgtcggtgcactcgaattctcataagaaagtgctggaaatgaggaccaaatgtgggacagctgatgcaccagaaatgatcccaaataaaagcaacccagcactagattacatatgaagggagggctttggagaattttggaaccctaatgttgattgggttaaaactttcacaatgttttccccatcccaatctcttttaatcttatttttatgtgtttatttttgaaattgttatttttaaaataaataataat

SEQ ID NO: 2449 - DNA, 68 bp, Gossypium hirsutum
  Clone ID: uC-gsronu33B098a05b1
cccacttgttcgcccacgcgtccgaaaaaaaaaaaaaggaaggagtttttataaaaaaaaggtgtatt

SEQ ID NO: 2450 - DNA, 457 bp, Gossypium hirsutum
  Clone ID: uC-gsronu33B098a06b1
cacaattccaaatcttctttgctttgctattttggggggtgtgctaagaactggctaacgcacagcaaaaaaccgtggaggaaaccaacaagaaccaagcggtggttcttgccctctatgaagccttaaacacacgagacgtcaacaccgttcaccaaatccttgctcccgacctagagtggtggttccacggtccacccactcaccagtttttgatgcgcttactcaccggcgcttcatccgacgatcctttccgtttcgagggcgaccctgtctcagtcaccacctttggatccaccgtcatcgttgaaggctgtgataacagccgttcgatctcctgggttcacgcttggactgttcgtgatgggataatcacccaagtgagggagtatttcaacacttctctcaccgttactcgccttagagactctccaccgtcagcttgcagttcttcgac

SEQ ID NO: 2451 - DNA, 559 bp, Gossypium hirsutum
  Clone ID: uC-gsronu33B098a09b1
agttttagtgggttgtgcaaggagctgccgatggggagattttttccaatccttcagccgaatgtgctgatgaggatgaaggtgttgatgaccaagctgtgaaggttgttgacattgttgacactttcaggcttcaggagcaaccccctttcgacaagaagcagtttgtcgtgttcatcaagaagttcatcaagaacttgacaccaaaactggatgcggaaaagcaagagtccttcaagaaaaacattgagggagcaaccaagtttttgctttcaaaattgaaggaccttcaatttttcgtaggagagagcatgcatgatgatggatgcttggtgtttgcttactacaaggatggtgctgttgacccaacatttttgtactttgcatatgcattgaaggaggccaagtgctgaggtttgaagcaaagaaaaaaaaagtggttgctgaagaatttagtcctttttattatagcttttgcttctagatttcagtactctgctaaagacataaattatttgtgggttttgatgtttatggttaattgtttgttggttattat

SEQ ID NO: 2452 - DNA, 530 bp, Gossypium hirsutum
  Clone ID: uC-gsronu33B098a10b1
agtcttttctaggatgccaacacagcctacacaagggggaggttattaggtccaatcattccctcagtatcagcagcaatggcctcaacaattatcacagcaagtgcaaccgcagcagcagtcctctatgcaaccacagatgagggccccatcaacaccagcttactctccctaccctccaactcaatcaacaaatcaatctcaaccagaggcgttgccaaacagcatggccatgcaggtctcatattctggacttcctcaacccgtgtctagccgtgctgataccattacttatgggtacggagtacctggcagaacagctccccaacaacctcctcaacaaatcaaaggcacttttggagcacaaccgactgataggtacacaggacctggctccaatcccacctttcctccaggaagtgcatacatggtatatgatagtgaagggggtagaacacatcacccgtcccagcagcctaacttcacacagggtgggtatcccccagcagcaaatgtctctcttcagactc

SEQ ID NO: 2453 - DNA, 569 bp, Gossypium hirsutum
  Clone ID: uC-gsronu33B098b02b1
gtacatctttatacggaccaaacgggcgccaacatttggggtactgtgcatttaggggaggagaagaacgaccgattttactcgcacgggaaaaaactgacgcgcttgtcgatacagtcggtgataaaaagcgcggtgacagcgagtacaaagccgttgccgataaaccccaggagcgggctcttcctcttgctcacatccgatgacgtgtacgtccaggatttttgcggccaagtatgtgggttccattatttcacattcccatccatcgtgggttacacgctcccatacgcatgggtggggaactcggcaaagctttgcctgggggtatgcgcttatcccttcgccgtgccgaaatacatgacggggttcaagccgttaaagtcacccaacggtgacgttggagtggacgggatgataagcgagatcggacacgaaattgctgaactagcaaccaacccgttggtgaatgcttggtatgccggccaagacccagtggcaccggtggaaatagcggatttatgtgagggtatttatggaactggagggggtgtcttacacgggacagc

SEQ ID NO: 2454 - DNA, 527 bp, Gossypium hirsutum
  Clone ID: uC-gsronu33B098b03b1
catacattggcacttactgaggccctttgtggctttgaggtcatactgactcacttagatggcagacaacttctcattaaaacccaacctggggaagtcgttaagcctgatcaattcaaagcaataaacgatgaaggaatgccgatttatcagaggccatttatgagaggtaaacttttcattcacttcactgttgacttccctgactcgttgaccccagaccaatgcaaggcactggaggctgtgcttcctcccaaggcatcggttcagctgactgacatggagctggatgagtgcgaggaaacaaccatgcatgatgttaacattgaggaagagatgcgtaggaaacaggctcaagctcaacaagaagcttatgaggaagatgaggacatgcatggtggtgcgcagagagtacaatgcgctcagcaatgataaaaaagccgaatgtccgagacacagacggtggtttttggcgaaggaatgtactgggttaaaaaaaaaaaaaaagaacatttgagagtagattc

SEQ ID NO: 2455 - DNA, 319 bp, Gossypium hirsutum
  unsure (1)..(319): unsure at all n locations
  Clone ID: uC-gsronu33B098b05b1
cctacttctctgtcgatcgcgagcggctgcccccctaggtgacgtttttcaagaagcttagtcgacccactggtcatcgcatgtacatgctcagaacaatggtttcccaggtggtaaagcacgagcgcattgaaactactgttgccaaggcaaaggagattcagcgacttgctgataacatggtacaggttgggaaagagggcacactctgtgcggcaaggcatgctgctgcttttgtcccaggagatgatgtcattcacaagctatntacagaactggcatatcgatacaaagacagggcaggtggatatacaagact

SEQ ID NO: 2456 - DNA, 403 bp, Gossypium hirsutum
  Clone ID: uC-gsronu33B098b06b1
gatggttgttattaagcataaagcttattagaacactgatgataatacggtgaaaattaattttctgaagattcgacgttcgtaattattcctcttaacaatgtcgtgtctttgaggtttaaatttgagttctttttaagagtacaatgtatcttacaactgcaatccttattactgtataaatcatgtttatcaacttcttacttttaatcgctcgatgtgctttttaaaaaaaatacttttttgcctagattctttaacaccttttgtaatctaatcctctaatttgtaataatattttgatgttgaatgcgtgcttaacaaaaacaaaaaaaagaacaaaacaaatcaacaacttaacaaactagctaaaataactaataaaagctcaattcaatcaaac

SEQ ID NO: 2457 - DNA, 354 bp, Gossypium hirsutum
  Clone ID: uC-gsronu33B098b07b1
cccactcgtccgatatcctatacggaagccaacggtcgagttgtttaatgtcgaaccagtattgtttgttggggatagcaggaagggtgtaggccctcactgataatactatttgccagtgccattgttgtaccattttttacacagaaatacattggagtgattgattaagggcaaggctagaccaggtgattattggagccagttagctaatgtcgaaggaaaggtatcctttccatactatagtttatgtgtaaatgctttacgagtgtggagattaaacactggaaggccgatttcttgccttctacaaataggatacatatattgtattcttattggttttttctgttc

SEQ ID NO: 2458 - DNA, 549 bp, Gossypium hirsutum
  Clone ID: uC-gsronu33B098b08b1
tttgtcgtgctggtctcatgtcttttatttcaggggtggcctttatctcaacgccgtggtttattccagccgctgttgttcgaagcttgtgggagaacagtgaaccctgtgaacggagccgtggggcttttgtggaacggaaactggcacgtttgccaagcggcggtggaaaccgtcctgcgaggaggatctctacgttccatgcctgaattcatggctccgacgccagcatccgacgaagcgtccgaagccacgtgcacggacatgtggaaattgcgggagacatccacgaatctcaactccaactgtcgattctcaaattcgagatccagggtttcacccaagcgtaaaagagtcgaagaagaattcaagaaactacagccctctgatctagatcttggcttgaccccgagcttttcgggcaagcgagttaccgataatcgtcgaccagggactccttctatgaactcggaggaatctgtgacgacgacgtgcttcgaaagtgtttttgcagatcaacaagggcaaggcagcagaggaactgataaa

SEQ ID NO: 2459 - DNA, 80 bp, Gossypium hirsutum
  Clone ID: uC-gsronu33B098b09b1
ccctctcgtccgaaaaaaaaaaaaaaaaaaaaagagaagatatataaaaaaaaaaagggggctaacacactaaaggaaca

SEQ ID NO: 2460 - DNA, 580 bp, Gossypium hirsutum
  unsure (1)..(580): unsure at all n locations
  Clone ID: uC-gsronu33B098b10b1
gccgctccggaactgccgggaccgaccacgcgtccgactcactcgttcgatcgcgagaggccaaagcatcggcggaagctttcacaaaaccctagtctctaactacttcgttttgcctaagccatgtcgagaaggaaggttagagagcccaaggaggagaatgctaacctaggacctgctgatgcagagggcgagcatgtacttggggtggctcacatctttgcttcatttaatgacacattcattcatgtgactgatttgtctggaagggaaacaatggttcgcattactggtggcatgaaggtgaaagctgatagggatgagtcttccccttatgcagccatgcttgcagcccaagatgtttctcatcgctgcaaggagttgggtattactgcccttcatataaagcttagagctactggagggaataagaccaagacaccaggtcctggtgcacagtcagcacttagagcccttgctcgttctggcatgaaaattggacgcatagaggatgttacccncattcccactgacagtacccgtagaaagggaggcagacgtggaaagaagctgtgattct

SEQ ID NO: 2461 - DNA, 165 bp, Gossypium hirsutum
  Clone ID: uC-gsronu33B098b12b1
tatgggaagctggtacgcccgcggggccagccgcgccgtgacccgccgggaccccccacgccgccgcatgggaccgaaaaccctaagcaatgcaagcggggagagctattaaaaaaacaggcggggtcccaaaaaccgaccggcggcgagcccgacgaaaatccc

SEQ ID NO: 2462 - DNA, 231 bp, Gossypium hirsutum
  Clone ID: uC-gsronu33B098c04b1
aaggatgacaaggtaccacctgctgcaccagtggcgtagcctgttttgttaacctaatggtgcttttacagggctcgcgttggctaattggttggcactctcttgcaagtgtacatcaccggtttaactgtaatgggtgctgctaaagcttcaaccaagtgttcaactggtgggattcagggcattgcttgggcttttggtggcatgatctttgctcttgtctactgcact

SEQ ID NO: 2463 - DNA, 210 bp, Gossypium hirsutum
  Clone ID: uC-gsronu33B098c05b1
gaaaaatctctcaattgtttcaattactttgttttcttgatgaaatatttgttagcaaataatatggccttcaaggccaattgattttctcaaagtactcgtatccaaatacatgaaaaaaggtacaaaaattcaattatcctcattaaatacatatctgtatctgatattttagacatcatgattttattggaaaaatgctaatgattc

SEQ ID NO: 2464 - DNA, 465 bp, Gossypium hirsutum
  Clone ID: uC-gsronu33B098c07b1
gtacataggtcatgtcccaacctgtgtcctcaggggtgtatctatttgagttgccctacacgcccgtgtgttacgccatgtgttaggctatgtaactcactaacttgcctacaaaataactctcaaatggcacatgatcgtgtcaacaggccgtgtgggagtcagcgcacgtgtttcatgctatgtgaacccaaaatttacctaaaatcaagccatttcacaagaaaattcacacttaacaaatctaaccattcgaacatacatctaagagactgaaacaacattcaccactacataagcatgccatttaaccctaaaatcaaccaaccaatgtgccattcaaagacaccacaattataccaaaacatcaactatcaaaacatatcaatattggttcaattcatggtaagtaatctagttcaaacatattccaaaacataccacaacactcattgattcattcct

SEQ ID NO: 2465 - DNA, 96 bp, Gossypium hirsutum
  Clone ID: uC-gsronu33B098c08b1
gtgaattacccgtttgctgattcggggaacaaagtggatgttgataaaggaaacagggtagtgaaacccatcaacaaaggtctactacaccatgaa

SEQ ID NO: 2466 - DNA, 481 bp, Gossypium hirsutum
  Clone ID: uC-gsronu33B098c09b1
cttactcgtccgtgcaactcaaggagtatccaacggaggaaagttacagctactgaaattcctcctacaattccaaagtcacggagcagtggcaagaccaagattggaatcaatggttttggtcggattggaaggttggttttacgaatagcaacttcaagggatgatattgatgtagtagctgtcaatgatccttttattgatgccaagtacatggcttatatgttcaaatatgattcaactcacggaccctttaagggaactatcagagttgtggatgagtccacattggaaattaatggcaagcaagtacaggttgtaagcaaaagggaccctgcagagatcccttggggtgagtatggggctgagtttgttgttgagtcatctggtgttttcaccacattagctaaggcttcagcacatatgaagggtggtgccaaaaaagttgtaatttcagctccttccgcagatgctcctatgt

SEQ ID NO: 2467 - DNA, 68 bp, Gossypium hirsutum
  Clone ID: uC-gsronu33B098c12b1
accgcaccagaacccccacgaccacccacgccgcccgaaattccacccagcgcccaccctaaattccc

SEQ ID NO: 2468 - DNA, 212 bp, Gossypium hirsutum
  Clone ID: uC-gsronu33B098d05b1
aaccacccgatatcgatgatatcgacgggagtgatttttaaaatgaatgtgtgtttctaaaacaaccaggaacagcatctgaaagacagagctctgcgtatttgtgggagtcatctcttttgagcgaggatgtactgggagaccacgctgatggcaccgagccaccatcgcctgcatgaggaggtgatgcactgtatttgtggcacgctgtg

SEQ ID NO: 2469 - DNA, 569 bp, Gossypium hirsutum
  Clone ID: uC-gsronu33B098d06b1
gaagatctaccttttttttctccttttccaccgccggggggctctatccttatcctcgggttcaaacaagctcaaaaaagatggccaacgctgcatcgggaatggctgtgcatgatgattgcaagttgaagttcttggagctcaagacaaaaagaacccaccgcttcattgttttcaaaatcgaggagaagcaaacgcaagttattgtggagaagcttggtgaaccaaccgaaagctacgaggattttactaaatgtctccccgctgatgaatgtcgatatgctgtgtacgattttgattttctaacggccgagaacgtcccgaagagcagaatctttttcatcgcatggtctcccgacacgtcaaggatcaggagcaagatgatttacgccagctccaaagacagattcaagcgagaactggacggaattcaggtggaattgcaagcaacagatccaactgagatgggtctcgatgtgttcaaaagccgtgctaactgaatacggttcttttaggcatctgcaacccggaagggcttcttcttcctacctacagtatgtctttactta

SEQ ID NO: 2470 - DNA, 559 bp, Gossypium hirsutum
  unsure (1)..(559): unsure at all n locations
  Clone ID: uC-gsronu33B098d07b1
gcttaatctcagcaagaaaaacagctgaagctagtggacatattgaagctcatgtcttcaactttcatggttgccttatgccaggccattgatttgaggcatttggaagagaatttgaagaacactgtgaagaacacagttagccaagtggctaaaagagtcctaacaatgggatccaatggtgaactccacccgtcgagattctgcgaaaaggaccttctacgagtcgtcgatcgcgaatatctctatgcctacgccgacgacccttgcagtgcaaattaccccttaatacagaaactgagacaagtactagtagaccatgcattgatgaatggtgacagagaaaaagattccaccacttcaatcttccaaaagattggagtctttgaagaagagctgaaaacccatttgcctaaagaagtcgaaagcgcccgaaccgaattcgagaacgggaatccggctatcccgaacaagattgaagaatgcaggtcctacccattatacaagtttgtgagggaagttcttgngactaatttgttaacaggtnagaaagtgattt

SEQ ID NO: 2471 - DNA, 461 bp, Gossypium hirsutum
  Clone ID: uC-gsronu33B098d08b1
attatatctcaaatctcctcctcctcctcagaagggttagtttcatcaccatggcctcaaatcccaaggtcttctttgacatgactatcggtggtcagcccgctggtcggattgtgatggagcttttcgcagattgcactcctcgcactgctgagaacttccgtgccctctgtaccggcgagaaaggcgtcggccgcagcggtaagcccctccactacaaaggctcctctttccatcgtgtgatccctaactttatgtgccaaggaggtgacttcacggccggaaacggtaccggaggtgaatccatctacggatccaagttcgctgacgagaacttcatcaagaagcacactggtcccggtattctctcaatggctaacgctggtcccggaactaacggatctcagttcttcatttgcacggctaagactgagtggctcgacggaaagcacgttgtgttt

SEQ ID NO: 2472 - DNA, 469 bp, Gossypium hirsutum
  Clone ID: uC-gsronu33B098d10b1
cccactcgtccgggacaaatatatgcagtgtccaaaggcttggttacctacatctccgtcaatcggcacatacttcatagatatgcaaacgaagacgtctctttaggttcttggtttattggtcttgatgtcgagcatatcgacgaacgaagcctctgctgtggtactctcttggattgcgagtggaaagctcaagcagggaatccatgtggcgcatcttttgattggagctgcagtggcatttgcaagtccgtggagagaatgcaggaagtgcatcagcgatgcggggagggcgacgatgccatatggcatacaagcttctaaaacacactgtcactaacctgttggtacaggattaaattaattaacgcacagattctcatttatcattcaccgaaagcggtcccccattgttttacacttgttgaagcattagaaggttagatgagaactatttaaacagcacatc

SEQ ID NO: 2473 - DNA, 65 bp, Gossypium hirsutum
  Clone ID: uC-gsronu33B098d12b1
cttatttctggtttctttttatggaattacaagaggtttagtttataaaaaaaatgggggggttt

SEQ ID NO: 2474 - DNA, 89 bp, Gossypium hirsutum
  Clone ID: uC-gsronu33B098e01b1
cccactctttctaccaaaacacaaccaaaaaaaaaatgaaggcttaaaaaaacaaatggcggttaacaaaaccccaagaacaacaccct

SEQ ID NO: 2475 - DNA, 368 bp, Gossypium hirsutum
  Clone ID: uC-gsronu33B098e03b1
gctatggtgcgatctcattctcatcccttcaaagaagggtggttgttactgcttctgatagacaaggacttttgaaagccggggaagacaagatcacagtgagatggggattgaaccagagattcccgggcgggaccgactcgtcttataagaccatcaaggtccagctttgctatgcacccatcaggcaagtcgaccgtgcatgggggaaaaccgaggaccatcttaacaaagacaagacatgccagttcaagatagtcaagaaaccctacatcaacgtcaacgaaacccttgaatggaccattgaaagagacgtgccgacggtgacattctttatcctagcctaactctttggactccgaccacca

SEQ ID NO: 2476 - DNA, 548 bp, Gossypium hirsutum
  Clone ID: uC-gsronu33B098e05b1
gtctctatcaattaaggatgatgagattgatattggggtgggagcactacgtcctgacctgacatctttcatgaatgagtggaggaccatattctctcgatttcatctcataattgttaaagaccctgatttgaaagaggagctcaaaattccagagggctttaaccttgatgtctataaaaagcctgacatagatcgtgttgtgggtacttctacttcaaccattttctctggctattcatgccggtattttggctatctggtttctcggaagaagtacattatctctggggatgatgactgttacccagccaaggacaataaaggcattttggtggatgctggtgcccagcatattactaaccttacaaccccgggcacaccattcttttttaacactctgtatgaccctttcactgaatgtgcagattttgttcgtggctacccattcagtcttcggagtggggtacagtgtgctttggcatgggggctttggcttaaattaactgactatgaatgcacctacttaagccctcaagccagagaaa

SEQ ID NO: 2477 - DNA, 450 bp, Gossypium hirsutum
  Clone ID: uC-gsronu33B098e08b1
tctcacgcgtccgattctggtgtgtttgggtgggagagtccgcttatctgtcatagtccgagctttgttaatagggtaaataattgaaatgaaattttgaaaatgagattatttgttttagcactattgaaaagtacgagaaagaatgtatgaattaaattatgaattgagttagtatgagaaaaatgaattatgaatttaagatttatgaagtaaaataattatatataaaagtagtttaaataattacaaaatttatggttgatgtttgtaatttattaatgttaaatagtcttgatttatagtaataccactgagtatatccatactcagcgtacggttgcttccgtgcgcaggttagtagaagtcaagtgtcccggctcagcatccagaacaatcccgacctccacacaaatttggtgatgtatatttttcttttggtaaaggtgg

SEQ ID NO: 2478 - DNA, 543 bp, Gossypium hirsutum
  Clone ID: uC-gsronu33B098e09b1
attatatcagcaaagaatctctgatcgctttaaggctaacttctaattaaagagctccttacccccttgaccgagtctcgtaactcgagttcactcaaactccaactactcatcttcagatttctgagtacgttagatttccaagacttctcgtttttttttctgagaatttcataaacaacaatgctgacgtgcatagctcggtccaagcaagctggtgatgactcactggctcaaccagaggaaatcgactcgtccaataatccgaacactaagcacaaccaagccatgaaatccctcacatctcagttgaaggacatggcactgaaagcgtcgggggcgtacaagcactgcaacccctgcacagcacagactcggttaaagaatcctggcggttccgacgccgactcggatcgttacaagtggtcgtatcgtaggacagggagttcgaactcggcgacccaaggacttgtggaaaggagatggcagcccggtttacagtatatcttgtccaagctgacaactactcctctcttcatttgt

SEQ ID NO: 2479 - DNA, 366 bp, Gossypium hirsutum
  Clone ID: uC-gsronu33B098f02b1
gctagatcgacgctactttttctggggtgggcttttattcaactttgctgtgctgcatgccccactactagaagcctcaaatcaaacaaggaactcccttcttctgtccaagatttacttgctcaggatgtaatggaattgagtgatggagaggaagtgataacggaaggtgacagattcaatggggaaaggatgttaatggaaagcactgattatccagggacaggtgcaaacaagaaccatgatcccaaaactccagggagagcttaaaaaacattaagacccataacctatttggtttatgtatagcttaagacatgacaggataaaaggcaaggctttgaatctggggtttcctcaatattt

SEQ ID NO: 2480 - DNA, 121 bp, Gossypium hirsutum
  Clone ID: uC-gsronu33B098f04b1
cttggtatgagcgattgccgtgtgttatcgatggaaaagagatttttaaaaaaaaattggtttataaaaaaaaaaaaaaacccaaaaaaaaaaaaaaaaaacaaaaacacaaaagatcaaa

SEQ ID NO: 2481 - DNA, 182 bp, Gossypium hirsutum
  Clone ID: uC-gsronu33B098f05b1
gctgttttcttctattttcagacaaattaagagacaagggacattatataaccagctgtcaggtttgaaattgacaactattttttttttttctgtaagaccaataatgcttctcctgtattatacacatttataactgtcttgggcatgtaaaaaaataccatatattttaaattttagcc

SEQ ID NO: 2482 - DNA, 433 bp, Gossypium hirsutum
  Clone ID: uC-gsronu33B098f06b1
atcgtatgattctcgcggtgttattcgccaactctgaaggcaacatcttagttgaacgctttaatggagttccagctgaggaacggctgcattggagatctttcctagttaaactgggagcagataatcttaaaggtgttaaaaatgaagagctgcttgttgcttctcacaagtctgtttacattgtttacacggtgcttggagatgtcagcgtctatgttgttggcaaagatgagtatgatgaacttgcattggcagaggtgatctttgttataacctcagctgtaaaggatgtatgtgggaagctaccaacagagcgcctttttctggataaatactgaaggatatgcttgactttggatgaaattatttggaagggatatctggagaacccggctaaagactggatcaggagattcgtccgtttaaaacc

SEQ ID NO: 2483 - DNA, 229 bp, Gossypium hirsutum
  unsure (1)..(229): unsure at all n locations
  Clone ID: uC-gsronu33B098f07b1
gcaatgtcataatttcggccataccggaggtttcatatgcccttttgttccacttctaccaattgtttgcattctcatcaatgtctacctgctcatcaatttgggggctgcaacatgggctagggtatcggtgtggcttttgataggggtggttgnctctgagtnctagctgcgactacacgaaagatgctgtgctgcatggtataatcccgctcatcatgggcattaa

SEQ ID NO: 2484 - DNA, 542 bp, Gossypium hirsutum
  Clone ID: uC-gsronu33B098f11b1
gtttaactgtgctccactcatgctccgtctagcgtgggactcatttggaacttttgatgtcaagaccaagaccggaggtccattcggaaccatgaagcaacctgctgagctcgctcatgctgctaacaacggtctcgatattgcagtcaggcttctcgagccgatcaaggagcagcttcctatcctttcatacgctgacttctatcagcttgctggtgttgttgctgttgagatcaccggtgggccggaaattccattccatcctggaagagaggacaagcctcacccaccacctgagggtcgtcttcccaatgctactgagggagctgatcacttgaggcaggtgtttagtaatcaaatgggtcttagcgaccaggacattgttgctctttctggtggccataccctgggaaggtgccacaaggagaggtctggatttgagggaccatggactaccaaccctcttatcttcgacaactcttacttcaaggagctcttgactggagagaaggctggccttgtacagttggcaactgacaaag

SEQ ID NO: 2485 - DNA, 58 bp, Gossypium hirsutum
  Clone ID: uC-gsronu33B098g01b1
aagcagcacgccgccgggggcgcccaaatacccgaccgacccacgcgaccgacccatt

SEQ ID NO: 2486 - DNA, 506 bp, Gossypium hirsutum
  Clone ID: uC-gsronu33B098g03b1
tatagggaaagctggacgccgggggagcgcgccgggaatgacccggcggacccacgcgtccgggccattttatatgggctggccctagcaatctacatgggtggctttttatgaaacatcaatgtcgttgcaacagcgcgtcatgtccttcagatgccaccagacgagccaagagtgagcggaccaccaatgccatctatcccaaatctcccacaaccaacaataccgacattgccaaccactcagccatcgttacccaagcctggtgctctacctccacttcctaccatgccaacattgccgaccatacctaatgccccaaaactgagcatgccacctctgccgaacattccctccttccctacaataccagctactatgccatctattccattcttctcggcaccaccggccaaaaactagcacttcaaaatagatggtttgggtgaatctcttagggaatacatagatggtgttttagacattcagttcattccaccttactt

SEQ ID NO: 2487 - DNA, 475 bp, Gossypium hirsutum
  Clone ID: uC-gsronu33B098g05b1
gtagctcacagaatgggatgaattcactggagacacgtgggcatggtctagaattggctttggatgagatctcgtatgacttggctgtatcaactggaaggatgtctacttccagccggaccacttgttgcctactacctgctgcaggttttctgagatccaagttctggaggaaaacagggatgaacacaaatggtacctctacgttttctacatccagttgcaccccatccgctgctgccacacattatagagcttatagaaattgcaatgaaacatttgagaaccataggttacgacttcaaggaggtggcggatttattacgaatccattggcagaaattcagtgaccaccagaagctgcaggcttgctgcatgactgggactcggaagtcactcaaatttcagtcatttgtgactacacatatgatgatcaacttatatatatattatgctctattacgaagttttctat

SEQ ID NO: 2488 - DNA, 474 bp, Gossypium hirsutum
  Clone ID: uC-gsronu33B098g10b1
cttgctgaggcaaagaggttggtgtacttgagagggtgtacagagggaactatgattgttggagaatatgctggaagaagagtccaggaagctaagccactgttgaggaccaaactgattgagacaggccaggcaataatttatagtgagcctgagaagaaggtcatgtcaaggtctggtgatgagtgtgttgtggctcttacagatcaatggtacatcacatacggggaaccagaatggaaaaaattgtctgaggagtgcttatccaatatgaatctatactctgatgagacacgtcatggctttgaacatacgttaggatggctgaaccaatgggcttgctcacgatcctttggccttgggactcgcattccttgggatgaagaattccttgttgagtcattatctgactcaaccatttacatggcttattacacaagttgctcatcttttacataatggggacatgtatgg

SEQ ID NO: 2489 - DNA, 88 bp, Gossypium hirsutum
  Clone ID: uC-gsronu33B098h01b1
ccccttccccccccaacccggtgtcatgtttacccacactataggtaaagctggcacacctgccggtggcggtctctaaattcctttc

SEQ ID NO: 2490 - DNA, 425 bp, Gossypium hirsutum
  Clone ID: uC-gsronu33B098h02b1
gttgatacattattcgccgacgaagaggaaaaaaaaggggcagagctatttgaatgcaactatgggatacttagaaggaggaaataacggcgtatacgggtctatctccggccactttcttcacgggtggtgctctgttgtgggccatttactatgtagtaacgggtctattcgggtcgtccgatgatcaccatcaacgttccagggctttcgaggagcagatggagccgctcccacctccggttcaggtaggcgaaatttccgagaaggaacttaaacagtatgatgggtcggatcccaagaagccactccttatggccatcaagggtcagatttatgatgtttctcaaagcagaatgttttatggacccggtggaccttatgcatttgttgctggaaaggatgctagcaaagctcttgcaaag

SEQ ID NO: 2491 - DNA, 390 bp, Gossypium hirsutum
  Clone ID: uC-gsronu33B098h04b1
cccacttcgtccgtggatcttctgggtcggacccttcgggggagctgcctcagctgcattgtaccaccaatacatcctcagagccgcagccatcaaggctcttggatctttcaggagcaatgcttaagtccagctttcattttcttacgaacttcaaccaaaaaagaaatggagaaccttgagttcagtgtggaccattgaaatgtaaataaatatttatgaacaagggtgtcttattttcttgctttcaatgtattttatttcgtgtttgtcatctttgttcatccttatcctctcttcttttttccttttttttttccggtgatgcttttcatgttaattttttaatgcataattctacaagtaaaatatattgtttgttttagtgtc

SEQ ID NO: 2492 - DNA, 407 bp, Gossypium hirsutum
  Clone ID: uC-gsronu33B098h05b1
cccatttgttcgctcggactcgctcacgctcacactaaagaagtttttttaactttgacgtgggccctccaactccagcaatgttagctgctggtgctgtggcagctgctgctgcagggcagattccggggacaactaacccaaccatacctggagtgtttcctaacatgtttcctattgcaactggacagccatttggtgctctcccagttatgccaggtcaggcaatgactcagcaggctactaggcatgctcgtcgggtgtatgttggagggctttctcctactgctaatgaacagtctgttgcacctttcttcagccatgtgatggctgcaaatggtggaaatactgctggtccaggggatgctgttgttaatggttccctcttccatgaaaagaagtctgct

SEQ ID NO: 2493 - DNA, 576 bp, Gossypium hirsutum
  Clone ID: uC-gsronu33B098h06b1
ctccttcatctcctccgccggagcttaattgcttcggcggggtttaccttctcgcagttcatttcccatggcggctggcttatccgccgccgtaccccttaaacctttcctttcatttcatccctcacccaagcaaaggctagttttcaaccctctacttcgcctcccacagctaacacacggtgctcgaaaggagacaaggctttccatttgtttcgtgttggaggaacaaaatgatgttgaaccccagaccttagtgaatctagtagaagaaggatccggttccgaggatgggaacaaacagatcttaatacctccacatgtggcggagaaattagctagaaaaaaatccgaaaggttcacttacttggtcgctgctgtcatgtctagtttcggtatcacttccatggctatcatggctgtttattatagattttcatggcaaatggagggaggagaagtgcctctgtctgaaatgttcggcacatttgccctatctgttggcgccgccgtaagcatggagttttgggctagatgggcacatcgagctctctggcatgcttccttatggcatat

SEQ ID NO: 2494 - DNA, 484 bp, Gossypium hirsutum
  Clone ID: uC-gsronu33B098h10b1
cttacttcaaaagccaacaaaaccagagaaacagggcgggaattatttaccagacccatggctgaaaccagacatcattaacaaacccaacaaaaacccattccccaaatctatatttcaacactacccatttcattatttttcgcaaaaaatatgaagaaaattggagggttcaagcttcgacgcaagctggtaacagttttcaaatggatattccgacccagaaaaagcaaccgcttcagtagtttcttaacacgtccgatccgaacccgtaacccattatccagactttgttctttccttcgacggggtagaatcaaggggatatcaaattcggatcctggatatatccaattgggtgagcaagaagtgaagcgggttgaggtacccaagggacatcttgctgtgtacgtgggcgaatcagagagtgacacgaggagagtggtggcgcctgtgatttattttaatcacccactggttgggg

SEQ ID NO: 2495 - DNA, 490 bp, Gossypium hirsutum
  Clone ID: uC-gsronu33B098h11b1
caaataacccgcacgggcaacaccggggtggcttttgtactctgcgcgtgcgatatcattccgatctcttcctctcaggtcgccttctcccgccccaccgctcctgcttcggtccacccgattcctgcccgagttatcggttccgggcctgccttcaagatctcgacgggtcaaaccaaaacctataaacaaaactattgaatgaggaacaaaaggggcaagaccgagaagttggatgacctagaaggacctcaagggtcaacctctcagggtttgatggaagaaaagttaggtaaaggtccttaatttggttagctgcccctctagtttatttgaaacttgggtcccctcccactccctgaacttcagcgcaattaactatctggagatctgctcagaaatacctcaagttagtaatgactattagtagatacaggaagagaatgttctggttgggactagtctattcttaagttttaatctaataccc

SEQ ID NO: 2496 - DNA, 551 bp, Gossypium hirsutum
  Clone ID: uC-gsronu33B098h12b1
gtttttctgccgactttcttccagatcctaattgggagggtttttatgagcaagtgggtgagcttacggaaagggcaaaggagatcccagatgattactttgtagttttggttggtgatatgatcaccgaggaagccctttcaacttatcaaacaatgcttaataccttggatggaactcgtgatgagacaggtgctagccttaccccttgggccatttggaccagggcttggactgctgaagaaaacaggcatggtgatctgcttaataagtatctctacttgtctgggagagtggacatgaggcaaattgagaggacaatccagtacttgattggatcgggaatggatcctcatacagagaatagtccttaccgaggattcatatatacttcgttccaagaaagggcaacttttatttcccatgggaatacaggcaggctggctaaagagtatggggatattaacttggttcaatttgtggtagcattgcctcagatgagaagcgccccgagacagcctatccaaaatcgttgaaagctgtttgagatg

SEQ ID NO: 2497 - DNA, 469 bp, Gossypium hirsutum
  Clone ID: uC-gsronu33B099a01b1
gttttgtgatatattcgagcggccaattccatctctactgcgaggttatagtgctcctatccgtcttgaatctgatctctccgacagtgacctatttttccttctcgctcatgattcggatgagtttaatcgctgggagtccggacaggtgctggcaaggaagctcatgctcagcttagttgctgatttccaacaaagcaaaccattgaccttgaatcccaaatttgttcaaggtctcaaaagcatactttgtgatccaagcttggataaggaattcatcgcaaaagcaataactctccccggtgaaggggaaataatggatatgagggaagttgctgatcctgatgctgtttatgctgttcgaaccttcattagaaaggagcttgcctcacaactaaaatctgagtttttaagcacagttgagaacaatagacgctcaaaggagtatgtatttgaccatactaatatg

SEQ ID NO: 2498 - DNA, 499 bp, Gossypium hirsutum
  Clone ID: uC-gsronu33B099a02b1
cccacgtgtttttccacgcgtccgaaccactcctatattcgagggtagagcagccaagaaaccaagcaatggtcaaggcaaaagtgacacacccctttctgattcttctagatcataactcgaaggaggttcaagattgcatcagcttcctactggctgtcgcagattaagctctctgaatcagcttctaagcactctgtctcacttggatttttcaaacttgccttagaagctggatgtgagccccttcagaaaatgagtgatgaacttaaatcctatatacgtcgccataatcttggtgaaaatggggaagctataaatgagctactcgaaagctacaatgttccagacaatcccgagcaaccacaggtgcctgaaacctgttctcaggtgcctgacgagggaacccggtcatcggatgacgaggttcacagggtttttcctgtagcagcagcagctcggagattgaaacccaagtccttgaatactgatgctgctc

SEQ ID NO: 2499 - DNA, 440 bp, Gossypium hirsutum
  Clone ID: uC-gsronu33B099a05b1
cccacttgtctgcgagttctttgtttaagaataaggatcttttaagatacgccggatccgctaaaatacgccgatccccgtccgtcttccgatcatatggggctgcttgaccagttgtgggatgataccgttgctggtccccgacccgataatggccttggcaagctccgaaagcactccactttcactttccggcctaactctgccaaggaatctgatggcggcagtgtaagatcgtacggtgatgaagcgccggaggaagcgacgagagtgacacgtagtattatgatcgtaaagccgcctggttaccagagcggatcgcctccggtttcgccggccggatcgacccctccggtatctcctttttccggaggcagagaatcatacggtttcggagaaggtccacatcggatgcatacgagaaggctaacgaggttgga

SEQ ID NO: 2500 - DNA, 258 bp, Gossypium hirsutum
  Clone ID: uC-gsronu33B099a06b1
atgcgcgatgttactttcaagaatttccgtggggcagtcgatgctttccatgtgactgccgaggacacaactggcgccggtgactcctttgttggtgcattgctatgcaagattgttgaaaacccaaccattcttgaggatgaagcaaaattaagggaagctggaacaaaattttagggaagtacaaatgacattttaatttttgtaatctctatctttatactttgtaaatgattaaatcgaattttttttaatttt

SEQ ID NO: 2501 - DNA, 509 bp, Gossypium hirsutum
  Clone ID: uC-gsronu33B099a07b1
cttttattatgtctccctcctcccttttacaatacaaataccttccatgccagaccaagtaaaccaaaagacaaaatgagacaagaaggaaaacccaagacaccaaaacacagccaaggaggcacaggccggtcctgtggcttatgccttttcattttcctcctcttggcaggagcatcagcagttgctgtgtgcctcatctaccgtccccgcaagcctcgtttcgctgtagtaggtgcagctatctaccaactcaacgccacctcacaacccatcatttccacttccatgcagttcaccatcgtgacaagaaaccccaacaggagagtctctatcttttacgacaagttgcaagcttctgtttcgtacagaaaccagcagattactcccgcaatggacttgccaccactgtaccaagaggcaaagagcacggtggcactgacccctctgctgggtagcgggacggtgccagcatcggcggaagtggtgaatggactgatgatggatga

SEQ ID NO: 2502 - DNA, 436 bp, Gossypium hirsutum
  Clone ID: uC-gsronu33B099a10b1
gtgcgttcactcatccgcaggatacaaaaagaacagcatcgcttgccctcttctttgccctcaacgttctcttcttttctctagtcagtgcttgcggttcttgcccttcccccaacccaaaaccaaagcctactccttccccatccccctcaggcaaatgcccccaagatacccttaagttaggtgtctgtgctgaggtgcttggcttagtcaatgtaactgttggttcgcccccagtgcaaccatgctgctcccttctccaaggccttgctgatcttgaagctgctgtttgcctttgcacagcactcaaagctaacgttttgggcatcaaccttaatatcccagtttccctcagcttgcttcttaacgtctgctcaaagaaagttccatctggcttccaatgtccctaattattgtttccaattctttgtcttct

SEQ ID NO: 2503 - DNA, 190 bp, Gossypium hirsutum
  Clone ID: uC-gsronu33B099a12b1
ttaggttttatgcaattgggttttaaaaaatgtatctgggctggactgtatatatatattttgggttaaataacttgtaaatggacattgacttaaaaaaaaaaaaaaaaaaaaaaaaaaaaaaaaaaaaaaaaaaaaagaaccccggactaaaaaataaaagggtccgtccatataaaaggaacaaaaa

SEQ ID NO: 2504 - DNA, 160 bp, Gossypium hirsutum
  Clone ID: uC-gsronu33B099b01b1
gcccttcccatttagttttttactttgcctgtcttatgtaattcaaggccgaaaaaggtgttttagtcacttcttgctccaataaggagctaggccaaaaaaaaaaaaaaaaaaaaaaaaaaaaaaaaaaaaaaaaaaaaaacacaaaaaacaaaacggg

SEQ ID NO: 2505 - DNA, 426 bp, Gossypium hirsutum
  Clone ID: uC-gsronu33B099b03b1
gccaattcagttgcatcgaccaaagcctaaccatatcgctaccattgaatccaaaaggtttgaaataaaactcatgtcttttgaggaactgtttcattttaatggttgttgtgttcttccctctgtttttagccatcataactgattctgtgagatgattgttgaaagttgtcagtatttgtgttctttcccttgcattgcctttggcttgtaaggtttcaaatacccaagaaacttcctcttgattacttgtttgctgttattttcctttgtccttgttagcaaacatgttaattataaacacttatcaatcaccaataaattccaatttttttttaaaaaaaaaaaaaaaatataaaaaaaaaaataaataaaaaaataattatattatatataaaaaaaaatattatttcaaatacacacccg

SEQ ID NO: 2506 - DNA, 431 bp, Gossypium hirsutum
  Clone ID: uC-gsronu33B099b04b1
tgttattccattgatgccccaacttagaagttcttgagactaggaatgttataggagatagaggattagaagttctcgctcgaagttgtaagagactaaagaggcttagaatcgagcgaggtgctgatgagcaagaaatggaggatgaagaaggtgttgtttcgcaaagaggattaatggctttagctcaaggatgtctcgaattggaatacttggctgtttatgtatctgacatcaccaatgcatcattacaatatattgggacatactcgaaaaatctgtgtgattttcgtctggttttgcttgatcgagaagaaaggataacagatttgcctcttgacgatggagtccgtgatctattgaggggctgtgaaaagcttaaaagatttgctctgtatcttcgacctggtggtttaacccgatgtgggact

SEQ ID NO: 2507 - DNA, 98 bp, Gossypium hirsutum
  Clone ID: uC-gsronu33B099b05b1
gaagtttttaatctcggtctgtaaaaaaaaaaaaaaactgaaaaaggctcattaaatcaaatatagtaagaaagaagaaataagatactaagaatacc

SEQ ID NO: 2508 - DNA, 104 bp, Gossypium hirsutum
  Clone ID: uC-gsronu33B099b06b1
gaaatttaatttttcggaaaacaaggaaaaagaacaaggagaggccccaatcacttacaacgtctacattatagaacaatagggggggcagttagacagtttac

SEQ ID NO: 2509 - DNA, 506 bp, Gossypium hirsutum
  Clone ID: uC-gsronu33B099b07b1
ttaactactcaaaacatcatcctccaaagccacctaagcctcccgtggtaaacccaccatatcaccctaaaccaccgaagccaccggtggtgaagccaccgtatcaccctaaaccacctaagcctccgatggtgaaacccccatatcaccctaaaccaccaaaacatccaccgcatcctcccaagccacctgttgtaaagcctccctatgtacctaagccacctattgtaaagcctccaccgtatacgcccaaaccgccggttgtgaagcctccgccatatacacccaaaccgccggttgtgaagcctccgccatatacacccaaaccgccggttgtgaagcctccgccatatacacccaaaccgccggttgtgaagcctccgccatatgcacccaaactgccggttgtgaagcctccgccatatacacccaagccaccttactatccaataccgccggtcatctcaccaccaacactgcctccaaagccaccagtctaccccagt

SEQ ID NO: 2510 - DNA, 467 bp, Gossypium hirsutum
  Clone ID: uC-gsronu33B099b09b1
ataaccctaaatcccctttgaaaatgccgattctcctttccctggcagcagccaacagatttagactggagagaacaccttttctcctttcaatctcgtcttaacttcgattttaactaagcaagaggagatctacggcgtgctttcaaggtaaactcccgcttttcccttttttattcatgccttcgagtaaaaataaaaaataaacaaaagatcaagccgaaaaaaaagaacgcccccgagatttcagtcagaaaatcacctttaagaatcggttgttttctattgcttctgcttttttatgcgcatttctgtgtttatgtggcgttcgagtgtgtaatatgcatgtgtatatttcattcgtaaagaagaaccatttacaatcgaaaataaaaggctttatagccgaataacacaaaaaaaacaatttttggtctcctattggctgctattctgctgctcttttc

SEQ ID NO: 2511 - DNA, 266 bp, Gossypium hirsutum
  unsure (1)..(266): unsure at all n locations
  Clone ID: uC-gsronu33B099b12b1
tttacttttgccatcacagggaatcgaacccaggtcttcccccaacacttacacgtcacccttatagctccctagtggcgtcacttagccactttaccagaggatctttttgtgttacattttacccacaaattttaataagaccacctatccaaagcccctaactgcttaagtccaaaattcaaaaattccaccgggttttggccagcacatgggccttccataagcttatttacctacccaaattatgaattccacaacccant

SEQ ID NO: 2512 - DNA, 286 bp, Gossypium hirsutum
  unsure (1)..(286): unsure at all n locations
  Clone ID: uC-gsronu33B099c02b1
cccacttgttttcccgacctcagattgtgagatccacactcacaaggaagctgatctttactaggtatttaatggtttgaaatcagtagaatctatctaaaaaaccccagaaatttcatcntgaattggcggaaaaataagggtaaatgactaaatgtttatcagggacaatctgttgcttaatatgcttagtgtttgctctaaagcttgtagctgaaattagggtttcaataatatttgtggatttgccatagaaaatatataccaatattgtcttttatgatct

SEQ ID NO: 2513 - DNA, 405 bp, Gossypium hirsutum
  Clone ID: uC-gsronu33B099c04b1
cactactactgctgcttctgtttcaacatctatgggaaaatcaagtgctgctaagatgaaaactgtagtgtctgatattggaagaactggtcttggaaatgggttcgatcatgaccttcaatctagtccaatcctttgggcttcacctcagagttctcatcttctagccttattgagaactaccccaaaccctaacgctaacactttgtccactaataatcctgttagtattaaggaagaggtgagcttgcttggatcgcatgcaatgaacgagccagctgttgcaaatgctgcgttaaatgctcgaaccctaggtttggatccccttagccaggtcccttctctaggactttgcagccctttttggaaaaacaatcaacaccaagctcaacagcaacatcagag

SEQ ID NO: 2514 - DNA, 391 bp, Gossypium hirsutum
  Clone ID: uC-gsronu33B099c06b1
gttacttcatttctcaatcaacaatcttggagatccgtttatcgagagcaactacggagttcattcaaggcagtttgaagttggtgtgctagattggtttgcccgtttgtgggaaatagagaagaatgattactggggttacattacaaactgtggcacagaaggcaatcttcacggcattttagttgggagggaagtgtttctggatggaattttgtatgcatcacgggaatcacattactctgtcttcaaagcagcacgaatgtatcgaatggagtgtgtgaaggtggatactctaatcttgggtgagattgattgtgctgacttcagagctaagttgctcgctaacaagagcatgccagctataatcaacgttaacatcggaacaact

SEQ ID NO: 2515 - DNA, 422 bp, Gossypium hirsutum
  Clone ID: uC-gsronu33B099c07b1
ttgacttttgggcggacgcgtgggtgatgatgcaaacattactgaaaaagttgaagccctgactactaccttatggcctcaagggaattcaagtttcagcaacactatacaatctttctcagaacaattgtcggagttagatcaaattgttagaagaatgatattggagagttttgatcttgaaaaatatatggatgaacacatgggttcaaccaactacctgctcagggtaatgaaatataaagggccaaaaaccactgaaacaaagcttggattacacagtcacaccgacaaaaacattgtgacaatattgtaccaaaatgaggttgatggattggaggttctgagcaaagaaagagaatggatcaatgtgaaacccttcaaacaatctttcactgttatgatccggggaatctttctat

SEQ ID NO: 2516 - DNA, 515 bp, Gossypium hirsutum
  unsure (1)..(515): unsure at all n locations
  Clone ID: uC-gsronu33B099c08b1
tgcaattcttgtgtttgcattcaatactggaatgttaccagaaatacaggcaacagtgaggcagcctgcagtgaagaacacgctgaaagctttgtactttcagttcaccatcggagttgtaccgatgtttgccattacctttatcggctactgggcttacggagcttcaacatccacatacttgcttaatagtgtaagcggtccactttgggtgaaggcggctgctaacatttctgccttcctgcaatccatcatttgtttgcacatatttgcgagtccaacttatgagtatttggacaccaagttcggcattagaggaagcgccttgcagcttaacagcctgtccttcagaattgcagcaagaggcgggtacctcgttatcagtacactggtgtcggctcttctaccgttcctcggagatttcgaaagccttacggnggcattgagcacgtttccactaacatttatcctagcaaaccacatgtacattgtggcaaagaaggacaaactgagta

SEQ ID NO: 2517 - DNA, 438 bp, Gossypium hirsutum
  Clone ID: uC-gsronu33B099c11b1
ttcattcattctttgatgatagcatagttgattgggtctgtattctttatatctgtattagttcatttaatatatgtatataatctactcaatcattacatatttcccattttaagtgatttcttaatattaaaaaggcgatcttctattcttttcaaatgttggaaacaagaagtttaggtcccaccagaacatggacttgcaaatggccaattttctctaacaaactatacagcctttctaagatcctgaattattagtgcttgactggcatgggatggataacagatcttttttctgaattctaggcaaggcctttgctctcacaggctttggaacatgggaattttgatgcatttgtggattcaaggttacagaaggactatgattccgatgaaatgacccgaatggtggctcgtgctgcagcctgcgtgcgtc

SEQ ID NO: 2518 - DNA, 507 bp, Gossypium hirsutum
  Clone ID: uC-gsronu33B099c12b1
ttcatattcctcacttttgcaacaaaatccaccaagagactacaccaacaaatggaggcattgaggataagactatttttggctatgatggtggtgttgatggccatctcagcggtccaatatgttgcggcagctgatgcaccggcccctactcctacctcagatgccaccgcattcgtgccgacggcatttgcttcccttgtcgctcttgcgtttggtctcctcttttaaaatggatgaattgtattggttgttgatatttcaatattgggggttatgtagagttcttttgtcttcttttattctttctctctaaaggccatacaattcttatgagtccttcgtttatggagatggaaaaaagatagagaaaaggtggagattttttttctttttctactttaaattttccttatgacaattggttgatgtattccttgttttgattttaatgtataattgatgtgatttgtttggtggtgacccaaaggaagttttgtttgctat

SEQ ID NO: 2519 - DNA, 431 bp, Gossypium hirsutum
  Clone ID: uC-gsronu33B099d01b1
gctagttctcttcatcgcttatatcccctcacacgtactcaagtctcaacaagtccttgatatctccaaaatgcgtttctccctcgttgttctctttgctgcatcccttgcctccgccgcttccgtgttcaaacgctggaacgacgattatggggttccttcctgcgcaaagccctgtatcgccaacgtagacccctggccttgcaagcacgacgacaaggcctgcctttgcgcaaactccgattatcatgcgctcctcggggaatgcattcagggcgcttgcagccctgaggacgctaaaaaagccgtagagtccgggaaaaagtattgcaaggcagctggtgttgatcatgagaaacccattccgaagtgcggggttcactgcttggagaaagcgcccgttggcaaatgcaaacacgatgactacaaat

SEQ ID NO: 2520 - DNA, 517 bp, Gossypium hirsutum
  Clone ID: uC-gsronu33B099d02b1
cccacgcgtcttattgggtacctgaagaaggtggatatctaattggcaatttacagccggctcacatggattttaggttcttcacacttgggaacctctggtccattgtttcatcactgggcacttcaaaacagaatgaagctattctcaacttaattgaaaacaaatgggatgatattgtggggcatatgcctctcaagatatgctatcctgcagtagagaatgaagagtggcgcataattacgggcagtgacccaaagaataccccttggtcataccataatggtggatcttggccaacacttctctggcagtttactttggcttgtgtcaagatgggcagattagaactagcccaaaaggccatagctttggcagagaagaggctttcaagagaccattggcctgaatattatgacacccgaagtgggaagtttattggaaagcaatctcgactttcccagacatggaccattgctggtttcctgaccttaaaatgatggtggagaaccggaga

SEQ ID NO: 2521 - DNA, 87 bp, Gossypium hirsutum
  Clone ID: uC-gsronu33B099d03b1
ggctttttattaatttggcactagaaattgatggcttatatcttaaattatttttatttagacaatgattgggatcgtttctttttg

SEQ ID NO: 2522 - DNA, 523 bp, Gossypium hirsutum
  Clone ID: uC-gsronu33B099d08b1
ttgagttcaacctgacatcttcagctgggataacaaatatgctggtgctcatgttcttctatccaggatggcattgttgggcaaagataaaaatttcgagcaattcaaacaagaagctgaaagctttatgtgtaggatcttacccaattctccttattcaactacccaatacacacaaggtggtcttatgtacaagttacctgaaagcaaccttcaatatgtaacatccatatcatttctacttaccacatatggcaagtacatgaaagctaaaaagcagacatttaactgtggcagcctcttcgtcactccaaattcactaatcggacttgcaaaaagacaggtggattacatactaggagagaatccaataaaaatgtcgtacatggcttgggtttggtcggaatttccccaagagaattcaccacaggggttctttattgccgtcgttggcaaaacacccttaaagcattggatgcgacggtggtttccagccatacttttactaatggaaccccatccc

SEQ ID NO: 2523 - DNA, 477 bp, Gossypium hirsutum
  Clone ID: uC-gsronu33B099d10b1
ttctgttgcatcttacagagagcgagttcttaaagcacttaccagaaagtttagattgcacgaagatatatccctctactcaattgcaaagagatgcccaccaaactttactggtgcagatatgtatgccttgtgtgcagatgcttggtttcatgctgcaaagcgtaaggtgttgagtccagattcatcttccatggatcaagctgactccattgttgtagaatatgatgactttgtgaaggtattgagagagctttcaccatccctttccatggcagagcttaagaagtacgaaattcttcgagatcagttggaagggtcttcaagctgaatgagaaaggtgaattggcaaattacatgctacgaaaatacaataaaatatgtcaaaagcaaaagattctttttaccatttattttatggatagaactgtaaaattctgtgcctttgtgtaataaatattaaactataatgtctta

SEQ ID NO: 2524 - DNA, 434 bp, Gossypium hirsutum
  Clone ID: uC-gsronu33B099e02b1
caaaatcctattctctcttgattttccctcaaccgatcctaacatccctctcttaagcaccgatttgcctctatcaatgttgacgaacagattcgggcttcgagagacgataatcttagccgtgaaattccttctcaactctaatttcaaccaaacagatgggatccccagtatttccgtaaggaggagccagctggaggtggtggcgcacatggggcgtacagaggggacgaagaaaaccgtgcgtaggagctgcggcgtggggaagcctagggttccagaagtttcaatttgtccgggccatttaggtcgctttaagattgggcctttttttaaaataagtttaaagtttgggcttcaatttgtatgtgggttaaatgtaaatttggtattatgcccaaagcttggctttttgtaatgttggactttggacc

SEQ ID NO: 2525 - DNA, 475 bp, Gossypium hirsutum
  Clone ID: uC-gsronu33B099e03b1
agaaaaatggaaaaacagatgatatttgcatgggcaatgatattttgccttgccattgtaccagtgtatggccaatactattccagaactgttaaggcaggtcctcgggtggaaaagattacccacctccacttctactaccacgacattcgcagtggcaataaccctactgcattcctgatagccagtctcaacatcacccaggacccgccctcacatggcaccttgtttgcaatggatgatcctctaactacagagtttgaactaacatccacgctcgtcggaaatgcccaagggctctacttagcattgagtcgagaccttaccaagttttctgcagtcttttacgctgactttacgtttaccactggcaggtacaacggcagctccttcagtttattctcacgatttccccccacagatgttgttcctgcccctggcacaattcgtgaaatggcaatagtgggagggacag

SEQ ID NO: 2526 - DNA, 536 bp, Gossypium hirsutum
  Clone ID: uC-gsronu33B099e04b1
agaaattgatggagaagaaggggctgaaagaaaagattgaagagaagttagaaggagaaaagaaagaagaggacacctcagttccagtagagaagtgcgatgagccagtagtccagccagagacgccagagaagaaaggtttcctcgagaagatcaaggagaaactccctggacaacacaagaaagctgaagaggccagtagcccagctccagccccagcagctgagccccatcacgaaggggagtcaaaggaaaagaagggaattctggagaagatcaaggagaagcttcctggtaaacactccaaatcagatgaagaaaaagaaaaggcttgagattcaagttcacataaaaatactgatgggattgtgtgtttcttcaattgctaaaaaaatatctgtttttgttttgaggttgtatttgctgcatatttcatattaagtttcttctttttccagcatttttagtacaaatcataagaaaaaaaaagtttggtttcggtatgtaagaaatgacatgttttcattctggctttt

SEQ ID NO: 2527 - DNA, 438 bp, Gossypium hirsutum
  Clone ID: uC-gsronu33B099e06b1
gccccttggtttgtatatcaaagtctattaggagacgatctaaagattctaagaggacacccgtcaccctcctcaatgccgacgccaaaaacttccgatccttggtgcaacaattcacgggctgtagccgatgtagcacctccatttcatttgccaaaaacccaagaggtcccggcaatataaattttgcccatgttaatccaaagaacgacgaccaccaccaccataattacactagtcattcagatcatgcttcaacattaccgcagcctggcactaatgattgttggaagtctcaactgctgcaaccgcaagaaaagcatgaacatcatcatcatcatcaacaacatgatgatgagtaccaacagcgagtgtcaaatgaagaacaagaaggcgagttttcttttgacagaataacgtcgactgatcatgatgatc

SEQ ID NO: 2528 - DNA, 482 bp, Gossypium hirsutum
  Clone ID: uC-gsronu33B099e07b1
caatttttgaactgggatccacagaacagaatcaaagttcggattgtgtctgctagagcttatcattcattgttcatgcataacatgtacgggtaagaccactttgtctaccgatcacaacaggtatctgatcggtgatgacgagcattgttggagtgacaatggtgtgtcgaacatcgaaggtggttgctatgccaagtgtattgatctttcaagggagaaggagcctgatatctggaatgccattaagtttggaactgtgttggaaaatgttgttttcgatgaacatacgagagaggtggattatggtgacaaattagttacagagaatactcgtgcggcctatccgatcgaatacattccaaatgctaagataccatgcgtcggtcctcatcctaagaatgtcattcttttggcatgtgatgcctttggtgtccttccacctgtgagcaagctgagcctggcttaaaccatgtaccatt

SEQ ID NO: 2529 - DNA, 535 bp, Gossypium hirsutum
  Clone ID: uC-gsronu33B099e08b1
tttattttatataaaaaaaaaaaaaaaaaaaaaaaaaaaaaaaaaaaatttaaaaagaaaaaaaaaaatttataataaagaaaaaaaaatttaagaaggcttgtttctgggggggggttttgttggttcttgttttttttttgggggcccgccctcttgttttctgtcttgggggccctccttttatctgggggggcgtcgtttggttccccccctttctggtggtccttggggggcccggttctttttttttttggggggcttcgccttttttgccgggggggtttttttttcagtggccggctcccgtttgccctttgggctccaccgtcttttttggtttgggaaccgcgcccccttgtgggggggtcgtttttggggggggccgggggggcttccttcctttttttttcggtgtttttcttctgggggttggggcccccccctgtggtcggttttcttactctttgcttgagcggtttccttctttctgggggtgcctttttttggggcttcctctttgggctcctttttt

SEQ ID NO: 2530 - DNA, 524 bp, Gossypium hirsutum
  Clone ID: uC-gsronu33B099e09b1
ttcacttcgtccgaagacattcattttcacctcagcttcttcttttttctctttgtttcatcatggcttctttggctacatttaattttgttatgtttcttattgtcttggcctcttcgctacatttcaccgccgatgcaaggaggctcgttgagtcagaccaacctgaccagcctttgctcttccaataccacaatggtcctcttctgtctgggaaaatctctgttaatcttatttggtacggcaagttcaagccttctcaacgtgcggttgtgtacgatttcgtcacttccgttgcgtcttccaagcctacaatagctcagccctcggtcgccacatggtggaaagccacagagaagtactatcagctcagcaagaaaccttattctcttgccatcacattgggttcacaaatccttgacgagaactactctttgggaaagtcgctaacaaatcaacagatcatggaattagcatcaaagggtggtcagaaaaacgccattaacgttgttttgacatcagct

SEQ ID NO: 2531 - DNA, 485 bp, Gossypium hirsutum
  Clone ID: uC-gsronu33B099e11b1
tttgacttagtttggcatgctgattgagtttctatttgaaaagtttcctaactttgaagatgctactgaaactgccattggagatctacaggcattctataaagcttcaaagcagagatttgattctgatcctgcatttaaggagagagctcaacaggcagtggtgcggcttcagggtggagaagaaaagtatcgcagggcatgggcacaaatatgtgaaatcagccggactgaatttcacaaggtctatcaacgacttggagttcatttagaggaaaaaggagagagcttttataatccttatattcctggggttatagaagggttgaccaaacaaggattagttgaggaaagtcagggagctcgtgtgatctttattgaaggcattaatatacctcttattgttgtgaagagtgatggtggtttcaactatgcatcaactgacctggctgctctttggtatcgcctcatgaagagaaagctga

SEQ ID NO: 2532 - DNA, 382 bp, Gossypium hirsutum
  Clone ID: uC-gsronu33B099f02b1
cccactcgtcttcggacgcgtgggcaaaacccgagtttcttatttcttaacctgaaacccctcctctttcctcctactctgtttcctttttcttcttagactcgtgtcggatttttttctcgtgctctgcaggtgatattagcatgacttaaacaaaggtttagtgatgaattagcatcgtcttcttcctttttcatttattgaaatcaatccaagtccgtgaaccagtcattggattctccatagccaaaaaaactttgcattcaactcatccctcaagctattcgtggtcataaactaaagctcagaaacttcaattcaacctccaaatcccaaataaatgtgatgagttgttgattatcaaagccaacttttctttgca

SEQ ID NO: 2533 - DNA, 340 bp, Gossypium hirsutum
  Clone ID: uC-gsronu33B099f04b1
cccactgtgtcttgttcaaatctcaaatcgtctgagttcatcaccctgtgttttggtatctgggaagtttggttggtctgccaacatggagagactcatgaaggcacaaactgtcggtgatacctctactttggagtttatgaaagggagaagggtgtttgagatcaaccctgcgaatcctattattagagatttaaacgctgtattctagaggtacccagatgatgaacatgtcttgagagctacagatcttttgtttgatgcaccacttgcttttagaggttacacttctgacaatccaccacagatggttggtaagatttatgagatgatgggaatg

SEQ ID NO: 2534 - DNA, 389 bp, Gossypium hirsutum
  Clone ID: uC-gsronu33B099f05b1
cccacgtgtcttcccacgcgtccgcatttgtcggaaaacttggggacgacgagttcggtcatatgctggccgatattctcaagcaaaacagtgtctccggtgacgggatcttgtttgaccaaggcgctagaactgctcttgccttcgttacgttacgcgccgacggagagcgtgagttcatgttctataggaatcctagcgccgacatgctgttgaagccggaggagttgaacgttgatcttatcagatcttccaaggtatttcactatggatcaataagtttgatcgtggagctctgcagatcagtttatttaaaggcaatggaagtagctctaggagctggtgcaatgctttcacatgatcccaaacccttccgttgcccactttgg

SEQ ID NO: 2535 - DNA, 297 bp, Gossypium hirsutum
  Clone ID: uC-gsronu33B099f06b1
cttatttaagtttgctgtgctaaatcatttgcaccatttccacctgggtgtatgttccacagtgagcaaggattgacgagttttgagcatccgaggagcaaaatgaaggcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatgttttttttttttgttggggggg

SEQ ID NO: 2536 - DNA, 493 bp, Gossypium hirsutum
  Clone ID: uC-gsronu33B099f07b1
tttgagtgtagagaagacagaattgatgattttgctcaacagatggaaattaatgggttttggccggttgacaagagagaagccattgtacaaacgttgctgaaaaatgtcgatgttaagaatgaatatcactgtagcatgaaattcgagactgcagaagaactttctctgcatatgccaacttgcagctttagggtaatgacttgtgacaatgaagggtgcgacgatagattttcggctaataaatcagagaagcacgattccacttgccctttcaagataattccatgtgaacaaaagtgcccagatttcatcatgagacgtgatatggacagacactgcataaccgtctgtcctatgaagctcgtaaactgccctttcttttcagtgggatgcaaagcagccgtaccccattgtaagatcgatgaacatcaatctgaagaactccattatcacattctttatattcttaaggcttttacaagggagcatt

SEQ ID NO: 2537 - DNA, 347 bp, Gossypium hirsutum
  Clone ID: uC-gsronu33B099f08b1
cttgattgcaaaattcagaaaaaagaagaagaaagaagccctttcttcctctcttttagtcactcaattttccgtagtattcttttgcatggcagtgaggttattgtcacatgagttgtctgacttgtgtcttggcaagccagcgctgaggtcactttctgtaacatctaccattgctgaggctcttgaggtcttgaaaacctcggatgataacttcgttagtgtgtggagttgcgatcataaggctaaaaccagttcagggtttgagtcggctgctggtttttgcgacaattatgatgatgatgattgtagatgtgtaggcaaagttctgatggtggatgtgattc

SEQ ID NO: 2538 - DNA, 377 bp, Gossypium hirsutum
  Clone ID: uC-gsronu33B099f09b1
accttcggaaattcccggccaacttttccccggcggcaccggcggcggcggagattcaaggaatggggcggggtcggaccaaaacaggggaggaaatcttccggtagggtatatgggcgctactactctggcaggaccttggatttccacactaacaggaagatcatcgaagaagttgccattatcccatccaagaggctccgcaacaagattgccggcttctcgacccatgtgatgaaacggatccagaggggtccggttcgcggcattttcttgaagctccaagaggaagagcgtgagcgccgcatggatttcgtccccgatgaatcggccatcaaggtcgaccaaatcgaagttgattaggaaactcttgatat

SEQ ID NO: 2539 - DNA, 435 bp, Gossypium hirsutum
  Clone ID: uC-gsronu33B099f10b1
ttcatttcttggagtaatgggagattgaaatcagtgaatcacagagtgatgatgagcggagacaaagatcgatactctatagcagcttttgtcattccaaatgagggtactataatcaagacacccaaagagtttatagatgaccaacatcctcggcttttcaaggacttagatttcatggagttcttcctttttgccttttccgacccagcaaggcacatcgacaacggggagttgctccatgtctttgctggcctctcaccatcagtttccaattaaaattatgctcatatagacaagtaaaagtttggttttggttttaaattaatattacaaataataaattgagtcctatactcgagatctacgttctcgaactgtattaccatgttatattttgctataattgtgtactacaaaatctactgtgttgag

SEQ ID NO: 2540 - DNA, 453 bp, Gossypium hirsutum
  Clone ID: uC-gsronu33B099g02b1
gttaacacagtttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgcgtctgttgtagtttgtgtggtgacttatatctgtcagttaacctttctctcctttactatgatgtaatggctatgcttatggccttatctggttaatgaagtatccttactattt

SEQ ID NO: 2541 - DNA, 520 bp, Gossypium hirsutum
  Clone ID: uC-gsronu33B099g03b1
agtttgtgggttttaaagagattattgcagcaatggcttctttgcaatgccagaaaaccattgagaaaggcttgggtcaaggatactatggtggcggttctagttggggaagccaggccactaaaatggagaacaaataccagaatggctatgcgatgtcttacagcgaacatgaacgccatagccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggag

SEQ ID NO: 2542 - DNA, 492 bp, Gossypium hirsutum
  Clone ID: uC-gsronu33B099g04b1
gcgaaataatagctaatacttaattaccttctcataagtattgtgtcctcccaagttctttcatttagtgtttggattggatgcagtatttatcttcagtaaatatggtcttatatgaataggtatccaacaaattctacttcacatttactgtccgccccgaggccatgaaagagggattgaagattcgaaatgttgttccagctactgaggaggaagcacggcgggtgcttgaacgtatggatgctgagaggtcccaatagtgctgttttgctctatattcatttgaaattttgaatctttctcgtatctaagagaaccccatggtcgatatgcaataagtgaacaagcccagtgtctgtaattcaacacattttttcattgtcaagatccaatgatggaaatttttccatctcaatctcccaaaaagaaaataaaggtcggacaaggggtcttggttttgggcatcatatcatatttaatttatctttg

SEQ ID NO: 2543 - DNA, 528 bp, Gossypium hirsutum
  Clone ID: uC-gsronu33B099g06b1
cccacgtttcctcccacgcgtccgattatattctctctcattttgcaatggcctcccatggaaacataacagtaataagcacctcccccaaaggatcagaagcagaagtggcacccaattcaggcaaaggagggcaatgtttgtgctcaccaacaactcaccagggctcgtttcgatgcaggtttcatcgatctaagtcatcagcctggatgatgaaacggtccaaatctatgcctgccaataattctcccaccgcttctttttctcccaagtctgttgaatctacgtaatccctgaaaaatatcaccaaatcctcactctcccctctatatgtgaactatataatatgcacatagaggtatgctggggtctctgtatttgcttgggatgtgattatctaaatatctgcaactgctttaaatcagacaccttatcaccaagagctttccttcccttcatttttctttttctggtaaagctctttctgtttcaagctactgcgattttcgtactattaatttaacacat

SEQ ID NO: 2544 - DNA, 391 bp, Gossypium hirsutum
  Clone ID: uC-gsronu33B099g08b1
gaaagtaacactcacgcttgggaatgatggggtttttagcagtgtgaatgagaagactggttattataagggaccctcataaaagatggctaagtgcacgccgcttaggtggttattgggtcccaatcttcactttctttttctccccttttgtttgtgcgtatcgtcttttctttgatgttgaatatattgcataagcaaaagagcatgcaaacaaatttgctttgaaagcccctttcaatggccttttatatggggtagtgttgttatgcatgtatgtacgtttggtccttttttttcatgtatgctgtcatcaagggggttaaccatagttttttttagtgctttgatgggttggtaatgatgttatatcagtccatggatggcttgt

SEQ ID NO: 2545 - DNA, 54 bp, Gossypium hirsutum
  Clone ID: uC-gsronu33B099g12b1
gtaaactttaaaaaggataaggtaatagaaatcttgggtgtgaaaatccatcgt

SEQ ID NO: 2546 - DNA, 437 bp, Gossypium hirsutum
  Clone ID: uC-gsronu33B099h01b1
gttctaaaaaatgaaagaagaagaagaaagcaaggaaggaagaagatgggtcttccatgcactatggctctttggtttcagcttctacttttgatgtgtggcagtgggatacatggtgtgaagaatttgagggaaaaaacaaggggatgctcaacttgttagaaaggcggaggataaatattctcttgtttctaatatagcacatcctgcagctgaggagtcatcttctcaagttgctaagcaactgggggatatatattctagtttttctgtgttggtggacaaaagtacttagttgtcttctgatcaacttgctaaggagctggaggataaatattctagaattgctgcctggaaacctttttgtgacaaaactccccaatcatcttcttaacttgctaaggagctggaggataaatattctagaattgctgcct

SEQ ID NO: 2547 - DNA, 516 bp, Gossypium hirsutum
  Clone ID: uC-gsronu33B099h02b1
cccactgcgtcctttccacgcgtccgtattccttcattgggttctttgttagaacccttaaacctaccggaaacacaatgatccgaatcgccaaaaaccccaaacctctaacaactctgactcaccaattcctccaacgctgcaccgtcagtggaaccgccaaaggcaaatccaaactcaaagccggccaacctttgaaacgctccaaaatctccactaaaaaaggaaaaggcggcgcttctctcgacgattccctccccaaaggcggcagaatccccgacgagaagcaaaaactctacgaccaatgcctcaatgcacccacaccggtccgtcacctctcaccgaaagagcgagcccgcgaagccgaacgagaaaaattgggattaataagcaaggagcggcaacgggaaatggagattttgaagaagggaggaagaaaggcaatgggagtccctgacgagcctatgattatgggaactccggggctggattggatacattgggccttgtcgatgc

SEQ ID NO: 2548 - DNA, 301 bp, Gossypium hirsutum
  Clone ID: uC-gsronu33B099h04b1
atttttataagaaaaatcccaaaattttcagcttttcttctcttctagaaatggcccaagttagcatgttgaaggcttctttattggcttttgtaatggcaatcctaaccgttgcctcggcgcaggttagtgaggcgccgataccgtcgtcagacgctggagctggattctcagtcggagtttctaccgccgccattggcttctatttgatcgtttcccttcttgctttcttcaagcattaaattgaagggcttgtttggctctcctctctgtgtggctttcttttatatatatatatatg

SEQ ID NO: 2549 - DNA, 496 bp, Gossypium hirsutum
  Clone ID: uC-gsronu33B099h05b1
gaaaatttaattagtgaattttttttttaaaaaagtggttatttgttattagatggaaatttttcagacaaatattgtaattacaacatctctgatgctcctgagttcggtcgttttttcagacaacaccatcaccactttaagcacgacatcaaagtaccagatcgagtgcaccatgtgttcatcatgtgaaaatccatgtcagcaaactccatcgccgccaccaccatctgcaccgccgtctaaaccattttcaccaccacctacagttcctaaccccaactactgtccacccccttcttcttcacccaccttcagcggtggtggaaactactactactttccaccaccaccttcttaattcagcgggggaaataactactacgcttcaccaccacccggtggtgtcattggtggcatgtactacccttcaccaacgtacaaaaactacccaatgccaccaccacccaaccctatggggccttacttgcctttt

SEQ ID NO: 2550 - DNA, 456 bp, Gossypium hirsutum
  Clone ID: uC-gsronu33B099h06b1
cccacgtgtctgggagcaatggcagggtacaccggcttcacaagcggccttgtcaatggcaggcagacatacataccattctatagaattatagagaaacgaaacagcgttgtgattacggataggatgtgggcaagactgctgtcttcaacgaatcaaccaagctttttgtgcctcaaagactccattgaagacacaggcgatgaagaacaatcaaatcaattgttggcgaatggacattgtggcgaagaggaagaacaatcaaatcaattgttggcgaatggacattgtggcgaagaggattctctcatttcaaagatatgatcaactgaggtgataatgtggcggtgaatgctttctgcaggcaggcgaggcttttggttaacacagtattgtagtattagggattggtccaagggaacttttgcttggacttttgttatttaggagggaaga

SEQ ID NO: 2551 - DNA, 433 bp, Gossypium hirsutum
  Clone ID: uC-gsronu33B099h07b1
tccactcgtccgcccacgcgtccggcttgagacttgtaaggaaatgatggaaaaggtgaatgataaagacaggactattgtttacaaattggtggaaggtgaaatcatgaaagctttcaaaagctggaacttcattctcaacgtgatgccgataggggagggaagtctggtgaaatggactatggaatttgaaaagcaaaatgatgatgtccctgatcctgtcaagtacggcgagtttttaactacctgggctaagaatgtcgatacttaccttcttaatgtctaattaaataattaaggaaactacatatatgaataatttgatcatatgtctcgttcttaaataaattatacaaataatcataataaacatgcatttaaatattttataatagctgattaagcattagcttagttggcaacgtttgctgag

SEQ ID NO: 2552 - DNA, 534 bp, Gossypium hirsutum
  Clone ID: uC-gsronu33B099h09b1
tcaggttattgatgaaaagattagagagctctcaaactgtcaaatagtttatcccggaattgattttcagaaggaagctggtattcctaaaaaagtcgtcaaagttgaggatatccctggcttgaaggaagctggttggactcctgatcaatggggtcatactcgatttagagccttaattgtttctgcagacaacgcgacaaatcagaaacatttaactggtttcatgcgctcacttttgaaggcttgtaaaaaaagcatgcttgtccccctcttctcgcaatcaaacaccttgtctaagatgcaggggaagctaatttccactttcaggattcttgcaatggcctaattacagtataattataaatgttaataagtcattgtccttttgcttttactcttgataacttgattctctccaagtgtttatttgacattagatgtctatatgagagcatctcctgccatgatttttcttagattctaagcaaaatggttttgttcaagcagtcaatgcatgaccatgttgatgct

SEQ ID NO: 2553 - DNA, 425 bp, Gossypium hirsutum
  Clone ID: uC-gsronu33B099h10b1
tttgtacttttgggggcattggaagaggatgcttttaggccagtcttgcaccactatgatggtcccaagttccgtcttgagctgtcagttcctgagactttggatctaatggacctttgtgaacaagcaggctccccataaacaaaatgctagccgagtgcaaatgtagtagtagtagggtttgtgatgcacgtttccggagatttttccatagagcgcaagctgtggtgggtgttaagtccagttggggaaaaagtaggaaatggcattagccacatatgaataaatgcgttcatgtcatgtgaaagatgcattgtaaaacttttgcattaatatgctatgaattaaaatcctatcagatatatttgcaagatgtcaaaaggaaatggcaacgacgtgtaatgttcaagtccccaaatcaaaaa

SEQ ID NO: 2554 - DNA, 525 bp, Gossypium hirsutum
  Clone ID: uC-gsronu33B099h11b1
gttagatctaccagccacacccgctcaagattcgaacttcatcgaatcatggtccaaagtcatacccaacatagaccctcccaagacaccatcttctttcatgacccctcgccccgccaccccttctgctatcccttctaaactcactgttaactttgttcttccttatgcatctgagctctccgctaaagaggttgacatggtaatagttccagcaacaactggacagatgggtgttttgcctggtcatgtccctacaattgctgaactgaaacctgggatcttgtcggtgcatgaaggaaatgatgtcacaaaatatttccttagcagtggttttgctcttattcatgccaactctgttgcggatattattgctgtggaagcagtgccagtcgaccacctcgatccggccttggtccagaagggtctggccgactttacccaaaagcttggctcggctacaactgatctggagaaaagtgaagcccaaattgggtgtgacgttcacagtgctatgagttctgc

SEQ ID NO: 2555 - DNA, 436 bp, Gossypium hirsutum
  Clone ID: uC-gsronu33B099h12b1
ttttgcttaatccctatttgccacaagatccttatgacaaagctaccgctcgattctggatcaagttcatcgacgaaaagtgctttcctaccctttggctagctgcatggagcgccgagaatgagcgagaaaaagtgacgaatgaagcttgcgagtatctgaaaacgcttgaaagtgcgcttaatggaaagaaattctttggtggagaaaccattggaatggtagatattgttgctagctctgttgggtatttcattagggtcactcaagaaattatggggcaaaatctgctgtcagctgacaaatttccccaattattccaatggtctgaagatttcgcaaattgcagcattgttaaggaaagtttgcctccaagagacaaactacttccctttgtcaaaggtcttattggcaaatatcagcaagataatgctta

SEQ ID NO: 2556 - DNA, 70 bp, Gossypium hirsutum
  Clone ID: uC-gsronu33B100a02b1
caatgtccaaaactgaagagatccaatctctctctgttcacaaacaatggatgttattacctttttcccc

SEQ ID NO: 2557 - DNA, 109 bp, Gossypium hirsutum
  Clone ID: uC-gsronu33B100a03b1
aatactccccgctgaggctcggagcaccatcatgaactttttccgcattcctctcaacattttcgcctgcattgcgctatacaatgccgacgcattccccattaccgtt

SEQ ID NO: 2558 - DNA, 166 bp, Gossypium hirsutum
  Clone ID: uC-gsronu33B100a04b1
cccactcgtccgttatcacctccacagtatggcagtgcctgcccaatgaaattgcagcagctcccctcttctaccggaagtggttatccgcagttttcaacagctagggtactaccacacgcattacctactgcatccgggtgtggtccctctttatctacctatt

SEQ ID NO: 2559 - DNA, 321 bp, Gossypium hirsutum
  Clone ID: uC-gsronu33B100a05b1
cttcttcagaagtttatttaattaaacatttaagtttatacatcaagaaattcgtgcactaaattaaaaaaacttccccgacaaggattgaggttaggaagttagctttcttcacccagttttcaacctccttcaagttcaaaaaagtcctggaattcaaagcttttaccaatttcttcgccgtgaaaaccaccattaaaacgcaatcaatcacatttccctctcaaaacccccgtcaaaactcagctttcaaaagcctagggagagagctaaatcaaacgaaaacacactaaaatagaaaagagagagaaactgaagcag

SEQ ID NO: 2560 - DNA, 60 bp, Gossypium hirsutum
  Clone ID: uC-gsronu33B100a08b1
tcggttccaaaggaacatgaaaccacaataatttgggcaggaaattaatattaacttagt

SEQ ID NO: 2561 - DNA, 90 bp, Gossypium hirsutum
  Clone ID: uC-gsronu33B100a09b1
aaaaatcctattcggttggcccgatttttgctcctctccttcgcttgttgcaggtacgtgcgtgcgcgagattcatggcagcgagggggg

SEQ ID NO: 2562 - DNA, 285 bp, Gossypium hirsutum
  Clone ID: uC-gsronu33B100a12b1
tcgttgcattaaatccggatgaaggtggataccatgtactgcttgctaacatatacgcaacagcttcgatgtggggtgaagtagccaaagttcgaactacaatgaaaagaaagggcttcagaaaacgccccggctgcagtgtagttgcgttgagaaatgaagttcacagtttctactctgtaaccacaaaccaccctcagcctacatagatatatgcttttctttaggtgctaggaaataagatcaaagctgtcgatcttgtacctgacacaagtttcatttctt

SEQ ID NO: 2563 - DNA, 114 bp, Gossypium hirsutum
  Clone ID: uC-gsronu33B100b06b1
cccactcgtccgctcacatctctgggaataagctgaccaaggatgagcgataagacagggaatcccgctgctctgttctcccctgttgaaggtgccgccagaaaaccccagtgg

SEQ ID NO: 2564 - DNA, 180 bp, Gossypium hirsutum
  Clone ID: uC-gsronu33B100b10b1
tctagccgtcttagtttaagaaaacatttccttagagcataaaagaatagttacgaacatgccgggtgtcaatcctgaaattgagttcccagccattgagtttcgtttatcggatttgaagcgaggaactgaaggatggaaccgtctgtgcaagagggctcaagaggcttgtgagacttt

SEQ ID NO: 2565 - DNA, 149 bp, Gossypium hirsutum
  Clone ID: uC-gsronu33B100b11b1
tcgaaaactctaaaccaaaaaaaaaaaacaaaaaaaaaagtttcaatttaaaaaaccaaatacccacaataccccaaaaaaggaataccttgggggggctcctctggtgttccccggtcttcttccgtctctctgctcttccttttttt

SEQ ID NO: 2566 - DNA, 125 bp, Gossypium hirsutum
  Clone ID: uC-gsronu33B100b12b1
tcgcaatttcatgcttccaccacatgaaattcttgcaaggaggcttgcaaggaatcagatttcgtcattctcagtttttgaaggtgttggtagaaaactaaaagggagggattcgaagaaagtga

SEQ ID NO: 2567 - DNA, 345 bp, Gossypium hirsutum
  Clone ID: uC-gsronu33B100c01b1
attgttagcgggttttcaggatttattcatgaacgtcctgctgtgcgtatacatgcatctcggcctgttaattccaattcactggccttctttgttacagttcttttgttattcatgattttaaactctcaccaaatgtctccaaattttctgctttggctagtagtaggcatctttttaatggctactagccttaggatgtatgcaacttgtcagcaacttcaagctcaggctcgagctcacgctgctgcagctagtggtttgcttggtcataccgagttgcgtttgctcatgccaccattaatagtttttgctacaagaggacgcttactaggactattatct

SEQ ID NO: 2568 - DNA, 466 bp, Gossypium hirsutum
  Clone ID: uC-gsronu33B100c02b1
aaaaatatggcgttttcgggtgttctgaaaaccctaatcaggtcatcgcatttgggatctacgactcgtaatttcagccttgttagcagccaaatcagcaatcacactgcgaaatggatgcaggattcaagcaagaaatctcctatggagttgatcaatgaagtccctccaatcaaggttgaaggccggattgtagcttgcgaaggagataataatcctgctttgggacacccaattgaattcatatgccttgacttgaaagagcctgctgtatgcaagtattgcagcctacgctacgttcaagagcaccatcactagaaactactttttaattcttctcaggctgttgggacaattgctatttcgctgtacccatggggcactcttctctgtttcagcttgttggtaacacatttgatgaacccattttagtgtaatgcttttttctttccttttcacataataa

SEQ ID NO: 2569 - DNA, 115 bp, Gossypium hirsutum
  Clone ID: uC-gsronu33B100c03b1
ggatgtgtacacctgatgcaactagagcagaacttgctcttgtagttttgtatttgaataaggccgaagcaagggatacgatatgcagggctatacaatatggctcgaaattctt

SEQ ID NO: 2570 - DNA, 75 bp, Gossypium hirsutum
  Clone ID: uC-gsronu33B100c06b1
gaacgtgaagaagttcactgagaagcagtttggagatgaagattctactcatgccgacagggaaggtacggaagg

SEQ ID NO: 2571 - DNA, 128 bp, Gossypium hirsutum
  Clone ID: uC-gsronu33B100c08b1
tgttcgcccactcgtccgcccacgcgtccggttgatttaaaaaaaaaaactcgtcaaaatagtagaaatccctaaagaacctttcggtttctgggtttcgaatacccctttattcgtaagatgtcatc

SEQ ID NO: 2572 - DNA, 110 bp, Gossypium hirsutum
  Clone ID: uC-gsronu33B100c09b1
tcgcccatgcgtccgattttttttttttttcagtctgtctatctctctctctcccctttcagcaatcaatacactgcgttgaagcgatttaacggcgatgcctggcggag

SEQ ID NO: 2573 - DNA, 92 bp, Gossypium hirsutum
  Clone ID: uC-gsronu33B100c10b1
tcgcaatttctaccgacagttgggtttctttggtctttttttctctttatttctccaaaacacgtttacgacaccaccatgagcttaacaaa

SEQ ID NO: 2574 - DNA, 519 bp, Gossypium hirsutum
  Clone ID: uC-gsronu33B100d01b1
ggtataattccggaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggcggccctcgaaaatccggaggaccgagtgccgtccgcgccctggtcgttctcataaccgcattaggtctccatggcgatcagcctctggtcattggttcaatgtatgcacggtaagcctgctcattggatccgctacctctttctctggattgtctctcaggtcttctcatttatttctctattcctcattctttttttaccttttttctatctctcatttactttctattcctacagttcctttcctctcattctccctcttctcttactcttcttttattctctttcctcttattttctatttttcctttctttctttttctttttt

SEQ ID NO: 2575 - DNA, 116 bp, Gossypium hirsutum
  Clone ID: uC-gsronu33B100d02b1
acccatgcgtccgttgtcatgctaacaattaatgagtttgattatttgctgttggatcaagcggacagcatcttatactgctttaagatgcataatatgaccaagtgtttgacacg

SEQ ID NO: 2576 - DNA, 100 bp, Gossypium hirsutum
  Clone ID: uC-gsronu33B100d03b1
ggatgtctgagcatggcagcatcaaagatcatgggcggaaacgggatcgtttcacgctccgctgcctcctatctccgactccgttccggcatgggtctcc

SEQ ID NO: 2577 - DNA, 163 bp, Gossypium hirsutum
  Clone ID: uC-gsronu33B100d06b1
cccgctacttccctttgccccgaaggcatgaataagatggtaattaatcatttagacaagctctttgttaccaatgatgctgctactattgtcaatgagctcgaggttcaacatcctgcggccaagattttagttctagctgttaaggctcagcacgaggaga

SEQ ID NO: 2578 - DNA, 54 bp, Gossypium hirsutum
  Clone ID: uC-gsronu33B100d07b1
tgcccgcccactcgtacgcacacacgcccggtaagaagcaagtgaattattgga

SEQ ID NO: 2579 - DNA, 90 bp, Gossypium hirsutum
  Clone ID: uC-gsronu33B100d09b1
tcgaggatccttggccacactgttgaggcattaccggtcttcctcttcaatctttgccttcacgaacgaggaatgaactgagctgaggct

SEQ ID NO: 2580 - DNA, 102 bp, Gossypium hirsutum
  Clone ID: uC-gsronu33B100d10b1
tcgcggactcgtggggaatactttattaccgaagataatgtcgggatgctcaagttggcaaaagaggctaactctatcctgcttgattatcgtatccctgct

SEQ ID NO: 2581 - DNA, 305 bp, Gossypium hirsutum
  Clone ID: uC-gsronu33B100d11b1
tcgtgcctcaaaggttccagatgttagtccaaccaatgtctccgaggttcagaacggtggagtgaccgactgctttctgatcgaattgaattttcctaccgttccagctattgatttcaattctgctgaggcttcacttgtatcgaaagccttgaacgatgctccacttattgatgttaagagaacgactcccgcagatgatatctttgttgtgctcccatctggaaaatctgttaccgaaatggagccacggttcgacgacatactgaaatgttctggactaggcttaattgttacaggagctg

SEQ ID NO: 2582 - DNA, 508 bp, Gossypium hirsutum
  Clone ID: uC-gsronu33B100e01b1
aaagttgagagatcactgcgaaacagaaaaaggaaaacttattgtggccgtacgattactcctcatcaacggctttgatttgcttgttctcttagatccctccttccttcatcgttcatctcacctcctttggtctaggtctctttaattgagcaatattacaatgggaaaactacgccaatggtagaatagctcggttgcgtctacttggctatcaaaacctcatataacttgcctcaactgatagatcatctgcttttgctttcacaaggccgtcgagatattgaaatgcagtcacctcctgaaaaagcttttgttatgttgaaaagggaagcaactgacttggctgggtcaagttttacaagtcacgtggatagtactttccaagatgctgtaaatgctgctgctttttctgctttatcatcctttttagatgatgactctcaggtgacacaaaatgaagacgacctttataatgggaatacttctaaacaggtggtgctttatg

SEQ ID NO: 2583 - DNA, 93 bp, Gossypium hirsutum
  Clone ID: uC-gsronu33B100e02b1
gaagtctgcgtttatgacacttatactttgcctaagctgtatgttaagatgcaatactgtgtctcgtgtgcgatccactcccacgttgtgaga

SEQ ID NO: 2584 - DNA, 451 bp, Gossypium hirsutum
  Clone ID: uC-gsronu33B100e03b1
attgatagttattgattaggggatgactcattgaagatgaactacacaacgttggtgcggatgatgaaatatatggcccctccaccaggagagtatgaaagaggactctttgctcatactgatgaaccagctagcacactcatttgtgaggatcaaatttcaggactggaaattgaggtcaatgatggtcaatggatcaagctaactaatttatctccttcttcctttgtatttgtggttggagatcccctcaaggctcggagcaatggtagattgaaatcagtgaatcacagagtgatgacgagcggatacaaagatcgatactctatagcagccttcgtcttccaaatgagggtactataatcaagacacccaaagagattatagatgaccatcattcttggcttttcaaggacttatatttgatggaggtcttcctttattgcctttc

SEQ ID NO: 2585 - DNA, 116 bp, Gossypium hirsutum
  Clone ID: uC-gsronu33B100e04b1
agaattaaaagataaaaccttctagaaacttcaaaagaaatggaaagtttttagtttccaactgagttggtttcctcttgaccgcttgagccgggtcttgtgtgcttatctcgttt

SEQ ID NO: 2586 - DNA, 153 bp, Gossypium hirsutum
  Clone ID: uC-gsronu33B100e07b1
tcgaagcttcttgaataatttgcacgttgctttgcctcccgtgattatcctttcatttcaaagaattctcaatttattcccctttgatatgcgacctttgttccccccacacccgattgcttgtgttgcaatgatggaaaaggctccgtggtt

SEQ ID NO: 2587 - DNA, 414 bp, Gossypium hirsutum
  Clone ID: uC-gsronu33B100e09b1
gaagtctccaaggaagcaacttgctaccaaggctgcccgtaaatctgccccaaccaccggtggtgtgaagaagcctcatcgctaccgtcctggaactgttgctcttcgtgaaattcgaaagtaccagaagagtactgagcttcttatcaggaaattgcctttccagaggcttgttcgtgaaattgcccaggactttaagactgatttgcgtttccagtgtcatgcctgtcttgctcttaatatagctgtttttgctttctttttgttcttttttaattatctctatttttctttgtattttcttcttccttttttctataaatttttttatttttttttttatcctttttttatttcttattttattcctcttctttctttattattttttattatctcttctctttttttatt

SEQ ID NO: 2588 - DNA, 393 bp, Gossypium hirsutum
  Clone ID: uC-gsronu33B100e10b1
tcgggcatccggggctgatgttacgcaggtctcttatgctgttggtaaggacacaaggattggacccaaatttttgaatgctagtgtcggttttggtggatcctgcttccagaaggattttctaaacttttgtttacattttgcgagtgctatggccttcctgtggtggcagtgtatttgcttgtttttcttttatatcaatgtctattatatattctcattttatctccttttttgttttttaatgtttacctttttctcttctttttttatttctttaataattctttttttttatttctctttttatcttttctttcttttattttttattctctttacttttctctttttttctttttatttttctatttctcttttttcttttttttt

SEQ ID NO: 2589 - DNA, 203 bp, Gossypium hirsutum
  Clone ID: uC-gsronu33B100e11b1
cttattacacagtgagctttttgcagtgctttatttattgattctcttagttctcgttttcatcggagaagaaaagtcaaaaaacaaaaatttcatggctcggaaattctttgtcggtggcaactggaaatgcaacgggacaactgaggaggctaaaaagatcattacaacattgaatgaagctgaagttccttctgaggatg

SEQ ID NO: 2590 - DNA, 130 bp, Gossypium hirsutum
  unsure (1)..(130): unsure at all n locations
  Clone ID: uC-gsronu33B100e12b1
ggatttcccgctgagtttaagcatatcaatccgccnggggaaatgtatacttaccaggattgccctagccccggcgagcgaaccgggaaaagcccagcttgagaatcggtcgccatcggcgtccctattg

SEQ ID NO: 2591 - DNA, 262 bp, Gossypium hirsutum
  Clone ID: uC-gsronu33B100f01b1
cccattcgtccgtccacgcgtccggattctccgccacatctttccaagtcctaggccacatgaaaacggtttgtgtattgatattgggatggctactctttgattcggagctgacactgaaaaatatactcgggatggcgattgccatcctcggcatggtagtctacagttgggctgttgaagctgattaacaaacggatttcaaggttttaccactccccatggtagcttttgaagaaaaagttgaattggtaaaacaatc

SEQ ID NO: 2592 - DNA, 161 bp, Gossypium hirsutum
  Clone ID: uC-gsronu33B100f04b1
cccactcgtccggttatcactgaagacgaaatcaaggctctcattaaagggagtgagggagtttacaagcctgttgaagcttacctcttggctaatcccgaagcctgcaactaggatataagctgcttaattcgaattcttatgcttgcttttaaagaggg

SEQ ID NO: 2593 - DNA, 175 bp, Gossypium hirsutum
  Clone ID: uC-gsronu33B100f05b1
agccattgatgatggtcgtattggtccaagagatgatcccaaggttcgttcaaaaattttggctgaggagtatggatggtacatagtttttgttatgaagacttcgtgtttcttcctcatctttcttcttcttctctcttttatcccttcttattatctttttttcttctttttt

SEQ ID NO: 2594 - DNA, 490 bp, Gossypium hirsutum
  Clone ID: uC-gsronu33B100f07b1
ctttaagaaggataccggtgacactagggagacccctgctatcgatgtatgcaaaggactcttgggagacaaagctcgattgagcatatatgacccgcaggtgaccgaagaccaggtccaacgggatctttccatgaacaagtttgactgggaccatcctcttcacttgcaacccatgagtcccacgactgtcaagcaagtcagctgtgtgtgggatgcttatgaggcaaccaaagatgcccatggaatttgcattctgaccgagtgggacgaattcaagaaacttgacttcaagaggatatacgacaacatgcaaaagccggcttttgttttcgatggaaggaacatcgtgaacgcggatgagctgagggagattggtttcatagtgtactcaattggtaagccactggatccatggctcaaggacatgcctgcagtagcataaatggtcttcgattacagatggagtcccggtcaggttgattcatac

SEQ ID NO: 2595 - DNA, 224 bp, Gossypium hirsutum
  Clone ID: uC-gsronu33B100f09b1
tcgcccatgcgtccggcaaaacagaaaatcgaaccgactgaaagtgagactcagattcttcaagacttgcagaaatggaaaacagcggaaaacatgaagcagagagatatgccgtagtgaccggagcaaacaagggcatcgggtctgagatcgtatggcagctcgcttcaaatggcgtatcagtcgtattaacagcttgtaataaagtgtggggaaacgtggct

SEQ ID NO: 2596 - DNA, 284 bp, Gossypium hirsutum
  Clone ID: uC-gsronu33B100f11b1
tttttctgcagtagcgttcaagtttttaccaatccaaaatttcaatttaaagaaaaaggagaaaacagaaatggctcgctctttctcaaacgctaagcttttctctactttcgttgtcgatggaatctctaacgttatctccagacgaggatatgcggcggcgtcacaaggaattgcgtcgagtggaataagaggaggagcaggaaggagcgctgctgcggcagccaagaaaacaggggaagagatgtctggcggtgctaaagagatggtttcttggtctttcc

SEQ ID NO: 2597 - DNA, 76 bp, Gossypium hirsutum
  Clone ID: uC-gsronu33B100g01b1
cggactgcgtggtctgacgcgtgggttagaagagaaaaagggctagtgaggtaggtcccctcctctaccaagatcc

SEQ ID NO: 2598 - DNA, 181 bp, Gossypium hirsutum
  Clone ID: uC-gsronu33B100g03b1
cccactcgtacgttctctctggtctccattttttcccctttctcctcttttcctctaaacccagagttttttttccatagaaagcgaagaaactggaaaacgacgacgcagtgaaaaaaaaaaacatgtcttacgattatctttctaagtactttatcatcggtgacactggcgtgggaaa

SEQ ID NO: 2599 - DNA, 162 bp, Gossypium hirsutum
  Clone ID: uC-gsronu33B100g04b1
cccactgtcgtccgctccctgagtttttgcctttcacatttccagaacatttaaaattgtgttagcattgaacttttaatctggatccctgagagttattatttttgtattggaatttagattatctttgaactttataaatgcaagcttattttggttggt

SEQ ID NO: 2600 - DNA, 264 bp, Gossypium hirsutum
  Clone ID: uC-gsronu33B100g05b1
cttgcttaatacctactaccaaaccaaaacaccaatttcccctcaaaagtaaaaatcccaacctcattttccttcaaaccaaacacacccttttaccatcatggcccctaacatcaccactaccaaagctgccactatcactgccaaggctcccgagagggcttatgttacgttcttggctgggaacggagactacgtcaagggcgtggtgggtttagccaagggactgaggaaggtgaacagcaagtacccacttgtggtggc

SEQ ID NO: 2601 - DNA, 155 bp, Gossypium hirsutum
  Clone ID: uC-gsronu33B100g08b1
tcgaatatatttgtctgttttcttgaagcacaagaataatgcctgagaaaatatcagaggacttatttaacaatctagtagagaccattgcagatagtgtctctaagcagaaatctgtgtccttttttgaggaagagaaatcaaactcggttgtt

SEQ ID NO: 2602 - DNA, 231 bp, Gossypium hirsutum
  Clone ID: uC-gsronu33B100g09b1
tcgccctctcgtccggaaaaaaatcagagaaattctcacttgtcttgctaccaaagaaaagttcccaaaaactccgatcgacgatgtccggtatggaacgattgcacaggatgttcgccggcgctggtggtgcgttgtttcacccgccgccgtatccgccgtcttttgatttttttggagctggttttcttcttttctttgtccttccttattatgtttatgctcttgttg

SEQ ID NO: 2603 - DNA, 420 bp, Gossypium hirsutum
  Clone ID: uC-gsronu33B100g10b1
attccttcccagaatcaaatctttctagagccacagtctatgacaaaatctcgagttcatcgggcaatcaaaatcactgagcccggactctacctcttcatctatcctccataaccatcgtttcgtctctcttgattcaccaggttttccactgcaggcggtaccttctctatccagtatcgagggtgctaaaatcggattccttcctttgccatctcatgagtagcgttgttggcttcccttagagttcagtttccgtatattagtaagcgcatctcctttaacacaaacatactacaaacccagctcttttgccatgacaatagcttgtaatacatgcccgtgcctcattcataattggatctaatatcttatcccatggtacgtttcaggctgccatagtcaaacatctctttattc

SEQ ID NO: 2604 - DNA, 182 bp, Gossypium hirsutum
  Clone ID: uC-gsronu33B100g12b1
accgattgaaggaattgatcaaatacaaaggctttcaggttgcccctgctgagcttgaagccatgctcattgcacatcctgatatcatcgatgctgctgtggtcggaatgaaagacgaggcggttggcgaagttcctgttgcgtttgtggtgaaaccaggctaattagatatcagcgaggat

SEQ ID NO: 2605 - DNA, 243 bp, Gossypium hirsutum
  Clone ID: uC-gsronu33B100h05b1
aaaattgtcggcgtgggccgcaactatgccgcgcacgccaaagaactcggcaacgccgtccccaaggaaccattactgtttttaaagccgacatcatcttatttggaaagtggaggtacaattgaggttccacatccattgaattcattggattatgaagctgaacttgctgtcgtgatcggaaaaacggatcgcgatgtggctgaaaacactgccatgaactatgttggaggctatgcttta

SEQ ID NO: 2606 - DNA, 319 bp, Gossypium hirsutum
  Clone ID: uC-gsronu33B100h06b1
gtttgtcttaataggattagctgcagttttgaataaaaaaccgttctagatgaactgttagtgattggtaagcgacgtcctctgatcgagatcttcattatacttgtcacttgttcatggattttttggatcttttccctacttttcttgttttttattttctctatttccttttttctttcttctactcctttttttctattcctcctactttttcttttctctcttttttttctttcttttttcttcttttttctttaccttattcttcttctttttttcttctattatctaccttcccctcccttttctctctttt

SEQ ID NO: 2607 - DNA, 544 bp, Gossypium hirsutum
  Clone ID: uC-gsronu33B100h08b1
tggtgaaccactttgtgcaagagtttaaaagaaagaacaagatggacattagtggtaatcccagggctcttaggaggttgaggactgcttgtgaaagggcgaagagaactttatgattcactgatcaaacaaccatcgaaattgactccttgtatgagggtatcgatttttactctaccattacccgtgccaggtttgaagaacttaacatggatctattcaggaagtgtatggaaccagttgagaaatgtttgagggatgctaagatggacaagagcactgtccatgatgttgttcttgttggtggttccactagaattccaaaggtccaacaacttttacaagatttcttcaatgggaaggagctttgcaagagcattaaccctgatgaggccgttgcatacggtgctgcagtccatgctgctatattgagtggtgaaggtaatgagaaagtgcaagatccttttgctcttggatgtcccccaatgtcttttgtttggaacccttggggtgttataccgttttgttccagggacccaccttt

SEQ ID NO: 2608 - DNA, 219 bp, Gossypium hirsutum
  Clone ID: uC-gsronu33B100h11b1
cccacgcgtccgcaatttctttcaccaccaaccatttaagccttgcagtagcatctttggaccatcctttatcagaagaggtttctcatgctttgaaacaatcaattcgaagaggcttgccaagggttgaggcaaggcattatctttcagtataccaagatattgagtcccataataaggctttgttggagtttgctaagatcgtctttatcacgtttc

SEQ ID NO: 2609 - DNA, 350 bp, Gossypium hirsutum
  Clone ID: uC-gsronu33B101a02b1
ttttctgggatgatgccaaactttttcatgccaatgcttcagcctgggcagcaaaatcagcgccaaggaggcagacgatccggagggggcccaatgcaacaaacacatcaaccacttcccttcatgcagccacagatgattcctaagggccatggctatcgttatcccccaggtcgcaacatgcccgatgttcctggacgtgtgctttctgttccttacaatgtaggaggaatgccattccgagatgctgcattttcacaacccatggcaactggagctctcgcttctgcttttgcaaacgcaacaactgtacagcagaggacttcgttgtgcagatattctgtacccac

SEQ ID NO: 2610 - DNA, 64 bp, Gossypium hirsutum
  Clone ID: uC-gsronu33B101a06b1
cttgttttcaatcgctttcatatcctgaaggaactcggtttgctaaacgttcacgttgcgaaac

SEQ ID NO: 2611 - DNA, 125 bp, Gossypium hirsutum
  Clone ID: uC-gsronu33B101a09b1
tcgtcacgcgtccgcctcattcttcggaactcgggcttcctttacgaccagcgacaactatcaccgcgatatcccaattctaccctaaccgaaccccccaaatactccgctagctcatagaaaac

SEQ ID NO: 2612 - DNA, 219 bp, Gossypium hirsutum
  Clone ID: uC-gsronu33B101a10b1
tcgtcacgcgtccgctttatctcttcaaatggacaactctcttaatccctcccacaactctgataatactgaacatggtcggagttgtggccggagtttcagacgcaatcaacaacggctatggttcatggggtccattgttcggtaaactgttcttcgcattctgggtcattcttcatatttacccattcctcaaaggtttgatggggagacaaaaca

SEQ ID NO: 2613 - DNA, 90 bp, Gossypium hirsutum
  Clone ID: uC-gsronu33B101a11b1
tgagaagcctaaggaacagagacccaaagcaaatgagaataagcctgtcatgacagagtaacagctgcttttgtttagtatgaatggcaa

SEQ ID NO: 2614 - DNA, 78 bp, Gossypium hirsutum
  Clone ID: uC-gsronu33B101a12b1
tcggaaatttaaaaaagagttattttttttttgaatattttttttttttattcatataatacacaaggcctagaaccc

SEQ ID NO: 2615 - DNA, 191 bp, Gossypium hirsutum
  Clone ID: uC-gsronu33B101b04b1
tgtcgatagggccttattacaatgtgaatgagatttttttccccctttgatatggtctgagtttcatacatcacatggctttcttaatttgtaatgttgctttgacttaatctccaaacccttatcgatcactttcttcgattctaagaattttctataccccataatttcactcccttactttcacatta

SEQ ID NO: 2616 - DNA, 419 bp, Gossypium hirsutum
  unsure (1)..(419): unsure at all n locations
  Clone ID: uC-gsronu33B101b05b1
ctcactcgtccgggcaatcaacatggagaacggatatatcaacccggcaccaagtccgcttaggaaaatcatcacggttgcatccattgccgccggcatccagtttgggtgggctctgcagctgtctctcctgacaccctatgtccagacccttggtgtaccccacgcttgggctgctttcatttggctttgcggtcccatttctggccttctggttcaacccattgtgggatacaacagtgaccgttgcacttctcgtttcggacgacgccgaccctttattgtcattggagctctctctgtctctatagctgncttcctatcggtttcgccaaagacattggccaccatgcgggagaatccttggagagatcgactaaaccgagagctttagccttctttgtcgtcggaatttggat

SEQ ID NO: 2617 - DNA, 291 bp, Gossypium hirsutum
  Clone ID: uC-gsronu33B101b07b1
tcgtcacactttgtagggcccaatctgcaattaaaccctttagtatatggtactatctatgccttcccttttctgtcttccctttatggctccaattttctcttcgtttcttgctttaactctcatttttccattaagcaatgctcaaggtccaccttcccctggattctccccaagctccagagtgagcactgtggcttttgataaagggtttcgaaacctctggggtcctcagcaccaaaaactagaccagggcttatcaacagtctggctcgataaaagctcagtgag

SEQ ID NO: 2618 - DNA, 272 bp, Gossypium hirsutum
  Clone ID: uC-gsronu33B101b08b1
tcgtcacgcgtccgcccacgcgtccgctacacataaaatctgtgcctgccctttgctctgcacacctcgggatatcagtttcaactccactcatcccacgggttgagtaccgagtccatatattggtaagttcaaggaaggaacttgggcatcatgggtcttaaggcattagactatgagacaatgaatgaaaacgtgaagaaagctcaatatgcagttagaggtgagttgtatcctcgagcttctgagctttagaaggaagggaagaagat

SEQ ID NO: 2619 - DNA, 293 bp, Gossypium hirsutum
  Clone ID: uC-gsronu33B101b10b1
tcggtctttcattgttgacatccgtgctgacaagaagaagattaaagatgctgtgaagaagatgtatgacattcagacaaagaaagtgaatacgttgatcaggcctgatggaaccaagaaggcgtatgttaggttgactccggattatgatgctttggatgtggcaaacaagattggaattatctaagcagatcaaccaattgttttcttgcttttaacagactttgatagaacgatcaactatgttaggacttctttatattcgtgtctgctttatatgtgtaaggtacttt

SEQ ID NO: 2620 - DNA, 77 bp, Gossypium hirsutum
  Clone ID: uC-gsronu33B101b11b1
tcgttagagaaagatttgttatgcagggctcatgatgttcttcagatggcaatgcacaggcttgaggatgagatcaa

SEQ ID NO: 2621 - DNA, 229 bp, Gossypium hirsutum
  Clone ID: uC-gsronu33B101b12b1
tcgtcagaccgttgctgtcggtgtcatcaagagtgttgagaagaaggacccaactggtgctaaggtcaccaaatctgctgccaagaagaaatgagagattattgcagagataattatatcagtttttattacagctttggacaattatcttaaatttggactttaaatttactttttgtgagacttgttgatttgctatttaaacaaattttagtttttatgttctaat

SEQ ID NO: 2622 - DNA, 234 bp, Gossypium hirsutum
  Clone ID: uC-gsronu33B101c01b1
ttcagcttcatttctccaagatggctagagggttgaagaaacatttgaagaggctcaatgcccccaggcattggatgcttgacaagcttggtggtgcttttgcacccaagccatcgtctggtccccacatgtccagggaatgcttgccattgatccttattttgcgaaaccgattgaagtatgctctcacctatagagaagtcattgctattttcatgcagcggcatgttatgg

SEQ ID NO: 2623 - DNA, 493 bp, Gossypium hirsutum
  Clone ID: uC-gsronu33B101c02b1
ttaaaagaaaaaaagatcgtttattttttgctttcttatcgacgccatggcacctaacggggtcgtttccgacaagagtttaatcgtgagtttcggtgagatgctcatcgacttcgtccccaccgtctccggtgtttctttagcggaagctccaggcttcctcaaagcccccggtggagccccagccaacgtggcgattgccgtctcaagactaggcggtaaagcatccttcgtcggaaaactcggcgacgatgagttcggtcacatgcttgccgatattctcaagcaaaacggagtctctggtgacgggatcttatttgaccaaggtgctaggaccgctcttgccttcgtaactctacgcgccgacggagagcgtgagttcatgttttattggaatcccagtgctgacatgctgttgacgcccgaggaattgaatcttgatcttataagatccgccaagtatttcccttccgtcaataagtttgatcgagag

SEQ ID NO: 2624 - DNA, 53 bp, Gossypium hirsutum
  Clone ID: uC-gsronu33B101c05b1
ttccttgttctgaacgtaacaaagttcctggaagaacatccattaggagaaga

SEQ ID NO: 2625 - DNA, 180 bp, Gossypium hirsutum
  Clone ID: uC-gsronu33B101c06b1
gtaatttatcagcaattcaccgtcttagctcattcgccgtatcagtaatggcagacgagattgaactgaaaacagccccagctgactttcgttttcctacatcaaatcaaactagacattgtttcacctgttacatcgagttccacgggtgcttgtctgcataaggagaatcttatgaat

SEQ ID NO: 2626 - DNA, 108 bp, Gossypium hirsutum
  Clone ID: uC-gsronu33B101c07b1
gtacaatctaagtctccctgtgagaaaatggcatcctaccaaatcttagctttcgcagctttgttcttgatcttgttacccgtagccgtcaatggagatttagatagg

SEQ ID NO: 2627 - DNA, 393 bp, Gossypium hirsutum
  Clone ID: uC-gsronu33B101c10b1
cttgttgatgttcagagcagtaaggatcctgaaggtcttcgcatattttattatctggttcaggatttgaagtgctttgtattctctcttatctcactccacttcaagatcaagcctatttgaagaatgaatgatgatattgaaatcctccactatagaggggagagtggtgtgtctgtcacaattggcgtttctgcgtttgatataaagctttgttttccatttccttttgttctcttgaattgatgagctaagtctgtgatggttgggttgtgtgagtaatttttttggaattacataatgtcactctgtttcttgtgtgaaagcttttatgattgtgcacttgttttctttttagtgttccaaataagaagttcttttagctttggcatt

SEQ ID NO: 2628 - DNA, 261 bp, Gossypium hirsutum
  Clone ID: uC-gsronu33B101c12b1
tcgttattaacggttgtcctatcgagcttgttgagcccgaaatcctccgtttcaaggccgtcgagccaattcttctcctcggccgccagcgttttgccggcgtcgacatgaggatccgtgttaaaggctgaggccacacttctcagatctacgccatccgtcaaagcattgctaaggccctcgtcgctttctaccagaagtacgttgatgagcaaagcatgaaggagattaaggatatcttagtcgggtacgataggactt

SEQ ID NO: 2629 - DNA, 560 bp, Gossypium hirsutum
  unsure (1)..(560): unsure at all n locations
  Clone ID: uC-gsronu33B101d02b1
tcaatttcacttccattttattaattttagcttcccaagaatggcttctttcggagaaacatcatctgctttagaactcataaatcaacaccttaatgattttgcttcaatggaaacctttctttcacctcctccaacaccccagtttcataaacaatccaccctaagccaacgtcgtccttctattaacgtcacaattccaccatcgaaagttgaaataacctccaccgccacgaaagccatcgaggaacatgacgagaaaaggcattacaggggtgtaagaagacgaccatggggaaagttcgcagccgaaattagagaccctaatcgaaaaggttctagaatttggctcggaactttcgaaaccgctatcgaagccgctaaagcttatgatagagctgcttttaagctacgtggaagtaaagcaattttgaatttccctctcgaaatcggaaactcgaactcaactgaatcccaaccctcgaataaaagaaaaagagaagaagaagaacanngagaggaagtngtgaanaaggaagagataaccggaaacgtaacga

SEQ ID NO: 2630 - DNA, 81 bp, Gossypium hirsutum
  Clone ID: uC-gsronu33B101d03b1
tctcactcgtccgcggtgcgcaaggatgacgaggtccaagtggttcgtgggacctacatgtgactcgaagggaaagtggtt

SEQ ID NO: 2631 - DNA, 70 bp, Gossypium hirsutum
  Clone ID: uC-gsronu33B101d05b1
gtaatgaagtggttgcgatggttgtcatgcaggtggtggtgttggcggctgatattccctacactatttc

SEQ ID NO: 2632 - DNA, 54 bp, Gossypium hirsutum
  unsure (1)..(54): unsure at all n locations
  Clone ID: uC-gsronu33B101d06b1
ggaaagctggnacgcccgcaggcaccaggtccggaaatacccggaaacgaccca

SEQ ID NO: 2633 - DNA, 131 bp, Gossypium hirsutum
  Clone ID: uC-gsronu33B101d08b1
tcgtaggtcgccgtacccattagtattctttggcaaatacctcaatatttcttgttgggtgccgcagaggtctgcacatttatcggacagcttgagttcttttatgatcagtcccctgatgccatgcggag

SEQ ID NO: 2634 - DNA, 312 bp, Gossypium hirsutum
  Clone ID: uC-gsronu33B101d11b1
tcgtttgattttagcttccgcaagcaaaccctaaccctaaactttcttttcttcatctttttttttcctctcaatcgcgataatgtctcacttcggaaggtcaggcccgcccgacatcaccgacacctactcccttctcgtcctcaacattaccttccgcacgactgctgatgatttgtttccgctcttcgacaagtacgggaaggtcgtcgacatcttcattcccaaagatcgaaggactggtgattctcgaggctttgcatttgtgcgctacaagtatgccgatgaggctcagaaagctgtagataggct

SEQ ID NO: 2635 - DNA, 233 bp, Gossypium hirsutum
  Clone ID: uC-gsronu33B101d12b1
tcgttgaaaggcccttaccaattttcaactcgaaaaccctaaaaactggtaactctcaaagactcaagctttaacttgcaaaatcaccaactttttttttttgaaatggagggatcggaaaatgacggaaatgttacgccgatcgcgaagtggaagaccgagttctcgaggaaagtccattctttttttgacaggtcaacaccacacacgatggattggtggttgtggacatt

SEQ ID NO: 2636 - DNA, 71 bp, Gossypium hirsutum
  Clone ID: uC-gsronu33B101e01b1
ttcactcgtccggcactcttgtgcgtgttcttattcatacggatgttacaaaggatctttacttcaaagct

SEQ ID NO: 2637 - DNA, 94 bp, Gossypium hirsutum
  Clone ID: uC-gsronu33B101e02b1
tccactcgtccgcgtgactccgccgctgttttcgcttggaaaggggagacccttcaggaatactggtggtgtactgagagagcccttgattggg

SEQ ID NO: 2638 - DNA, 90 bp, Gossypium hirsutum
  Clone ID: uC-gsronu33B101e03b1
tttctatttgaaatcaaatctataatggagtcatccgaatttaaaaaaaaaaaacacgatataaacccaaaaaacataaacaaaccaaca

SEQ ID NO: 2639 - DNA, 119 bp, Gossypium hirsutum
  Clone ID: uC-gsronu33B101e05b1
ttgatacgacagtgggcacgtggagatatcggaatgtatagacgcggaaggagacagaaataactccttctaggagagttctcattacgaatagtgataccatgattctgcatagagat

SEQ ID NO: 2640 - DNA, 210 bp, Gossypium hirsutum
  Clone ID: uC-gsronu33B101e08b1
tcgtcaagagataacaacttgcttggtaaatttgagctctctggtatcccaccagctcccagaggtgtcccacagatcacagtgtgctttgatattgatgccaatggtattttgaatgtgtccgctgaggacaaaaccactgggcagaagaacaaaatcaccatttcaaatgacaagggaaggcttttgaaggaggaaattgagaaaatg

SEQ ID NO: 2641 - DNA, 51 bp, Gossypium hirsutum
  Clone ID: uC-gsronu33B101e09b1
tccacgcgtccggtagcggtagccgttcttgctttcagttaagcagcgaga

SEQ ID NO: 2642 - DNA, 161 bp, Gossypium hirsutum
  Clone ID: uC-gsronu33B101e11b1
tcgtttgtatgagggtcctcttgatgatatctatgccaatgctatcaggaactgtgatcctgagggtcctcttatgctctatgtttcaaagatgattcctgcttctgataagggtaggttctttgattttggtcgtgtcttctttggctaagtttcaactg

SEQ ID NO: 2643 - DNA, 158 bp, Gossypium hirsutum
  Clone ID: uC-gsronu33B101e12b1
tcgttcacgcgtccgcccacgcgtccgcccacgcgtccgttttacagaaatgttttagctggatctaattagagatttgttaaaatataatatatttttattataataaatatttatattattaaaggggtggtctttttagaggtattaatcttact

SEQ ID NO: 2644 - DNA, 434 bp, Gossypium hirsutum
  Clone ID: uC-gsronu33B101f02b1
cagttttgcgacctggtggcattggtctcaaggatggtctgctctttgctgctctcagtgctaagacacaagggaaagatgtgggtataccagaatgtcagggagctgctactgcaaagtctccatggaatgctcctgagctctttgaccttttggttcttgatggtgaatcaattagggagtggctctttttcgataagcctcgaagagcatttgaaggtgggaacagaaagcagaggtctttgccggattacaatgggcgtggctggcacgagtcgagaaagcaagtcatgaatgaattcggaggactgaagagatcatactacatggatccacagccactaaaccattttgagtggcatctttacgaataccagatcaataaatgtgatgcttgtgccttgtatcggttggaatttgaagcttgttgatgg

SEQ ID NO: 2645 - DNA, 197 bp, Gossypium hirsutum
  Clone ID: uC-gsronu33B101f04b1
tttttcttaggtaaaaaagaagagaaaatgagcggtccttggtgtttcaaccacaagaacggtgtggttcgcctggttgaaaactcatgttcggaccaaaggtcgaagtccgagggcaaagtacttgcacacattccttctaacgaagtgatcactttttatgagattctcaagacttagttgtcgtttcttgtttt

SEQ ID NO: 2646 - DNA, 82 bp, Gossypium hirsutum
  Clone ID: uC-gsronu33B101f05b1
cacttcagagcctccttcaccaaccatccgctctgttcagcccgtgatctttcgaaactctcttcatggagtaccatttcca

SEQ ID NO: 2647 - DNA, 168 bp, Gossypium hirsutum
  Clone ID: uC-gsronu33B101f06b1
tggatagagacattaagggatgggcacagctcatacagagcctactgagtacatccactccatttttctttaacactctttatgacccataccgatccggtgctgacttcgttcgtggctaccctttcagtctccgtgagggtgttaccactgctgttttacacggcc

SEQ ID NO: 2648 - DNA, 365 bp, Gossypium hirsutum
  Clone ID: uC-gsronu33B101f07b1
aagggaacaactcacgtaaataagtaaaatatcttctaatgtaacaaccaaaccaaaataacataagagcatagggctcaatgaaaacctccaaacaaaataaaagcaatccttacaacattttaaacaaaatctttaaaaaggtttgaaaatgctaagagaagcaactaaaagtatcactacatgttccttaatactatatgattactcattggaaggcacaacatgcatgcatgaatgttggtcttagtatcgaccaattccccaaactttgattacaccatctgtataaccactaaataaggtgctttcatttgcacttcagttcaagcttgtgcagtatattaccttttttttgttgcatt

SEQ ID NO: 2649 - DNA, 203 bp, Gossypium hirsutum
  Clone ID: uC-gsronu33B101f08b1
tcgtaaaaccgaaaaaagggagaaacccaagtatgttgttggagtgaaacactgtctgtttgtgaagttaagaagtccagtgtgtagctgtgtacggaaaaaaaagcatggtttctgtattagagattgcaacaaagttgaatttggcttcccaccctgaaggtggctttttttctgaaacttttagggatagttcttgtttt

SEQ ID NO: 2650 - DNA, 433 bp, Gossypium hirsutum
  Clone ID: uC-gsronu33B101f10b1
tcgttttttcatttccccatccaaacgacgccctaaaccaaaagtcatggccaccccttccgcacgtgacgaaaacgtttacctggcgaaactcgccgagcaagccgagcgctacgaggagatggtcaagttcatggagaacgtcgtctccgccgtccctgcccccgacgaactcaccgtcgaggaacggaacctcctctctgtcgcctacaagaacgtgatcggcgctcgccgtgcctcttggcggatcgtttcctccatcgagcagaaagaggaaggacgtggcaacgccgaccacgtctctgtcatccgtgagtacagggccaagatcgaggccgaattgtccgagatttgcgccggaattttgaagctttttgacgagaagcttgtttcggccgccgggaccggtgatttcaaggttttttacctgaag

SEQ ID NO: 2651 - DNA, 193 bp, Gossypium hirsutum
  Clone ID: uC-gsronu33B101f11b1
tcgtattgatgaaaatcaggatgtacttatgaatggatggaagcatttatatatacgaaagttttacttaacaggtttatatgccctacggcatgatgaaatcattgattatggccacgccaaaaaatgaaagaaaagaaaaaaagggggacttgaggcaagtacacaatggtggattgctgctgtaaaaact

SEQ ID NO: 2652 - DNA, 129 bp, Gossypium hirsutum
  Clone ID: uC-gsronu33B101f12b1
ttacttccctaccctggcagagtatttgatattgttcattgtgcacgatgtagagttccatggcacatagaaggtggtaaactcctcttgtagctgaatcgtgtcctgttaccttttggtcttatttct

SEQ ID NO: 2653 - DNA, 122 bp, Gossypium hirsutum
  Clone ID: uC-gsronu33B101g01b1
cccactcgtccgcccacgcgtccgattcaataagaaatggagaagaagaaagtttgagcatgttgatgtcaacttcttgcggtaaatagctgtgggctaacattttgtgaaggtaatgtggg

SEQ ID NO: 2654 - DNA, 113 bp, Gossypium hirsutum
  Clone ID: uC-gsronu33B101g05b1
atcgttatcgacaatttaaatattgattgcaacgtgatattacgatcgttatttacgaattcgatacttctagttactaatgtttaacaaatatcactacattcgaaaacatt

SEQ ID NO: 2655 - DNA, 230 bp, Gossypium hirsutum
  Clone ID: uC-gsronu33B101g09b1
ttatttcctattttcagtgtcttgtataattgcttggttccaaatgttggttttttttagcactcgatccttagtacatgttatatagttgtagtataccactgaatatttcagccatcattttgtgtgtttctagtattcctacagacaccaatacgcaccatgttcacctaaccaaattacaagttatcaatccccattgttattggaatttgtaagattgttgtaac

SEQ ID NO: 2656 - DNA, 173 bp, Gossypium hirsutum
  Clone ID: uC-gsronu33B101g10b1
tgttcttccacgcgtccgatcccattcttccaacaagctgtccttccaaaagattgcaccactgttccaaagtgctatattgaactggcaaaacaggtgaaggaaatgcttagcatagttgttccctactttgacaagttggctgctgccatggcctcatggattgaagcctg

SEQ ID NO: 2657 - DNA, 120 bp, Gossypium hirsutum
  Clone ID: uC-gsronu33B101g12b1
tcgtccacgcgtccgggtgtaccgatggtaccatggttgatatcggctatcattgctataaacatattcctactagggttaatagacggggaatcctttcttaatggtctgctatatatg

SEQ ID NO: 2658 - DNA, 309 bp, Gossypium hirsutum
  Clone ID: uC-gsronu33B101h06b1
ttcatccacttcttctcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttcgtgaaggccttccattccaatatatgaagcaccagatcggaggacatgatgaaagcatttcttcatacagtttcgatttaa

SEQ ID NO: 2659 - DNA, 198 bp, Gossypium hirsutum
  Clone ID: uC-gsronu33B101h07b1
gtacatttcatgtgctacactgaggaaaggcgtatttgctgctggagctgctctaactttgttgtcattggcgggatcagtcttctattactgggctcactctagagctgatactggtggatggcagaaacatcggaatgaaggcgttggaatgacagagcaacctcccgaatttggtaaggcctgactctattgtgc

SEQ ID NO: 2660 - DNA, 314 bp, Gossypium hirsutum
  Clone ID: uC-gsronu33B101h08b1
tcgttgacgcgtgggtaggaatcggaggcattcgggtacccatatccgaagacatttttcaacttaccgaattagggtacggtggagtcgttatggataccggcacggcggtcacaaggttcccgaccatagcttataacactttccgtgacgcttttatagagcaaacggctaacctccctcgagtttccggagtatccatattcgatacgtgttacaacttatcgagttttgtcacggatcggattccgtcagtttcgttttatttgacttttgtgccgattctgaccctacctgtaactatactttttttc

SEQ ID NO: 2661 - DNA, 227 bp, Gossypium hirsutum
  Clone ID: uC-gsronu33B101h09b1
ttcacgcgtccgggtggacttgctgacatcaaaattgacgagtatatgcgaagcttctctggagatgtcatctcaagagcctgtttcggaagtaattattgtaaaggagaagaaattttcttgaagctaagagctctacaggaggccatgtccaagaaaggtttatccactggcgtgcctggaatgagatatcttcccatcaaaagcaacagagaagcttgctaact

SEQ ID NO: 2662 - DNA, 227 bp, Gossypium hirsutum
  Clone ID: uC-gsronu33B101h10b1
tcgtccacgcgtccgcccacgcgtccggctgtctatactccatgaataagttatgtgatttgagctgcactcagcacgaaatcctgaggatcgtttttttgttgtcagtttgatattcatcaacgtgctttgaatcatttcaaaaattctagttacatctacatacaacaatggataatgtggcgtttgtttccctatcttcttttttttcttttttatctctcttt

SEQ ID NO: 2663 - DNA, 151 bp, Gossypium hirsutum
  Clone ID: uC-gsronu33B101h11b1
tcgatctccacatttacgcaacatgtcattcgatgaagaagagtccttcgaacacaccctcctcgtggtccgtgaagtcactgtctacaaaatcccgcctcgttccacctccggtggttacaaatgcggcgagtgtgttcaatcctacatg

SEQ ID NO: 2664 - DNA, 83 bp, Gossypium hirsutum
  Clone ID: uC-gsronu33B101h12b1
tcgttagatcgcgagcagcctaattgcttacaacacatttaccatggttgtttccttgccctattcttttttgcttttgctca

SEQ ID NO: 2665 - DNA, 339 bp, Gossypium hirsutum
  Clone ID: uC-gsronu33B103a01b1
tttaacttttataaaaacagaagccatcaatctctcttgctagggtttcattcaactcaccgtcgacgaaccaatatcacgcctagtggccgacggcgtgcgattaacgaccagatctttgccaacgaaggccgtaactatggaaatctggtcagcttttctcagcgccgacgcaggtaggcacggcatggcgaagccgcttatgagcttgtcgatgtggggcgtgaagcgttagggctactgatggcgcttgcggccctggctgttggctagggttggccgacagtttggttggtattttgggcctagggtattttgggtttaggtttattcggttgg

SEQ ID NO: 2666 - DNA, 272 bp, Gossypium hirsutum
  Clone ID: uC-gsronu33B103a04b1
ggccctccaaactcctctctttgccccatgagaaataggaaactatagtttttatttataccttttggatggatggtgcttgtaaagctctcttgtttttgattcatagcttgtttccttcagtaaatgccatctgttgtaaaaatactagtccacgaagtacacagactttgacattttagagttggctttacctggaaatctctttgtcttggagtctgtatctgaatttgtgtgtaagatgttatatatttataaaattttgacccgtt

SEQ ID NO: 2667 - DNA, 270 bp, Gossypium hirsutum
  Clone ID: uC-gsronu33B103a05b1
ggcccaccaaactcctctctttgccccatgagaaataggaaactatagtttttatttataccttttggatggatggtgtttgtaaagctctcttgtttttgattcatagcttgtttccttcagtaaatgccatctgttgtaaaaatactagtccacgaagtacacagactttgacattttagagttggctttacctggaaatctctttgtcttggagtttgtattgtaatttgtgtgtaagatgttatatatttataaaattttgacccg

SEQ ID NO: 2668 - DNA, 230 bp, Gossypium hirsutum
  Clone ID: uC-gsronu33B103a06b1
atctgtactcaaaagaagggaaacaacactcgaagaggtagaaatagtaaaaacatgcatatatggtattgtagggggaagacatctatcgagggaatcatacatctcagttcaaagttgtaccttgatcatgatctactgttatgagatagagaattcactagtaaaaagcatcagaatttctaacaaaaaaaaaaaaaataaaaaataataaaataaacctttaagct

SEQ ID NO: 2669 - DNA, 543 bp, Gossypium hirsutum
  Clone ID: uC-gsronu33B103a07b1
gaaaatgggaaacacatctgaattgtgctcacagctcggcgcagttctgggtatgcttggtgactgctgtcgagcaatgggagatgctgctgctgcaatcaattatttcgaggagagtgttgagttccttaccaaattgccagctgatgatcttgagatcacacatacactatctgtttcacttaacaaaattggagacctaaagtattatgatggagatcttcaagcgtcaaggtcttactacttccgatcactgggtgtccgccgtgatgttatcaaaaaccatcccggtgttgcttcacagattctggatgtagctgtttctcttgcaaaagttgcagatgtagacagaactcttggaaaagaggatgtggcggccgatggatttcaagaaggcataaaattgttagaatctttgacactgaaatccgaagaagccggtctcgagccaaggcgcctttcagtgctggcattcctcaaatctcagcttgaagagaaacagcatgaggcaactgctagctctgtatcctcataatggaaaat

SEQ ID NO: 2670 - DNA, 97 bp, Gossypium hirsutum
  Clone ID: uC-gsronu33B103a09b1
gcaaccttcatctctatgatgccatattaatcataaccttccattctatgaattctatcattgtatttatgaaacaatgtaatggaacccatcattt

SEQ ID NO: 2671 - DNA, 467 bp, Gossypium hirsutum
  Clone ID: uC-gsronu33B103a11b1
ggtgtaccgttagctcaacttgcaatcgcatggtgcgctgcaaatcccaacatatcatcggttattactggtgctacaaaggaatctcagattcaagagaacatgaaggcacttgatgtaatcccattactgactcctgctgtcatggagaagattgagaccgtttttcaaagcaagccaaagcgtccagattcttacaggtagacgccggtacctgttgcttccttagcatgtcattggcatagctgtgttttggagcagatgtgtgagcatcaatttatgtacttggtttggtgttttatagtactttgcaactttagttgtatttggcacccttatcattgtggaaagacgacttgggagatgaaatgaatttggaactggctgtgattggtggcggattgtgaatgtccgtaccacctctaattaaattatccctctctctaaccccttctcaattttttccc

SEQ ID NO: 2672 - DNA, 475 bp, Gossypium hirsutum
  Clone ID: uC-gsronu33B103b01b1
cccacttcgttcgctccccctgtctacattagtcctcttgacctgagccccaagtactctgacaagttcacaggtcttcaggaatattgcaagacgtatggtgaaaattattgtttggggcagctagttttttggtataaccagaccagtgttgatccagattccagcctgtttagagcaagtaggggttgcttatcattacctgacattggttgcttctacgccaaggttcagaagccatcaaggcatcgagtttatggcccaaagactgtcaaatttatgctgtcatggatggagaagcaagctcagagaccatggccgaaggaccgaatatggacattcaaaggtagtccgagaatctttgggagtccaatgctagatgcagttttgaacaatagttcactggacagagagatggtgcaatggttgaagcatagacctgcgaaattcaggcaatgtgggatagatgaggaca

SEQ ID NO: 2673 - DNA, 370 bp, Gossypium hirsutum
  Clone ID: uC-gsronu33B103b04b1
atcgttttttttgcctcactttctcagaaagaacaatgccttcaggctgcaattgcggatctaactgcagctgcggcgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggcctataataat

SEQ ID NO: 2674 - DNA, 417 bp, Gossypium hirsutum
  Clone ID: uC-gsronu33B103b05b1
attgtattttttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgccaaggatggatgcctgcaaggtctataattatgtctctgcctgcgtcttgcgtaatagaagctttgtttgtggtgaaaa

SEQ ID NO: 2675 - DNA, 451 bp, Gossypium hirsutum
  Clone ID: uC-gsronu33B103b07b1
cggactcgtgggtggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatctcatttgagtttcctatctctttccttgttttttgtgtttaatttgtggcccgtcgatcttgtttacttttttttcattccccatcctctatcatgatcatcatgcatggcagatgttgtttacaattgcatgccctgaaaaaatagtatatgagtgactcactgtaagtcttttttcttatattattcaaaaccagcatcagggct

SEQ ID NO: 2676 - DNA, 503 bp, Gossypium hirsutum
  Clone ID: uC-gsronu33B103b09b1
cccacttcgtccgggcattacgttgctttctcttatctcattttttgcgtctacatcatatctttcagtgcctgagccaagcgccgatcacctcttttccctgccatcaatccattccattgccttccatcctaaaacaaaacaaaaataaatggagtcttgtccttctataaaaaatatccttctcctggattccgaggggaatcgtgttgctgttaaatattactccgatgagtggcccaataacagtgctaaggaagcctttgagaagtctttatttacaaagactcaaaagaccaatgctcgaactgaagcggagatagcaatgttcgagagtcatatcattgtgtacaagtttgttcaagaccttcacttttttgttactggggctgaaaatgaaaatgagctcattctggtaactgttcttcaagggttttttgatgcagctggccttcttctaagagggactgtggacaagaaagaggcactggagaacttagatc

SEQ ID NO: 2677 - DNA, 584 bp, Gossypium hirsutum
  Clone ID: uC-gsronu33B103b10b1
gtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaaacaacttgaagacggccgtaccttggccgactacaacatccagaaggagtcaacgctccatcttgtcctttcgttgcgtggcgggatgcaaatcttcgttaagacgcttacggggaagacgatcactctcgaggtcgagagctctgacacgaccgacaa

SEQ ID NO: 2678 - DNA, 438 bp, Gossypium hirsutum
  Clone ID: uC-gsronu33B103b12b1
tccactcgtccgcccacgcgtccgcaccaagctattcagccggctatttgccaaaaaggagatgcgtatactgatggttgggcttgatgctgctggtaaaaccaccattctttacaagctgaagttgggagagattgtcactaccattcccaccatcggtttcaatgttgagaccgttgaatacaagaacatcagcttcactgtttgggatgttggtggccaggacaagatccgaccattgtggagacactatttccaaaacatgcaaggacttattttcgtggttgatagcaatgatcgtgaccgtgtggttgaagctagagatgagttgcacaggatgttgaatgaggatgagttgagggatgctgtgcttctagtatttgcaaacaagcaagatcttccaaatgctatgaatgctgctgagattaccgacaagct

SEQ ID NO: 2679 - DNA, 549 bp, Gossypium hirsutum
  Clone ID: uC-gsronu33B103c01b1
gatagcagaggaagtcggtggtgctgttgcagcagctccacttgatgcgcagattgagctcttcaatgcgctagttgaaggatgcagggaagctgttgaattaggaaatatagaacctaagggaccattattagatttctttggtgttcctgttaaggcaaatgatctgattaatcgtgtccaagaacttcagctcttagcaaaacgaataagtcgatacgaggatcccataaaacagttccgtgtgttgatgtaccttaaaccctctaattggtctaaagggtgtgggtggaatcagattgatgatgcaagattgcttctgggaatatactaccatggatttggtaattgggaaaagataagattagatgaaaggcttggcctcacaaagaagattgctcctgccgaaacttagcaccatgaaacctttctgccacgtgcacctaatttgaaggagcgtgctaatgcactcttggaaatggaacttgcagctgctggtggcaagaatgctggtgtcaaagctggtcgaaaccctcaaagaaggaaaag

SEQ ID NO: 2680 - DNA, 510 bp, Gossypium hirsutum
  Clone ID: uC-gsronu33B103c04b1
cccactcgttcgcccacgcgtccggactctgctgttcgacatgttcttctgagacagggagtactgggcatcaaggtgtcggtgcatgcctcgctcgtgaatatagaatggtttgccatgttatgcgcggagaattcagcaaagactttttcgagggttgcagggctatgctactggataaagataagaacccaaagtgggagccgtcgaaattggagcatattgctgatactacaatagacaggtatttctccaaggtgaaggatgaagattgggaagatcttaagcctccaactagatccaaattcaacttgccaccatatgtcattgcaaagctttagatgaccactgagatgatcatgttaagagtatagagcacaaagttgtaatgtctataatgaagcaaagcccattgggtctaaatatatatatatatgcatgtcactccttgatgagtattaagtaagctgtcctgtgcattttactgccgacataactttgaattcatat

SEQ ID NO: 2681 - DNA, 538 bp, Gossypium hirsutum
  Clone ID: uC-gsronu33B103c05b1
cccactcgttcgcccacgcgtccggactctgctgttcgacatgttcttctgagacagggagtactgggcatcaaggtgtcggtgcatgcctcgctcgtgaatatagaatggtttgccatgttatgcgcggagaattcagcaaagactttttcgagggttgcagggctatgctactggataaagataagaacccaaagtgggagccgtcgaaattggagcatattgctgatactacaatagacaggtatttctccaaggtgaaggatgaagattgggaagatcttaagcctccaactagatccaaattcaacttgccaccatatgtcattgcaaagctttagatgaccactgagatgatcatgttaagagtatagagcacacagctgtaatgtctataatgaagcaaagcccattgggtataaatatatatatatatgcatgtaactccttgatgagtaataagtaagcctgcctgtgcatttcactgccgacataactctgaatccatatgagaccaaagtcgattgctaaaccccag

SEQ ID NO: 2682 - DNA, 228 bp, Gossypium hirsutum
  Clone ID: uC-gsronu33B103c06b1
cccactcgttcggatcgatttcgaagccttttcaccatgagagctaagtggaagaagaagcgtatgaggaggttgaagaggaagagaagaaagatgaggcaaagatctaagtagtttaattttatcttaaagcaagcaatttgttctatgtttctttagattttctgttgtttgatggatactttactttaaaaggatttaagttatctttatcgaaaccttttgaat

SEQ ID NO: 2683 - DNA, 471 bp, Gossypium hirsutum
  Clone ID: uC-gsronu33B103c07b1
acaggtccctggtatcttgttcacaccaatctgtcctcattcattatcctttcgacccctgatattgcctgagcatgtaacagtccggattatggtgccgttcaatagcagaagtccggcttgggcatcattcgatggaaaggacaggaaactgttggctgctggggatgctcttctgtgcagcatggcaccttggcctgtgcctacagcttgtcaagttgattctactaatgactttttacgcagtatccatgacggcctccattggaatctgagaaagacgcagtcatttgatggccctcgggatcgggatctataaggtcattttccgaacttatatctagctggaatctaacttatacattccatatgtttcagtcattgtaggaaggggaaatcaaattcacaaaaactgaaatagctgcaagttcttgttatatcaccagattatggtttacccttaaaaatgtt

SEQ ID NO: 2684 - DNA, 490 bp, Gossypium hirsutum
  Clone ID: uC-gsronu33B103c11b1
cccacgcgtccgtgccgttgcccaaccagaggcacccgctactcttggtgagccaatggacatcaacacagccttgcctcttgtggtgaggaagtcccaagctcatggtgggcttgctcgtggcttacatgaagctgccaaggcaattgaaaagcacaatgcacatctttgtgttttggccgatgactgtgaccaacctgattttgttaagctggtcaaggcactctgcgctgaccataatgttaaggtgctacgtgcacctagtgcaaaagctcttggcgagtgggctggtttgtgtaagatagattctgaagggaaagcacggaaagtagttggttgctcttgcgtagttgtgaaggattacggtgaacaacacgagggtgtcgaagttgttcagcagcacatggattaagtaaagaggatggtttctttgggagaatcagagtttaattttggccattcatgatatttgcttaagtaattctgtttt

SEQ ID NO: 2685 - DNA, 588 bp, Gossypium hirsutum
  Clone ID: uC-gsronu33B103c12b1
gggatatgtacgaccatgagagtttggtcaaagcaataaagcaagttgatgtggtgatttcggttgtgggtcaaatgcagttatcagatcaagttaagatcattgctgctattaaagaagctgggaatgtcaagagatttttcccatcggaatttggaatggacgtggacaagaacaatgcggttgagccagcaaaatcgacattcgcaatcaaggctcaaatccgtcatgctgttgaggctgaagggatcccttacacttatgtgcctgctaactgctttgcaggctattttcttcctacattgtcgcagccaggagccacctctcccccaagagacaaggtggttattctaggtgatggaaatcctgaagctgttttcaaccatgaagctgacatcggaacctacaccatcaaagctgttgatgaccccagaacagcgaacaagactctattcatcaggccttccaagaacacctactcatttaacgagctcatcgccctgtgggagaagttgattggcaaaaccccttgagaaaacatatgttcctgaggaccaacttctcaacagatccaagagtctccaatcc

SEQ ID NO: 2686 - DNA, 505 bp, Gossypium hirsutum
  Clone ID: uC-gsronu33B103d01b1
gcaagtcactgttggggttaaatctccagcactgcaattcaatcagcagtcgaacctttgagctgctcgtcgagaccctatggaaatgtgacatccttttctaatcacggatacaactccgttgagatctgaacattaaactcatatagtcagctcacaagacagggtagtagcaaacattcgctgcattttttttttttttggtccgacaaggtggtcatgccggttgctctacacttgatgtttcccaggaactttggcacagttttaagagatggcctataaaaccatccctttattttttttacaggctctcccgacacccgacacaagagctagcctgtttctcgatagccatggttcccggttttaggtttccactcatgatcatcatcacaccaccaccatagctttttccgtcctgctgctacccggtgttttagctcttgttttcagtcataaaagtctggtggttttagatcaaatctcatctttggtttttttt

SEQ ID NO: 2687 - DNA, 203 bp, Gossypium hirsutum
  Clone ID: uC-gsronu33B103d02b1
gaagatctatgttcaggcggttccatcatttaccagagcttcaacggcattgggggatgtggatcacctagatcaactctgagttgcctctgggaagaggaggaagagtattattataattaaaacggcttattttcttatgctataactattaaataaattgctacccaggcattgcctggtgataaagcatggtgtgtgtt

SEQ ID NO: 2688 - DNA, 458 bp, Gossypium hirsutum
  unsure (1)..(458): unsure at all n locations
  Clone ID: uC-gsronu33B103d04b1
ctgattatgtaaaagaagggatgggagttttaggcaaagtggtggatgggattctattgctaacattcgtgtccatgtcggtggtgccagcgtgcttggacgcccaggtacttttgcctaaagcgcttttccccgatgtgctgggtcgtgtatattcatggtatacgaccacataccaagattatttgctgttggatgagcctcattttttcatggcacttatgaaattggagcttgttttagtattgccgcttgctatacttaacacttatggcttgttgacctccaagccctggntcaacaccacctgcctcatctttggttctgctcttgttacctccacgacagctatggtgggagacatgctgggatccgacaaaccatcagcaggtaaactggcgtcgatgtactcgccttttataggatttgggttcctagccatactgcgagggctgctt

SEQ ID NO: 2689 - DNA, 353 bp, Gossypium hirsutum
  Clone ID: uC-gsronu33B103d11b1
ttaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctggtcaatgtttgggagccatatgtggatgtgggctagtgaaggcattcc

SEQ ID NO: 2690 - DNA, 89 bp, Gossypium hirsutum
  Clone ID: uC-gsronu33B103e02b1
aaaattaaataaaaaaaaaaaaaaaaaaaaaaaaaaaaaaaaaaaaagggcggacagaaatagaggaaacacaaagaatacaaacgaaa

SEQ ID NO: 2691 - DNA, 367 bp, Gossypium hirsutum
  Clone ID: uC-gsronu33B103e05b1
cccactcgttcgcccacgcgtccgggaaaaaccaaaaaaatggcgaaaccccaacttttatttctattttccttttcccttctctgtctcatatctttttccgccgccgattcctccatcatagacgacttacgtctagccggttccagtttcccgtcggttcatgcaaagaagctgattagggagttgaatttgcttcctaaaggggaagccaatgtcgttgacgaacatcgggcttcgctgccggagggtcccaaactggcggagaagcggctcaagctcccaactctggaagtgcccggtggagcctccgctgaggatctgggccactacgctgggtattacaagcttcttaccctcatgatgc

SEQ ID NO: 2692 - DNA, 440 bp, Gossypium hirsutum
  Clone ID: uC-gsronu33B103e06b1
accagttcttgcctcaaccctctccgggtgaatccgacggcccataaagactccgacttatcaggccctatctttctctacttatccctctgcttattccaactcctcgctggcaagatccaattcggcgtcatccttggctggatcgtcgtctcctcgattttcctctatgtcgttttcaatatgttagcgggtcgcaacggcaacctagatcttcatacgtgtacgagcgtggttggttattgtatgttaccggtggtgatcttctctgcagcatcgctttttattccccaggggactagcgttgctaggcacgccgtggcggggattttcgttgcttgggccactagggcttgcaccaatttaatggtggcacttgctgatggaggtgaagaacatccgcggccttatatcgtacgcttgatctttcaatctacact

SEQ ID NO: 2693 - DNA, 419 bp, Gossypium hirsutum
  Clone ID: uC-gsronu33B103e09b1
cggactcgtgggcggacgcgtggggaaaaacctttctttgtttaacgcttaagattcctttaacaacaatggctccctcaatgtctactctaatggttgttctcgtcgctgtatgcgctctcatgggttccgccattgccgccgacgctccggctccgagccccacctctggtgccagctctatctcgccgccatttgtctctgtttccgtcgccgctgccgctatggctctgcttttcggatctagacttcggatctgaatgatgctatctctggtgttcagatgatgctctgtttttcttttatatatgtattttttttctttttgatttgattctgaatttggtttgcaattttagtagctgcggtagtggatctagggagtgattatattatatataatttatcagagagaggga

SEQ ID NO: 2694 - DNA, 461 bp, Gossypium hirsutum
  Clone ID: uC-gsronu33B103e10b1
cggactcgtgggcggacgcgtgggcggacgcgtgggttcttgtttgtgttttacagaagtcaggaagctctccacaaagcttctaccgaaaatgccgaagcaaattcatgagatcaaggacttccttctcactgccagaaggaaagatgcacgctctgtaaaaatcaagaagagcaaagactttgtcaagttcaaagttcgctgctcaaagtacttgtatacacactgtgtgtccgatgctgagaaggctgataagttgaagcagtctcttcctccaggtttgagtgtccaggacctgtgaaaatagggccgcttcgagtttatcatccaattactaggtgaaagctagattctgactttgcttttatcatatttcatgcctttcaaactcaaaatttactggaatggatttgcattctggctatttttatggatatgagtaaggtcgagttactttttat

SEQ ID NO: 2695 - DNA, 581 bp, Gossypium hirsutum
  unsure (1)..(581): unsure at all n locations
  Clone ID: uC-gsronu33B103e11b1
tcttttttctcttatcaattactgtcccctctcttgtttctctcatttcattcgtttaagaatgtctttcatggcggctgcaaaggtttttgcgtgtccttttgtctttgttgccctcttcagcatggttgcttctgatcctgatcttctccaagatctctgcgtagctaataaagctgctgggataaaggttaatggatttccatgcaaggacgaagccaatgttaccgaagctgattttttctttagcggattagccaatccaggagtcatcaacaactcggttggatcagtggcaacaggagccaatgtcgagaaaatcccagggctcaacaccctcggcgtctcgcttgctcggatcgactatgcaccaggtggccttaaccctcctcacactcacccacgagccaccgagatcatcttcgttctcgacggtgaattagacgtggggttcatcactacatcaaacangttggtctccaaatcagtcaagaaaggcgacgttttcgtgttcccaaggggattggttcatttccagaagaacaatggcgacaaatcggcatccgtatagcaggatttac

SEQ ID NO: 2696 - DNA, 495 bp, Gossypium hirsutum
  Clone ID: uC-gsronu33B103e12b1
tccactcgtccgtttgcaaacaggcttcctcatatttacaaggatccagacacatatgatcctgatagattcagtgttgggagggaagaagacaaggcagcaggggctttctcgtatatttcctttggaggaggcaggcatggttgccttggtgaaccgtttgcttaccttcagataaaggctatatggagccatttgctgaggaacttcgagtttgagcttgtgtcacctttccctgagattgactggaatgctatggtggttggcgtgaaagggaaggtgatggttcgttacaagcggcgacagctctctgttgaatagcaaacataatgtacctgggttcgttagcagttttaatttatcttttttaaaatgttggcctattttgatctgttttggaacttttgattttatttgtgagcattctctggattttattttctagttaatataatattcatgattcggtcatgagcacttcctcttcttcctttt

SEQ ID NO: 2697 - DNA, 292 bp, Gossypium hirsutum
  Clone ID: uC-gsronu33B103f05b1
gagaaactttctgctagggtttcttttccatgccgccgccgccaccgctcaagccattccacggcctccgacgacgccccgacctccgatcgcgacggaggtggaccgattcgacggtttcggctaaagattcagccaactggggatgtacgtgggacacgtacgtgcgcaaagggtggtggtgcagggctgatgtgcggcggctagggttgaaggttgtatgctgctagggttgctgctggaatttagttagcgggctgtttagttcgggctaggcgttgggccattctag

SEQ ID NO: 2698 - DNA, 516 bp, Gossypium hirsutum
  Clone ID: uC-gsronu33B103f06b1
gttcatcaccactgctgaacgggaaattgtccgtgacatgaaggagaagcttgcctatgttgccctggactatgagcaggaactggagactgccaagagcagctcttctgttgagaagaactatgagttgcctgatggacaagtaattactattggagctgagagattccgttgtccagaagtcctcttccagccatctctcattggaatggaagctgctggaatccatgaaactacctacaactctatcatgaagtgtgatgtggatatcaggaaggatctctatggtaacattgtgctcagtggtggttcaactatgttccctggtattgcagaccgtatgagcaaggagatcactgctcttgctccaagcagcatgaagatcaaggttgttgcacccccagagagaaagtacagtgtctggattggaggatctatcttggcatcactcagcaccttccagcagatgtggatttccagggtgagtatgatgagtcggtccatccattgtcacag

SEQ ID NO: 2699 - DNA, 555 bp, Gossypium hirsutum
  Clone ID: uC-gsronu33B103f07b1
ggttgttgcagcgtttagttcccggggacccaatatggtgacgccacagatcttgaaaccggacgtgattggacctggtgtcaacatattagctgcttggtcagagggtattggtcccactggtttggccaaggactcgaggaagaccatgttcaacatcatgtcaggtacatcaatgtcatgcccacacatcagtgggctagcagcgttgatcaaggccgctcatccagaatggagcccgagtgcaatcaaatcggctttaatgaccactgcctacacccaagacaacaccaactcgactctcagggatgctgcggacggatcgttgtcaaacccatgggcacatggggctggccatgtcgatccccaaaaagctctttcaccaggcctaatatacgacatctcgaccgacgaatacatcacattcttgtgctcactcggctacaccgtcgaccatgtcaagaccatagtgaaacgccccaacgttacatgttcgaagaaattcaaggacccctgtgaactcaattacccattcgtttcagtcatgtttggggg

SEQ ID NO: 2700 - DNA, 79 bp, Gossypium hirsutum
  Clone ID: uC-gsronu33B103f09b1
tccactcgtccgaaaaaaaaaaaaaaaaaaaaaaaaaaagaaaaaaaaaaaaaacaaaaaaaaaaaactaaaatgaagg

SEQ ID NO: 2701 - DNA, 527 bp, Gossypium hirsutum
  unsure (1)..(527): unsure at all n locations
  Clone ID: uC-gsronu33B103f10b1
ctcattttcagatctcatctccttccctaaggttaaccaatggcaacagttcgaaatctgaaaatcaagacatccacttgcaaacgaattcttaaagagcttcactcatatgagaaggaagttgaaagagaagctgctaaaacagctgacatgaaagagaaaggagctgacccttatgacctaaagcaacaggaaaatgtgctggctgaatcaaggatgatggtccctgattgtcacaagcggctagaggcttcattagctgaccttaaagcaactttggctgaattggaggaagcgaatgagaaggaaggccctgaattcgaagatgctcgcagcaccatcatcgaagttgaaaagttgtttcaaacaacagaggcttagtgacagcttcttttaagtggctgtagttaccataaaaaaaattgacatagatggttataagttcgtatgtttctatttctagctacaancctgtaagatgtcttttggaacttggaatcttgcctgttatctgaaactgattctgc

SEQ ID NO: 2702 - DNA, 574 bp, Gossypium hirsutum
  Clone ID: uC-gsronu33B103f12b1
cccactcgtccgcccacgcgtccgccgacgtggcagcttcgccggcagctaggaccggagctgggttcgggtggaccgccaatggtctgcccttggtccacgggagtgtcgtcggagaacctatgggccggtctcagtgggattcctccctcctcgcttgtcttggccgtaacgatgagttttgcagcagtgacgttgaagtttgtctactaggaagcgtggccccttgtgtgctgtacggaagcaatgttgaaagacttggatctgcacctgggacctttgcaaatcattgcttgccttattctggtctttacctgattggaaattccttttttggctggaattgtcttgctccatggttttcataccctacccgaactgcaattcggcgcaagtttaatctggagggtacctgtgaggcacttaacaggtcaggtggatgctgtttggaagatgaagtgcaacgtgaacagtgcgagtcccgctgtgactttgcaacacatgttttctgccatgcatgtgctctttgcaggaaggccgtgagcttcgtcgaaggtgcctcaccagggttcat

SEQ ID NO: 2703 - DNA, 350 bp, Gossypium hirsutum
  Clone ID: uC-gsronu33B103g01b1
gtgatgttttttatgcgtcgagcaacccgagggaagcgtttttcaattaccgagaccttgacgtcggtagcaacgaaagcggcgagacggattttgaggttgcgaaggaatacggggcagagtatttcaggaacaatttcatgaggctggcgggtgtgaaagccaagatagaccctgagaatttcttcaagaacgaacaaagcataccgcctttgtcaacgccgccatctgattaaaacaatatatgaaatatattctcaattatctttgtctactttttagttcttaatatcgagtgtttctttgatgtacaatagtgattattcttaagaccatttatgaactttaat

SEQ ID NO: 2704 - DNA, 270 bp, Gossypium hirsutum
  Clone ID: uC-gsronu33B103g03b1
atatctcacatgagtaactgtacagtgggtgagaatttcattccatcaaggtttgcctagaggctagaaaaattcagtcttgaagggtcgttagggattgtgggacataggaatggagatttgcttattaaaaagaaaaagaaaaaaaaagaaagggtcctactgtgcgtgctctgagtctgatgtatagtgtagctgttgtacatattttttttctaaacgttaacctgccaaagaaatgttgctcaaccaaaaaaaaacttatgtggt

SEQ ID NO: 2705 - DNA, 485 bp, Gossypium hirsutum
  Clone ID: uC-gsronu33B103g04b1
cccacgcgttcggaagaactgttgaaaacattttggagctagctgggttcaagaatgtcaaatctaaggttattggctcaaggaaccctcacaacaccgtcaaggctgtttttaaagccctcaatgcagttgaaacaccaaaagacattcaggagaagtttgggagaacggttgttgagaaacacttgctgcaatagccccccccccccccaattcataccctgtattttggatcagataaattgaaaagaaaaaccccttcaaagttttgtcattgtttgatgttttgccatgtatttggtttcatagcccagcacccatttcaaccatttttttttcttttgaaataattcggggctctggttttgtgcctaaatattttagataatttttttttctttttctgaacttggttttctcctcttttttttgttcttttcttttaagtccaattagtgctttggaaaaggtcttttagccttaat

SEQ ID NO: 2706 - DNA, 485 bp, Gossypium hirsutum
  Clone ID: uC-gsronu33B103g05b1
cccacgcgttcggaagaactgttgaaaacattttggagttagctgggttcaagaatgtcaaatctaaggttattggctcaaggaaccctcacaacaccgtcaaggctgtttttaaagccctcaatgcagttgaaacaccaaaagacattcaggagaagtttgggagaacggttgttgagaaacacttgctgcaatagccccccccccccccaattcataccctgtattttggatcagataaattgaaaagaaaaaccccttcaaagttttgtcattgtttgatgctttgccatgtatttggtttcatagcccagcacccatttcaaccatttttttttcttttgaaataattcggggctctggttttgtgcctaaatattttagataatttttttttctttttctgaacttggttttctcctcttttttttgttcttttcttttaagtccaattagtgctttggaaaaggtcttttagccttaaa

SEQ ID NO: 2707 - DNA, 242 bp, Gossypium hirsutum
  Clone ID: uC-gsronu33B103g06b1
gaatgttattaactttcctttgattttgtataccaagataaagctaaggagatacatttttatcaaacaacacgaagtataaataaataaatatggccataaaaatattaaagttgtctcatgcatgcaaatatgcttccatgatttccattgataatttttcctgttttctctagatttagtgctcttgttttttgttttttttttacagtaatacgcaactagaaaggttttaatacagt

SEQ ID NO: 2708 - DNA, 534 bp, Gossypium hirsutum
  Clone ID: uC-gsronu33B103g09b1
gggattgcacagcattggctgtcttttctggctgttagctaggatggttcttcagatgcgtggtacaattgctcctggacagaagtgggatgtgatggtggatctatttttctacagggagcctgaggaagctaaacaacaggaagaggaggaagcagttgctgctcctgattatggactccctgctgcagattttggaatgagtgctttaggaactgaccaatggccctcccaaatgggtgatcagtggtcagctgatgtggttcagccaccaatttcgggtgtccctgcaattaactggggtgatcaagttgctgttagcgctgatgtttgggatcctgcaagtgctccaccacaaatccctggccctggaatcgatgtatctgctcctgctcccactggctgggagtgaggttttcttatttttgcaaatgtttttcctattgaaaaaaatttggtattgtgatgggatctgtgattttgacacgggttagtttgtagtttccatagacttgaatgacttgctagagattt

SEQ ID NO: 2709 - DNA, 584 bp, Gossypium hirsutum
  unsure (1)..(584): unsure at all n locations
  Clone ID: uC-gsronu33B103g12b1
cccacgcgtccgcacaaaggaacagttccatcgtcatcttatgttggaggcagaaagaagacaattgaggccaattattgagaataagtcgcgaataattcttgttcatacaagctccggatataagcatagtttgagagaagtcttggatgccccaaatgttatgagcatgataaaagacaccaaagcagcgcaagaggtccgagcactcaaggatttcttcaacatgctttcaaatgatccggcacgtgcatgctacggaccaaaacatgtggagattgcccatgagcgaatggcagttcaaacacttcttattaccgacgatctcttcaggaattcggacgtaattacgaggcaaaagtatgtcagtttggtgaactccgttaagaattcggggggcactgctcacattttttcgtctatgcacgtatcangggaacatctggcacagctgaccggcattgcggcaatccttcgtttccctcttccggatctggaagacatcgaaatgtagggtaccattttctgcatatgttcgtagttcccgcggtcgagattttatcctgtactcggattatttcccc

SEQ ID NO: 2710 - DNA, 350 bp, Gossypium hirsutum
  Clone ID: uC-gsronu33B103h02b1
ggcggttactaccttctctccttccttctgcactccctcggtcaattcttcctccagagcccacaaaactttaaccaaccctaatctaggctttttggcctcagtttcgagatccttgaggtctctcaaagcaaccaggctgactactgataatgcttgtggctcagctatggcctctcgtatggtctccgttcctgccgtccagacacacatatctctcgattttgagacctttgttttcaagaaggagaaagtctccctcgctggtcaggacgagtacattgtgagaggaggaagagacttgttcaagttgctgcctgacgctttcaaagggataaagcagattggcg

SEQ ID NO: 2711 - DNA, 379 bp, Gossypium hirsutum
  Clone ID: uC-gsronu33B103h04b1
cccactcgttcgggcaacttcaataatatatagattcccattctttcatgtccctaaatgagaaagagccttgcgagtttccgtcacaaacgcccgcccaaccccagcccaacccaccccgtgtcgccaagaaacgcacccgccaagacaaccactccccgtttcgcggggtacgtaagaggaggtgggggcgttacgtctccgagatacggttaccgggtcaaaagacacggatatggctggggtcgtttgggtcaccggagatggcagctcgggcatatgactcggcagctttcttcttgaaaggcgactctgctatcctcaacttcccggagttagtggggtcacttccccggccagagtcttgctcgaggaggga

SEQ ID NO: 2712 - DNA, 456 bp, Gossypium hirsutum
  Clone ID: uC-gsronu33B103h05b1
cccacttcgttcgggcaacttcaataatatatagattcccattctttcatgtccctaaatgagaaagagccttgcgagtttccgtcacaaacgcccgcccaaccccagcccaacccaccccgtgtcgccaagaaacgcacccgccaagacaaccactccccgtttcgcggggtacgtaagaggaggtgggggcgttacgtctccgagatacggttaccgggtcaaaagacacggatatggctggggtcgtttgggtcaccggagatggcagctcgggcatatgactcggcagctttcttcttgaaaggcgactctgctatcctcaacttcccggagttagtggggtcacttccctggccagagtcttgctcgaggagggatatacaatccgcggcggccaatgcggctttgcaggaatcggtggggcagggtaaaagatgaggagggtcccgaaag

SEQ ID NO: 2713 - DNA, 429 bp, Gossypium hirsutum
  Clone ID: uC-gsronu33B103h06b1
cccactcgttcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaggggggggccgttttaagggtcccaggtttacttccgggggcttggaactctttattttttttttggggcacctaaattacattttatgggccggggttttaaaagggtggtatgggaaaaaccttgggttacccaaattaaatgccttggaaaaaattccctttttgctggtggggattattgaaaaagggcccccccctatgcctttcccaaaaatttgccccccctatagggaaatgggaccccccctttaatgggcttattaagggggtgggttggggggttaaccc

SEQ ID NO: 2714 - DNA, 469 bp, Gossypium hirsutum
  Clone ID: uC-gsronu33B103h09b1
ttactattgtatatatcttcggtgagtgtgtttagtctctttttctctttgttcctgtttgatgggctgttgatgtctttggcggttggtgagaatccaagtcccaaaaccatggggtttgataaggaggggagtgctactgatagtgaagcttcagagacaaaaacaccatcaaagattcctccaaacgaagatgccgttgacggacatcatccccctggaatcaatagaaaagcaagcgagagttctctttgtccaactgaagacgaagacgatgatgatgaagaagagagggagattgagttaggcccgaagtgcacccttaaagaacaactcgaaaaagataaggatgatgagagtttgaggaggtggaagcaacaacttcttgggactgtggatttcgagtcccgtggagaaaagctagaacctgcagtgaagatattgagccttgcgatcaaatcacatggta

SEQ ID NO: 2715 - DNA, 355 bp, Gossypium hirsutum
  Clone ID: uC-gsronu33B103h10b1
cccattcgtccgaagaaaaaccagaacctaaaccaccaaaaccaccagtttatgtaccaccaaagaaagagaaaccaggacccaagccaccagtttatgaacatccaaagaaaccaccgtatggtcactatccaggacaccctccattggggaagcctcaatagagagatcccatcggctagccatcccaagaactgagctactatggctatatagataaattagtatctatacaataagagtttcttcctactcatgttctattctcttgtatgtcatgtagtaatgttttcttttacctgcgagaatgccgatggcagtacctattggaatgcttattttatgtcttcttgtt

SEQ ID NO: 2716 - DNA, 374 bp, Gossypium hirsutum
  Clone ID: uC-gsronu33B103h11b1
attgttgccttttgttagttttctttattatttttcccgatagcgaataagcggcggacctctaaatgaagggcaggttcatatagctgaccgtgaagacaataacacgtcgttcaggtataatctccgagttggtgagaggcatacatttgtgtttgatttttttgttccacggatttagtcacaggactggattctgtgaagtgctgtagcattgattggtttgaaaatgctatcctacactagtggcatggtcttatagatacttaataattttccttcttaatatgggtgcataacttttgcagcagtcaagagcatatatgctttggttacaattatacaactaaatgaaattgtaattagttgatgtt

SEQ ID NO: 2717 - DNA, 512 bp, Gossypium hirsutum
  Clone ID: uC-gsronu33B104a01b1
cccacgcgtccggagccagccgatctcaacaacaggaacatgattgttgtagatgttggtggtggaactggtttcactactttgggtatcgttaagcatgtggatgctaagaatgttacaattctcgaccaatctccgcaccagcttgccaaggctaagcaaaaggagcctttgaaggagtgcaggataattgaaggtgatgcagaagatctccccttccgtactgattatgccgacagatatgtgtctgctggcagcatagagtactggccagacccacaacggggcatcaaggaagcatatagggtattgaaactaggaggaaaagcttgtctgattggtcctgtgtacccgacattctggttgtcatgcttctttgcggatgtttggatgcttttccctaaggaggaagagtacattgactggtttgaaaaggctggatttaaggatgtccaactcaaaaggattggccctaagtggtatcgtggagttcgcagacatggtttgatcat

SEQ ID NO: 2718 - DNA, 282 bp, Gossypium hirsutum
  Clone ID: uC-gsronu33B104a04b1
atttcctcaaggaatgagggttgatgtataggcattttatattaatacaattttgatacgtatatttgtgccgtattgtgttttagttattttataatttctctccttgaattttgcatcggtttctattaaatgatagtggacaataattagtaaatatacatttttatacttgaatttcgcttcatggttcatgttagtacttaaggtttttttttgtccaattaggtatttcaacttgacttttaaggttcaattttgtaccctaagtatcttttgggt

SEQ ID NO: 2719 - DNA, 427 bp, Gossypium hirsutum
  Clone ID: uC-gsronu33B104a05b1
cccacgcgtccgaagaaaatggggtttcgtgagttatgtgtggggttaatgatgatgatgattctcctgaaaccaattagcggcagagacgccgtcctagtacttaggagcaacgccacttaccagtgcaatggcctactcggcggctgcgttatccgggaagaattggagtcggagctggatgtgttgatgatagattctaccgttatcagaatcctcaagcacggtagcggtcacatatctatcaacacgtttataaagggtaagccagcagtaaatcaaaatgactgcggtcctagttatgggaattgtatttcaaaacccaagccaaatggacataattctaattgtaacggtaatagcccttattgtaaacaatgatgtttatcaacctatctatgacaataaacgccctattcattaattt

SEQ ID NO: 2720 - DNA, 511 bp, Gossypium hirsutum
  Clone ID: uC-gsronu33B104a06b1
cccacgcgtccgcccacgcgtccggagctttgcaagatgatccaacgttggcagcagctttggttaggatgcatttccatgattgcttcattgagggatgtgatggctccattctgattgactcgaccaaggataacacagcagaaaaagactcacctggaaacttgagcttgcgaggctatgaagttattgatgacgcaaaggagcagctggaagatcagtgccctggcattgtctcctgtgctgatattgttgcaatggctgccagagatgccattttctggtcagagggacctgtgtatgatataccaaaaggaagaaaagatggaaggaggtccaagatagaagacaccataaacctgccattccccaccttcaacacctcagagctcatcagcgccttcggcaagcgaggtttcactgctcaagaaatggttgctttatctggggcacatacgttaggagtggcaagggtgtcgtccttcaaaacagattgagtaacgcagatgct

SEQ ID NO: 2721 - DNA, 442 bp, Gossypium hirsutum
  Clone ID: uC-gsronu33B104a08b1
cccacgcgtccgggttaccataatctcactggcttcccttggtggataactattgtaacttccaccatggctatgagatttgcattgtttcccgtagtagttattcatcttcaaaagctgaaaaagattggagagttagctcctaaatgtatgtttcttttatcattatttaaagtcataacatcgcttgcttggagtatgaattagtcaagaactcaagatagtagggttcggctttatgtatgccgatcttgcattgctcgagtaattaatctagccgaggtctggtttttttgtattggacctagtggcttgtgttgtgagttagatatggtttatacttttccttcaacatcttctaatattatacacatacttagtaaaatataaaaattgttttcataattatacactttatttgatttgagtttaaatttattat

SEQ ID NO: 2722 - DNA, 506 bp, Gossypium hirsutum
  Clone ID: uC-gsronu33B104a10b1
ttctcgcgtccgcccacgcgtccgaaaaaataaaataaataaaaaaaaaaaaaaaaaaaaaaaaaaaaaaaaaataaaaaaaaaaatatattaaaaaaaaatatttaaatatgggggcggccgttttaggggatcggggtttccttttgggggcttccggtttcttaccttttttttggggtcccttaatttttttttcgtggccgttgttttccttcgttggcctgggtatacccctggggtgcccggatttattcgttttggtacactttttcttttttttggttgcattctttttttagaggttggctccttttgcctttgccccttttgttcgctttttttggcatttgggcccccccttgtgccgggggtttacgccctgtgggggggtttttttcccgcggtgtgttcgtttctcttgccggggtcctggcccccgttcctgggttttatcccttctttttttgttatgttccctgtttttccgcctttgtttttttttt

SEQ ID NO: 2723 - DNA, 491 bp, Gossypium hirsutum
  Clone ID: uC-gsronu33B104a11b1
gtgttttaccttaaaatgaagggtgattatcataggtatcttgctgagttcaagactgctgctgagaggaaggaagctgctgagagcactttgttggcttacaagtctgcacaggatattgctctcggtgacctagcgccaactcatccaattaggctgggacttgctcttaacttctctgttttctactatgaaattcttaactcacctgatcgtgcttgcaatcttgcaaaacaggcatttgatgaggctatttctgagttggatacattgggtgaggaatcctacaaggatagtacattgatcatgcaacttcttcgggacaacctaaccctttggacatctgatatcacggatgaagctggagacgagatcaaggaagcttccaaacccgagtcaggagagggacagcagtgatgagttaagttcatatgatatgtactctgcaatttatgttgcaggttgtacttttacgtacatgcaacgtgggc

SEQ ID NO: 2724 - DNA, 537 bp, Gossypium hirsutum
  Clone ID: uC-gsronu33B104b01b1
cattacctaaaaaaacttcatcgacggccgctcaaactccgcccaaacaacctctctggccaccgtcatggaaaacacagacgaactcaagagggtgttcgatcaattcgacgccaacaaagacgggcaaatctctattacggagctccgcgacgtattgaaggcaatgggatccaactactcagaggaagagttcaagcgtgtcatggaagacatcgacagcgatcaagacggttacatcaacttctccgaattctccactttctggtccacttcttccgacgccgttaaagccgcttcggagttgcgcgaggccttcgatttgtacgatcagaacaagaacggcctgatctcggcaaccgagttgcaccaggtcttgaatcggctggggatggcgtgttcagccgatgattgtgtcgggatgatcaagtcagtcgattcggacggcgacgggcacgttaatttcgaggagtttcggaagatgatgaatgcttcttcgatttctggcaatggcgacggatctaagccgtaggatat

SEQ ID NO: 2725 - DNA, 451 bp, Gossypium hirsutum
  Clone ID: uC-gsronu33B104b02b1
cccacgcgtccgactttatcagcatattcgcagactttcatctccccgactcagtgtgtcactgttggtctcctcgttctcatgtttggtttgctcgtcagggaaggcctcatctctctctaatcttctttttttcttccatggaattgagaatcccagatttgcagtttgacttgtttcaatcttatattatgatgttcttctttagcaagactgagatttatatatatatatacgtatatatatgttgtaattctgtatttcctgcttaattactccgtgatctacttatgctgtttatttatacatattataagatgaaacatgcttgaattcatggtagtttttcatttagtaaatgaaaaacatatcttggtaaaattaccatgaaggaccttgtactacaaattagtcctcgtatgttagattaaagaacgatttgatccttttt

SEQ ID NO: 2726 - DNA, 520 bp, Gossypium hirsutum
  Clone ID: uC-gsronu33B104b05b1
gttctggatgtggtaattggggtagtcctactgatggaattgctccggaggccgaagaaaatgtccctgagaatgaaaagaatgttggcattgagaagcagtctggagaggaagatgccatggatgctggcaaggagaatgctgcaaatgaagctgaggagaaagagccagaaaacaaggagatgactctggaagaatatgagaagattgttgaggagaagaggaaagctttgcttgcccttaagactgaagaaagaaaagttgataccaaagagtttgagtccatgcaacaactttcaagtaagaagagcaacgatgacatttttatcaaactgggttctgaaaaggacaagcgcaaggatgctgatgaagaagaaagagtcaaaaagtctgttagcatcaatgagtttctgaagccagctgaaggcgagaggtactacggacccgggcgtggtcgaggccgtggccgtggtgctagaggctgatttggtggccattacagttgcagtgtgaaagctcc

SEQ ID NO: 2727 - DNA, 489 bp, Gossypium hirsutum
  Clone ID: uC-gsronu33B104b06b1
gaagaactgatccctggctttaagttctctcgatgcagttacctccagagcctcctccgtccctccgttatcagtgaactagagttagcgagacatggtttgaagttgttgaagaggaatccatcatcgtttacgccttgtttggatgggcgatatcttttgttagggcctactaaagtgcttaatcatagggagatctccaagttctccagacgagatgccgatgcttatccgaaatatgagagtcaattagagagattctgtacactcatggatccacttttggattcatcgcctcctgaatctttgcaaggtatttcatctctccaagagcgtctcaagaataaagtacacaactcggtattttggactcgtttgctgcaccaggctgcttccttggggcagaaagacatggcggattttatggatcttttattgtccccagctttccaggttttgaataactggtttgagcttttgtttgcttta

SEQ ID NO: 2728 - DNA, 365 bp, Gossypium hirsutum
  Clone ID: uC-gsronu33B104b07b1
cccacgcgtccggtcttccccagctttggagagcgatacttgtcttccgtgctgttcgagtccgtgaaacgggaagcagagagtatggtgtttgagccttgagatgaaacatggagaaggtaacctattgatcaagcaacattaccaactttccccattgatggttcttgttttcttctagggttatataaaaaaaaaagaatgtgtttggacatggtgttgaaccctgtttgttgctgttcactgtatttcttttcaaagttttaacacatattaataaatatgttacattagactcaaaaacaaaatattataattatatctcatcatatttaaaaattaattttatatctcaataaaatttg

SEQ ID NO: 2729 - DNA, 430 bp, Gossypium hirsutum
  Clone ID: uC-gsronu33B104b08b1
ccggcactcaacaacatggttgctgccgctaagttgctccgaacccaacttgctagtgccaagtgaaagagggctttatgaaagattggaaatgtccatgaatgattaagaaaaatctctcaattgtttcaattactttgttttcttgatgaaatatttgttagcaaataatatggccttcaaggccaattgattttctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactctaatattttttaaaataaaaaaatttcactgcctttcatataacaaaataattactgggggggggcctttaaaaaaaatcatttttcgccttgcttcacatccccttattggcttttctttggggcccc

SEQ ID NO: 2730 - DNA, 513 bp, Gossypium hirsutum
  Clone ID: uC-gsronu33B104b09b1
cttcactccacatttcacactctttttcaactttctcttcttctctttgttttaaagaggggctggagttttagccaaagaaaactccatggctaaacttgttgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagacccttttttttttacattattatccctataaatttcctatttgaaattcaagtcatttaagcataaggttgcactgtaatactaacta

SEQ ID NO: 2731 - DNA, 558 bp, Gossypium hirsutum
  unsure (1)..(558): unsure at all n locations
  Clone ID: uC-gsronu33B104b10b1
acttatgaagcggcgcttgataaagggttgactatttttgcgccgtccgatgaagcttttaaagccgacggtgtacctgatctgagtaagttgaccaatgccgatcaagtttcgctgttagaataccatgcctcgccggattataaaccaaaggggactttaaagacgacgaaagatccgattactacattggctactagaggtgccgggaagttcgatttgacggtcaccgccgccggtgattccgtcacgcttcatactggaatcagtccatctagagtcgctgaagcagtttttgactccccaccggtcgtgatattcaccgtcgacaatattttgttaccctctgagttgttcggaaagtcaccgtcgccagcacctgctcctgaaccagtttctttacctttaccgacaccttctccattatccgaagcaccatcgccattagccgcttcacccccagctccaccaaccgacactcncngcggatctncagctgatttgccgcttgttcgtcggagaacagcaccttcgataatgctgccggtcacgtgagtc

SEQ ID NO: 2732 - DNA, 520 bp, Gossypium hirsutum
  Clone ID: uC-gsronu33B104c01b1
cccactcgtccgattttccgggaaaacatacaacgaaaaagaaaatttcgaagagagagagaaaaaatgtttgcatacgatcgcgtaagccactcgagtgccaacaaggcggatgagatagatctagaatcaggggagactttgtacccgggactcagctacggcgagaaccaactccggtggggttttatccgcaaggtttacggcatcttggcagcgcagttggttctaaccaccgtggtatccgccttcgtggttctttcggctccggtcaacgagctccttcgtggaaattctggcctcttgctcttcctctgtttaatccccttcgtcttgttgtggcccttgcatgtctatcaccaaaagcaccctgtgaacttggttatcctcagcctcttcaccgtgtcattgagtctcacagttggtgtgagctgtgcaataccgatggaagaatcgtgcttgaagcgcttattttgacagctgctgtgctgcatctcttactgctacactttctggcatc

SEQ ID NO: 2733 - DNA, 514 bp, Gossypium hirsutum
  Clone ID: uC-gsronu33B104c03b1
cccacgcgtccgatagaaagtatagatagattactatgtatcgactgaaccaatgactattcatgattccataattgaatcaatgctccaaactagaggaatgttatggtaaaacttcgtttgaaacgatgtggtagaaagcaacgtgcgacttgaaggacatgatcagctgtggatgtcaaaacccaccactttccgttatgtagaaatgaaggtgctttttgctcgacatcctttgttctattataatccgtctttttgttgggttgtaatgtaaatagtacaggatggagctcgaagagaaacatccatttttcaggggcaaggatctagggttagttaatggaaatcaataagttggaacaacttcgtaagtctatttgtgatatagaaatcgaaaggatccgattcaaactattttcaaatcaaaaagaaaagttgttggaattggtaaaactctttcgatcaaaagtgtattatgcgggaattaatccgttatatgattctttgatag

SEQ ID NO: 2734 - DNA, 307 bp, Gossypium hirsutum
  Clone ID: uC-gsronu33B104c04b1
gtctaattattgggtatgatgtttgagaggagtgtgcagctttcttcactataaaaatggacttacacattgtaggatattcccgcatgggacctaagagagagcttaagtttgtttttgtatattctatgggaaaagaagagcagtgtcgaggattcgcacaacagtgcagatggtttcaggtcatctacatgtaaactgatggctgatgctgggattaatttcatttctagctatactactctttaattatgatcaaagcagattgtcctttcagcaatgtttcggctgctgtaccacttaaata

SEQ ID NO: 2735 - DNA, 282 bp, Gossypium hirsutum
  Clone ID: uC-gsronu33B104c05b1
atttaaaatttcagcaaaaactagaagtaaaggaaaaagcacatcggctctttgctacgcttcgccagcttcgagtatgcatcgccggcgatttagctgaagagatgaatttgagccatgcctcaccccacccagtgcaagatctaccaaccacggacggaggcctccgcctaggcggcggccacaacaccacctaggtgcctacagcgcggctgacggatattcatggcacgcctgcaacggcaccaggtcccccgctgcggccctcccagttcgtctctc

SEQ ID NO: 2736 - DNA, 502 bp, Gossypium hirsutum
  Clone ID: uC-gsronu33B104c06b1
ttttttttttttttttgagaaagagagataattgtgcttattaacaacaaatacacggcattataattttgaaggcccactatgtaagagtaaatgttcaacttaacagttcatacatacttgatctctatccaaaagaaactcgagcttctaaattcaagatacgctatttcaggcctcctactagcttatgaacttattttaaagcaccaaacaagacttcatttgcaatcttggctcccctttcttttgccatgtaaagccctatatggtgcatcaattcctgagggtgaggcagagctccttttgtgttcgtggcgatgtgaagaggaacatcaaaggttgcgcaggcacgcgaatacacgataacatccttgagcggagccagaaatcctcgattcctcactgataatgtcgaacacacgaaatccagcacacatatatctgtgcacacccctactaccaatatagcttcaatgtgaatggttggacacccaacacc

SEQ ID NO: 2737 - DNA, 542 bp, Gossypium hirsutum
  Clone ID: uC-gsronu33B104c08b1
cttcttcatctctttcctttaatcacgaaaaagaccatgggagtttccaataacataacagcagttctcaacatagttgctctcctctgttccatccccatcatcgccgccggcatatggttagaccaaaagcccgacaacgcctgtgtccacctcatccggtggccggtcatcctcctcggcttcctcatcctccttgtctctctcgccggcttcgtcggcgcttaccgttacaaagaaaccctccttgctttctacctctgttgcatggccatcctcattgccctcctcctaattttgcttatcttcgctttcgtcgtcaccaggccggacggcagctatgacgtgcccggaaaaggttataaagagtacaggctcgatgggtactcggcttggcttcgagaacatgtggttgataacaagagttggagaaaaatcaaggcttgcttggctgataccggtgtttgtcctaagcttactcaaaaatttattaccgccgatcagttctttgctgctcatatctctcctcttcagttaggatg

SEQ ID NO: 2738 - DNA, 360 bp, Gossypium hirsutum
  Clone ID: uC-gsronu33B104c09b1
cccacgcgtccgcccacgcgtccgcccacgcgtccgattccttctaatgtcttactctgcggtaaagtagttgggcgccatccttagccagccggtatgcccctagtggctattgtctgttaccagtcatcagagtttgactgctgataaaatagattgagagaaagaaattggattgaaatgtttggcctttattcatttgtatatcttagaaagcaatagactaaaattatctattctgatagttattactttattactcttcaattcgtgttctgcaaacagttaaaattatgaggttttgtaaaattaatcattttcttttaagtattaggtgtgcaattttatatatattatttt

SEQ ID NO: 2739 - DNA, 525 bp, Gossypium hirsutum
  unsure (1)..(525): unsure at all n locations
  Clone ID: uC-gsronu33B104c12b1
cccacgcgtccgtcgagttatccctcactttcctcaccaaaaaatatccaaacaacgaccaccgtccactgccgccgaagaggagagagccctttaaataaaaaaatggacacaattctccataccgaacctctatctctcactcgcttacgcgccacttcgaattccagcgcttccattcaccatatgccttgccagctcatcttccgtcctttccaccgcctctcctttcctttatccaccgtcaacgctggctccagttctcgcaggtcatccgcttttgttgtcgccgctagcggcactctcaccgccaattccgtttcgccgagaggtggagtatatacagctgcngatttcatgacgggaaaagaggatttgcatgttgtaaagccaacaacaactgttgatgaagcactggaagctcttgttgaacacagaatcaccggttttcctgttatcgatgatgattggaaattggttggacttgtctctgattatgacttgctagcattggactccatatct

SEQ ID NO: 2740 - DNA, 293 bp, Gossypium hirsutum
  Clone ID: uC-gsronu33B104d02b1
gcgccttcgccgctcttgtcttctcttgtatgggagctgcatatgggaccgctaagagcggtgtcggtgtggcatctatgggtgtgatgaggccagaattggtgatgaaatcgattgtacccgttgttatggctggtgtcttgggtatttacgggttgattattgctgtcattattagtaccgggatcaatcctaaggcaaaattcgattaccttttcgatggttacgcccatctttcatctggtcttgcttgtggccttgccggtctttctgctggaatggctattggaatt

SEQ ID NO: 2741 - DNA, 334 bp, Gossypium hirsutum
  Clone ID: uC-gsronu33B104d03b1
cccacgcgtccgcttattttcccttttcctcttcaatttttctcaatggatgatcttcccccatctcttgtcgttgatatcctcagtcgtctcactgattctgccgacgttgctcggcgccgagtcgcctccaaaacactcaactctctcactcgcgaggtccgttcccttaacctcctctgcaccttgtctcgctacctcaaatcccgctcgccggagaccaaggaccacgttactcctttcaaggcaatctttaataaccttgtcggccaggctccctgtcttaactcaatctcaattggagtcgataaatcgctcaggaatatctcgtatg

SEQ ID NO: 2742 - DNA, 540 bp, Gossypium hirsutum
  Clone ID: uC-gsronu33B104d04b1
ctgatttagtttaagaaaacatttccttagagcataaaagaaagttaagaacatggctattgatgctgaaattgagttcccaaccattgagttacgttcatcggatttgaagcgaggaaccgaagggtggaaccgtttgtgcaagagggttcgagaggcttgtgagacttttggttgtttcgatgtggtgtacaaaaagatatcaacaaaaatccgagaggatgcatttgaattgcagaaagaactagttgaggtcccagtggagaggaaacagaagaacaccagtcccttgccttgccatggttgggcttggaccatgcgagcaggtttctatgttgtatgaaggctttggagtcgcagatgcctccaactatgattctgttaacaactttgctcaacttatgtggcctaatggccagccacgctttactgacactatacataccctagcgacgcacatggaggagctgaacaagttaatttggttaatgctaactgataggtaccggatacaggaggattcactgaagatgaactaca

SEQ ID NO: 2743 - DNA, 240 bp, Gossypium hirsutum
  Clone ID: uC-gsronu33B104d05b1
cttgatcaaaataccacaagaggtacatgtagattggccgtgtaaaccagttccattacatagtgaagatttttaaagtggactaaggtcccgtggttttttcccctcaaggggttttccacgtaaattttggtgtcccctttttctgtttatgttgcgcacttatgtcaatatcttttgcagttttgataatgttcctttagcaggtatgataactgtgagccgtttaatttatcagtc

SEQ ID NO: 2744 - DNA, 419 bp, Gossypium hirsutum
  Clone ID: uC-gsronu33B104d06b1
cctacgcgtgcggaaatgccgagcatcgaaacttgattcgaaaaacctacgctgaaacctatggagaggatctcctcaaggcactagacaaggagctctcgaatgactttgagaggctggctttgctttgggctcttgatcctgctgaacgtgatgcccttttggctaatgaagccaccaaaaggtggacttcaagcaatcaggtccttatggaaatagcttgcacaaggtgtgccaaccaactgcttcacgcaagggaggctcatcatgctcgcttaagaagtcgcttgaagaggatgttgctcatcacacgactggcgacttccgtaagctcctcctacctctagtgagttcatacagatatgagggagaggaggtgaagatacatcccctgaaaacagacgttaagctgcttgatg

SEQ ID NO: 2745 - DNA, 329 bp, Gossypium hirsutum
  Clone ID: uC-gsronu33B104d07b1
ccctcgcgtccgaaaaaaaataaaaaaaaaaaaaaaaaaaaaaaaaaaaaaaaaaaaaaaaaaaaaaaaaaaaaaaaaaaataaaaagagaataaaaatacggtggtcgggggggccgcttttaaggttcccagcgttcttccgcggggttggcccgttttattttttttttaggggcccctagattgagtctccgggcccgcgttttccaccgggggtgaccgggaaaaccccggggtttcccagcttatttgccttgtggccttttccctttttgccagttggggaaatggccaaaaggcccgccctttcgcccttccaacatttgg

SEQ ID NO: 2746 - DNA, 546 bp, Gossypium hirsutum
  Clone ID: uC-gsronu33B104d08b1
ggttcagcaaaaggaaaatataggtgaagacaagcaaaatccagctgaggaagacgaagaaatatcaactttagatctcaacagcaatacatggggttcttgttctgatcatcaagaaactgtgaaaaatgcattatcaagagacaagaacagtacagaagagggcctgctgactattggattaggacattcaaaactaaaagctggccgaactggatttaaaccttacaaaaggtgttctgtggaagccaaagaaaacagagtgatgaacactggcagtcaaggtgaagagaaatgtcccaagagggtacgcttggaaggggaaccttcaacttgacttttacacaattgcatacaattaacaaaggcaaagtttgtttgctgaatgcaatctctaatgttcttcccccatatcttatttccttttcatatgttgatcttaaaagacttttattcgattgcagctcacgagacttttcgtgtaggtggggtggggactatctaatatctacattgacttattcgctttcctggacctttttatgc

SEQ ID NO: 2747 - DNA, 398 bp, Gossypium hirsutum
  Clone ID: uC-gsronu33B104d09b1
cccacgcgtccgtgaattttgcagaaaatggcaatgaggaaagtttatagcgagataaaagggatgaaagtgaaggaagtccctaactacgtgaaaccgatgctatcaatggattacgtgaagaaagcttttcaaaagggtttggacaattacaattcaaagtacattcaaaccgattcgatccagcctctttaccatgtctgtttcggtgggatggtcttttcttacctcgtcgctctcccaaatgagcgtcgccatctcgagcaccagcaacacgccaaggaacatggtcatcactgatccctgctcaggttaaagagtggcatttatggcataatgcttctggttgtaatttctgagcaatttaggcaggaagatactgcctttgatcacatgca

SEQ ID NO: 2748 - DNA, 445 bp, Gossypium hirsutum
  Clone ID: uC-gsronu33B104d10b1
tgatgatcccagcagacagttctggacgatctttccttgtgaaattgccagatggcaaagatttttactattggtgctcggaaagatcaaagctcttgggggttgaattgctctcaaagatgaaggatctaatcaaaagaaaaccatctatagctgaattaactggaatcagcgagtcacgattaggctgttttgcaactcagcttcatgcctatctcctaggatcatctgtgaatcctgaagctagttgttctagttcacctttacccagtaccacgcacgatgctattgttgtgcacaatgggcaatcttcatcagctacatcaaaatctttgcgatcccgacattctagcagttaagcattcaaggtgaatgcacttttataatggtgcttaagtccaaaatcaagcttcttcaaagagggtttgatccgaaacttatcttt

SEQ ID NO: 2749 - DNA, 552 bp, Gossypium hirsutum
  unsure (1)..(552): unsure at all n locations
  Clone ID: uC-gsronu33B104d11b1
ctgaggtaattgtggttgctccaacaaattgtgttgtagaaatatcaaaatcggcaggagaaatagcagtttacaaagagttctgcaagagtttgtcaagtctgctgatagagaaatcagatgcctcatcacaaattcaagggtccaagacagtcaccaacagcactagtattctaatgaatgaatgctccaaagaagaaaaagacagaacagaagaccagcgaggatatttctcctcttgaagatcgggttaattaatttagtttcaacttccatcctttcagtatcctgagtaaattccccaggattaatagagactcgtgaacacaatctgtctcaacagcaggaactatgagaactcaaaattactgctcttgggcatcattcttcacccaatacgaagttcaaacaacgtcatctgcacagctatgttcatgttttatgtgaaagttttgtccttttactttctcctctcttaaattagacactgcaccatatgcttccaagatgtatattagaaggtatgttggaacaatgaacanggatgaaaga

SEQ ID NO: 2750 - DNA, 484 bp, Gossypium hirsutum
  Clone ID: uC-gsronu33B104e02b1
gaaaaactaaaaatattgtcctttggctgggtcaggaatattattattttaaaatagaacaattaatttttgtaatggtttctgcatagctaagtcaagtgaagcactaaaaaaacaacaaaattttgttttaccctatcatttattattcattccaaggttctaaccattaattcctgctattggaaataccggcatattgaatctatgtatggattttgcttttctctggcctgtaaattaaaggactaaaaagtttatgaatggaagtgagaatcaatattatagatgttattgtccagccggcaatgccttgctgctgtttatatctaatattaaaggactagaaagtttacttggcactggtgaaggaactgcattggtcctctgatactgacctacgcatgaatatcctaatatattgctatttggacatgtgaaagctgagagattatgatgcaactctctggtcatatattttggt

SEQ ID NO: 2751 - DNA, 329 bp, Gossypium hirsutum
  Clone ID: uC-gsronu33B104e03b1
cccacgcgtccgaaaaaaaaaaaaaaaaaaaaaaaaaaaaaaaaaaaaaaaaaaaaaaaaaaaaaaaaaaaaaaaaaaagggcggggggtgtccggtttccaggatcccggcctccggccgccggcatgctacctcttatcttgtgtatcgtgacaccaaaatacaggccactggccgacaatttacaacctggggactgggtaacccctgccatttcccaacttattcggcttgtacccctttccccttttgccggttggggtaataggccagaggccctcgccgttcgcacttccaaacaattgctgcatgctgaatgggaaatggc

SEQ ID NO: 2752 - DNA, 517 bp, Gossypium hirsutum
  Clone ID: uC-gsronu33B104e04b1
cccacgcgtccgcccacgcgtccgggaggaagttttagaagccacacaacttgctgagtttcaacgctgcatggtacccttattccaccagataggccgttgcttgagtagctcgcattttcaggtggcagagagggctttgttcttatggaacaatgatcatattgaaaccctaataaaacagaatcgaaatgttatacttcccattatcttcccctccttggaaaagaatgctagaagccactggaatccagcagtgcagagcttgactctaaacgtccgcaagattttctccgataccgaccctgagctctttgaggagtgcttgcataagtttgaggaagaccaagctcaagagaacgaggtcaaatcgaaacgcgaagccacatggaaacgattagaagagattgctgcaatgaaagctgcaagtaatgaacccgtgctcgtctccccgaagcaactactcgcaacccgtcttgctaggacacagagattgccgtttagctacctgacattt

SEQ ID NO: 2753 - DNA, 324 bp, Gossypium hirsutum
  Clone ID: uC-gsronu33B104e05b1
gacgaatttggatcggttcttggagtttacgactcctgtggtttcggctcagtatttacctaagacaagcataagaggatgcagagggcaggagcgcggactggagtgtcctccatattttgcgcttaaggatttgagggagtcttttaaagaatggagtgcatatggagctggtgttcctcttttgttgaacgggagcgactctgtaatgcaatactatgtcccttatttgtctggcattcagctgtatgatgaccaatcaagaccctccccaaggcagaggatgcctggtgaggagagtgttactgagtcatcgagggaaac

SEQ ID NO: 2754 - DNA, 528 bp, Gossypium hirsutum
  Clone ID: uC-gsronu33B104e07b1
tcctcttcttcctcttccctcagaatttttttctcttttcccatagcaaaacaaaagccatgtctcagactgttgtgctcaaggttggcatgtcatgccaaggatgtgttggagccgtgaagagagttctggggaaaatggaaggtgtggaatcatatgaagtagatttggagcaacagaaagtgactgtgaagggcaacgtccagcctgatgctgtgctgcagacagtgtcaaagaccggaaagaagactgccttttgggaagcagaagctctggccgaaaccgaggtgaagccagccgaaaccgaggtgaagcctgcggaaactgaggcgaaaccagcagaacccgaggcaaagcccacggaagctgttgctgcagcttaatctgttccccagtttgattcattgaatggtaaacttaatgcagtttacatggattgtagagtatgtatacttccctttaacatggaagctaaaataaggtgtggggtgcatgtcactatgctttctaggctaaaacatactggat

SEQ ID NO: 2755 - DNA, 435 bp, Gossypium hirsutum
  Clone ID: uC-gsronu33B104e09b1
acatattccacctccagtcatgcctcctcctgcaatgcagtacaggccacctctgccaaacatgccaccacccccacccccacaatcagtatctggtctttcaaggcctccgccaccaatgggaatgggagcaccacatggttggccgcaacagcaaatgggtggaaggcctcctatgctccaaatgtcaatgccaccccctcccccaccaccttctgcaagttgaattatcccaactactgtttttcttcgttcagcaaatgtagtgcatttttatttctagcggtaatagaaatgataaatgtggatcgtactctattgatgtattaatatccgaaaattagactcctaaatttaatcgttcgttcaatgattggtaaaaaaaaaaaaaaaaaaatataaatttaaaataataaaaaaattaaaaaaaatatg

SEQ ID NO: 2756 - DNA, 313 bp, Gossypium hirsutum
  unsure (1)..(313): unsure at all n locations
  Clone ID: uC-gsronu33B104e11b1
ttcatggtcacctgctatgactgttagttctatctgtatcagcattctctccatgctatcgagcgcgactgccaagcaatgtcccgaagacaatgacaggtacgtaaagaactgtaggaatggccgatctccgaagcagacacggtggtggttccatgatgataaagtttaattgaagggaagatcatgccctgcatcaaatttgtttttaatgacttttttcatgaaagtgatgcttgatgccatgtaagcacatgaatgagaaaactatatatctttatgacacttttttttttcttttttttggaacana

SEQ ID NO: 2757 - DNA, 383 bp, Gossypium hirsutum
  Clone ID: uC-gsronu33B104e12b1
taatttctatagagggactcgataactctgatctaagaatcaaagggatcagcgaacgtgactgaataaatgtgtctagcaggagctggatcgccaacatcagacatcagtgactctgtgtttgactcgactgtatatcgaccagtgtagaaaggatcaataaagtgcaggaacgtgtctacctcaacatcttgggactgggcactctatggctcaaacctagcctaaaaggaatagggtttcgacacacactgaatcagataagataagaaagagacatgacaacctgagacttgtggtaaccttgtttgtgcgattctctaccagaaaaggttcaggtccatacattctgccaacctgtaatgagatggattaggatgatg

SEQ ID NO: 2758 - DNA, 486 bp, Gossypium hirsutum
  Clone ID: uC-gsronu33B104f01b1
gttggatattaaaccatgggacgatgagactgacatgaagaaacttgaagaagcggtaagaagtgttcagatggaaggactgctttggggagcatctaagcttgcgcccgttggctatggaattaagaaattgcaaattatgatgaccattgtggatgatttggtgtcagttgacactctcatcgaggaacacatgactgctgaaccaaccaatgagtatgttcagagttgtgacattgttgcattcaacaaaatataatttgctatttgggatgcctgcaatacgagttgcttgaagaggccttcaaagttatgtttgagattttcatgttttttgttttgctagaacttaatttatggtggcgttattcttgtgttggacaatggatcgtttatcatgaatatggagcgtaaaccacctcgtggctgaaacaagcaaagagatctagcttgtgtttaagaaaggcaggctgcaaaacttgtttt

SEQ ID NO: 2759 - DNA, 385 bp, Gossypium hirsutum
  Clone ID: uC-gsronu33B104f02b1
cccacgcgtccgcttcattctcactctctctccactgaactcttgctaaacggtatcgttttagtcagtctttcatcaatggcgaaagaaccggttcgcgtcctcgttactggagctgcaggacaaatcgggtatgctcttgcacccatgattgctaggggagtcatgttgggtgctgaccagcccgtgatccttcacatgcttgatatcccacctgctgcggaggctttgaatggtgtcaaaatggagttggtggatgctgcttttcctcttctaaagggtgttgctgctacaactgatgctgttgaggcatgcactggagtcaatgctgctgtcatggctggtggtttcccaaggaaggaaggaatggagtggaatgaatgtt

SEQ ID NO: 2760 - DNA, 468 bp, Gossypium hirsutum
  Clone ID: uC-gsronu33B104f03b1
agcatatcttgttcactttctctctagaaactatactttctttcccggatggatgtactaggcgttcaccaaatgaaaaacaagaagaagcagtttaagaggagagattgtaagaaagttattaaagtggtttatatttcaagtcccatgaaggtcaagacatgtgcctcacaattccgagctttagtgcaagaactcaccgggaaagactctaatgccgccgtccgcttcatggacaatgacgacaacgtttctgatcattctcctgcctattccgattcaacgggggttgaacgtgttcttgaattgcctttagcaaataccaatcaccaatctatgtttgaatcatacgatgaggggagtttctgggcgatgtttacatctaatttgtttcatgatccttctcagcttgacacttttagaagctttggatcaacttaaatttttttttaaatatctatatgtata

SEQ ID NO: 2761 - DNA, 521 bp, Gossypium hirsutum
  Clone ID: uC-gsronu33B104f04b1
ggggttttcacagaatgctggcttagattaccaagacactttcagtccggtagttcgtgctactaccattcgcacggttcttgctatctcaatcatgaaaaattggtcgctaagactagctgatgtcaacaatgattttcttaacggggagctggctgaagatatctacatggaacaaccaccagggtttgaagaattcggtcctaatggagagaagattgtttgtaagctaaacaaacctctcttcgcgcatggttctaaacactcaaatagtatctcgttgatcaacttggttttcgtgctgctaaggcagatctgtcgctattcatacatgctgcatccgacagtattctgttgctcatgacctatgttgatgatattgttctcaaaagtagttctaattcaaagattgacagagttgtttaactacttcatacaaaatttgctctaaaaaatatgggacccttacttttttcttgggcatcactgttgaacaatcctctacaggactgtttcttagc

SEQ ID NO: 2762 - DNA, 396 bp, Gossypium hirsutum
  Clone ID: uC-gsronu33B104f06b1
attttacataagagaaacaccattagatgtgccacaagcggtgccgtgaggaccagacttggtgttaaaaggactgggatgttaattacatgaccgtgatctcgtaacgtacccattgatggctctggaagagatagagtgcatgaagtaggggcatgatactgcggaactggtgatgcatggactgggccatgagatgacggaagtggctttcaagctgctaggaggagatgagatggaggaatccaaaatctggacgggtacaggtcaaggtagagaaggagcacacggcataggcattgtagggcactgtactacggcttatgccaagcttatcgagggtcttgtacattctgagtactgtgttcaggctttgatcgagcggaccacaggcat

SEQ ID NO: 2763 - DNA, 558 bp, Gossypium hirsutum
  Clone ID: uC-gsronu33B104f07b1
ccaaaaaccaaattactaaaaattatggcgaaatcggcggtttattttcttctttttctgatgacggcggcgacgccatcactattggtggagtcaagcgacgacacgaaccacgcgtacttaccgtgttcggacacgaaagtccagatttcggatgggttcacttttggaatcgcgttcgcatcgagacaatcattcttcttcaacagctcacttcagttgtccccttgcgatcgccgactctctctgtcgaacgccaactctcgcctcgctctgtttagacctaaagttgatgagatctctctcctcaccattaacacctcctcttttactccggacgtagttggtgggtatatggttgcgtttgctggtcgaaaatatgctgcaaggtctctgcctgcgtttgttgcaaacggtacctacactgtaacaggcttcactctggtgcttgagtttaagaaaggcaggctgcacaacttgttttggaaaagggatggttgtgctcaatgttcgggaagaatcaaatttgtgtgcctaaacaaacaagattgtgcaatt

SEQ ID NO: 2764 - DNA, 300 bp, Gossypium hirsutum
  unsure (1)..(300): unsure at all n locations
  Clone ID: uC-gsronu33B104f08b1
tctgaattacgctcagagtcctgtttagcatgtcttgaaacaacttatgtgcttatttttctcgcaaacttaattttcaaggaaccattattgtagtcagtttggttcaataaaagtaaaaaacagagttcangcnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgcccttacaggagaaaaaaactaatctatcctgtttataaagaaactcaaaatttcttttaggggtcc

SEQ ID NO: 2765 - DNA, 352 bp, Gossypium hirsutum
  Clone ID: uC-gsronu33B104f09b1
cccacgcgtccgcaaaatttgtgttcgaagattacatgaagctttacgcagtgcttaaattccaggccaaggagcccaggtttgaagccatgaaagccagggaagcaactgctcccattgtaacagcttaaaagagaattcaataccttacgtagctttgtgtttgatcaagaaaggggtactgttaatctattttaagctttttaatggtgtattaaagaaaaaagaagtcagtgtttactgtaggtgagtgttttgattgaatattctaaacagtgacgaccctgtcaatttctactatactatacaatgtaacattgaagtagaaaagatttatgctgtgatatgtttt

SEQ ID NO: 2766 - DNA, 244 bp, Gossypium hirsutum
  Clone ID: uC-gsronu33B104g01b1
gtcacttatgactatgagtctacctccccagtcgccccttccagccttttcaaggcctttactgttgaagctccgaaagtttggcccacggctgcacctaatgcagtcaagagtattgaggtggagctcaacctaactttggaaggatatgaaaaatcaactttgttgaaggccttccattccaatatatgaagcaccagataggaggacatgatgaaaaataattttcatacagttaccattt

SEQ ID NO: 2767 - DNA, 400 bp, Gossypium hirsutum
  Clone ID: uC-gsronu33B104g02b1
attgggttttatcggaccccgatttcaaccacaccgatgaaacgctttcgtttttcgtcgattatttcggtcgaagaaaagatttcaaagctgcccacgatctccttgtcaatcacaagtctgttgccgggcctaaaactcttaactcctccattgataggctggttcgtgctggcaggccaactcaagttctggggtttttcgagagaatggagaaggattatggtttcaaaagaagataaagaatcactgaagttggcagtggagaaattgtgtgaaaatggctacgcgagttatgctgagaaattggtgaaagactcagccaacgagatattcccggacgagatgatatgtgacttattgatcaaaggttggtgtgttgatgggaagctggcagaag

SEQ ID NO: 2768 - DNA, 437 bp, Gossypium hirsutum
  Clone ID: uC-gsronu33B104g03b1
cttttcaaccattccaatgccttttctctcctccctaagaccggtttccgtgacgccgccgtcatcctaatgcttattcaccagtttataacatttggttttgcttgtactccattgtacttcgtgtgggagaaagtgatagggatgcatgacacgagaagcatttgttcgtgggcgctggctaggctgccagtggtgattccgatctggttcttagccatcatcttcccattcttcggacccataaactcagcagttggtgctcttttggttagtttcaccgtctacatcatcccagctttagcccatatgctcacctacagaacagcatctgcccgacagaatgctgcagaaaagcctccattcttcttgccaagctggactgcaatgtatgcaataaacgccgtggttgtgatgtgggtgctagtggttggatt

SEQ ID NO: 2769 - DNA, 426 bp, Gossypium hirsutum
  Clone ID: uC-gsronu33B104g04b1
aaataattaaaaaaaaaaaaaaataaaagataaaaaaacaaaaaggaaaagatagaaaaaaaaaaaaaatacaaaaaaaaaaaaagaaacgaaataccttttttatggtgtctgctattctcctttgtctggccggtgtttttcatctggtgagttgggacaaccgtggtttatcccgacttatttgtcctgtgacggagcctcgttgtttgctgtggatgtttggtggagggccttgattcgatccttgttttaactgttgctcttcttgtctgttgcttggtacccccctcttctcgcgggtcattaaccgctgcgtgtgttcgaggtttctctccctttttttccgttttgttatcccgcgcttttagtggctccttcctttctttgtgtttcttttttttttcgcctcttttttcgtttttc

SEQ ID NO: 2770 - DNA, 280 bp, Gossypium hirsutum
  Clone ID: uC-gsronu33B104g07b1
cggacgcgtgggtttgcgttggtctcaagctctctctgcctctctttctaccatttgcttcaaaatcaaatccaaaatctctctgcgattttctccaaagggatcagccattagggaagagaaatggggctgacgttcacgaagctttttagccgcggcttttggctaagagggagacgcggatttggatgggggctcttgatgcagccggtaagactaccatcttgtacaagctcaagcttggagaaattgttaccaccattccaaccatcggatttaa

SEQ ID NO: 2771 - DNA, 549 bp, Gossypium hirsutum
  unsure (1)..(549): unsure at all n locations
  Clone ID: uC-gsronu33B104g09b1
cttccctcctaattttcaggaaaatatcgtcgccgtgatccaaaactcagcccaccgtctccgacagtgtcaacccgtaacccaatctctcaaatatggatcgatccagattcgtaatcgacgccgtcgaagccgagcaaatggccaaacaatcaggcaagacggtgctccaactccttccttctttggtcaaatcagcccagtccgtagcccgcccgccgatctcgaagtaccacgtcggggcagtcgggatcgggtcatccggtcggatctttttcggagccaatttagaattcccgggcttgcccctcaaccattccgtccacgctgagcagttccttatcaccaacctttccctcaatgcagagccgcgtcttaaatacatcgccgtctccgccgctccttgcggccattgccgccagtttttccaagagctcccggtgcttccgatgtcaagatgctcataacttcctncgatgatgaaaaggaaaacaaaatangcaacacttgtaatgataaagaccaagaattacccctttgtctcatttt

SEQ ID NO: 2772 - DNA, 426 bp, Gossypium hirsutum
  Clone ID: uC-gsronu33B104g10b1
cccacgcgtccggtagggcttcaagttcaacgtacgtgaaggtaaagatggaaggaaatgcaattgccaggaaaattgacattagtcttcaccactcctttgaatcgctcacaaccaccctgatgagaatgtttgatatatctgatgagaatgggcaaaagagctttaaactcacttatctggacagagaaggagactggctgcttgctgaagatgttcgatggaggaccttcattcgatccttgaaatacatcaaattaattcgaagcagatgctaataagttagtgatgggatggatgaaacttgaaagaatggtcacggccttttcatatttgcttcaatgtaaacatatagtaaatgaaacactagttgtttaagacacaggtatgtagatttgagtgcaataatgatcccctgtttcaatt

SEQ ID NO: 2773 - DNA, 512 bp, Gossypium hirsutum
  Clone ID: uC-gsronu33B104g11b1
gtgacagatcaaagggtatgaagaagtacactgctatagataaatggaacacgcagcttagatccctgtatcaagccgtcagcaacagggtttcctgagattgcaagtaaatggttatatgatatatctgatttcatcgttcattgaggccataataatatgcattctcaattctcatattaggtgatttagataagcaattcggaaaaagaaaatggtgtacctagaatcggatgttatatgtttggttagccaaagttgtagttttgttgaatgagccaaaagaagaaaacatatttgcctggttgcaagaattttgattgagtttgacagtcgtaatgtgaacaatagaatatggattctctgcattaagtgcatattaaatgtggaatgttgatggctggctgctgttgtcaatgcttgcttggtagtatgttattgggatttttcatatttgctaatgaacttgtgtgtgaaataattttttgcaatagactcggtttttttattct

SEQ ID NO: 2774 - DNA, 500 bp, Gossypium hirsutum
  Clone ID: uC-gsronu33B104h01b1
agctattgtaggttcaccacaatgggggaacaagaccattttaacaggacaaaaccatttcggagacctggtcgtgttcgacgaccccattaccttggacaacaacttgcattcgaaaccagtgggtcgggcccaagggttttatatctacgacaagaaagacatattcacagcttggttgggtttctccttcgttttcaattctacccaacataaaggaagtataaacttcgccggtgctgatccattgatgaacaagacgagggatatatcagtgattggtggaacaggtgatttcttcataacttgtgtcattaggtaatataatgttatagacttgtagggtctggaacatgcttagcattttgatcaattcttctgttcaaaacaaggctacatacattatcatatttctggagaaatgcggactcgaattatgatagttatcaaaacaagtttgttctgcttgtgtctataaataaaaagtgcagattcacgac

SEQ ID NO: 2775 - DNA, 80 bp, Gossypium hirsutum
  Clone ID: uC-gsronu33B104h03b1
cattatccctaaaaaaaaaaacgcgggagccgagggcctttaaaaaaaaaaaacacgcgtcggcctggtgggccgtacct

SEQ ID NO: 2776 - DNA, 362 bp, Gossypium hirsutum
  Clone ID: uC-gsronu33B104h05b1
ttcaaaagcaaaagctaaagcaagaagataataaagagaggaattcaaggttgaaggagggtttctctttttctatttctttttctttttaaaatctgtgtggagaaactggagttagggaagatgatgcagactgagcagcagcctcagcaccaaaatcagttaacggttcaaaactctgggagtctcagctttagcagtcatttgtctaaggaagatgaggagatctcaaattcggcgctttctactttcagagccaaagaagaggagattgccaggaagaagatggaggttagagaaaacgttcgcttgggctgggccattgggcacattacactctcgtatacactcacacattattg

SEQ ID NO: 2777 - DNA, 57 bp, Gossypium hirsutum
  Clone ID: uC-gsronu33B104h06b1
ggaacatgtgaaagacctctcctgcttatcgaaaaatttatgccgaaccgttatctt

SEQ ID NO: 2778 - DNA, 460 bp, Gossypium hirsutum
  Clone ID: uC-gsronu33B104h07b1
tcccacgcgtccgcccacgcgtccgcataaatctaagaacccgaaaagtagagctttggttctctgtctgctgcttctttcttctcttggtacttcattatttttcctttcacttcctttttgtgaaaaaacattgaaacccttttcaagacgcaatagaagatgtgtggaggtgcaatcatttccgatttcattgccgtgaaacgcggtcggaagttaaccgccgaggatctttggtctgaacttgacacattctccgacctgttgggtctggattacggaaatggaaaagaccctttcactcagttcgacaacaccaaggccggttccaaagccaagaaccttgaaaaagtgacaaacgagtcgactcagaagacaagcccggggagagagaaagaagggaagactcagcgaactcgaaagaacatttacagaggaatcaggcgaaggccatggggga

SEQ ID NO: 2779 - DNA, 511 bp, Gossypium hirsutum
  Clone ID: uC-gsronu33B104h10b1
cccacgcgtccggatgaagtgataatctcagagcttttaagctatccggtcaggggtcttgtctttgagggtggtaacactcttcaggccttgtctgacactgtctctgatgcctgcatttgccttcaagagaacaacataccatataatgtcctcatctccgattgtggaaagcggatctttctcgttccacagtgttatgctgagaaacaagctctcggggaagtgagtccagagcttctggatacccaggtgaacccagctgtgtgggaaattagtgggcatatggtgttaaaaaggaggaaggactatgatgaggcgtctgatgaaaatgcttggaggctcctggctgaggtttctctctctgatgagaggttccgggaagtgaatgcactcatctttgaagtcattgccagtggcaaagatggcattgaacatgctgctaagagtctgcctaaggagcccgatactaaagctgaatccactgaagaagaaagcgccatcaccaaaa

SEQ ID NO: 2780 - DNA, 342 bp, Gossypium hirsutum
  Clone ID: uC-gsronu33B104h11b1
gtttctttaacccttgggggccgccgttcaagagctcccctcggcttcaaacgccgttttagcttctgatcgagacagagagaatagcagaacgcaaccaagtctggtattgttggcgcatggagcggtgcacgctggggagggtcgtggcgcgagattcgcggcggtgtgcgagggtggtactggagactgctggggcttgcggcgttggggccaaagctgctagggttttcggtagaaaatttggttagtgggctgttggggtttgggcctaggtttagtttattgggttgttttactatttgtaaggcctggaccatttgggccgattacactctcaat

SEQ ID NO: 2781 - DNA, 545 bp, Gossypium hirsutum
  Clone ID: uC-gsronu33B104h12b1
gaaggaagcacgtttaaggtaaagacgatggtgtcgggatcagggatatgcgcaaagaaagtggtggtggatgcccgccaccacatgctgggacggttggcttcgatcgtggccaaggagctgctcaacggccaaaaggttgtcgttgtcagatgcgaggaaatctgcatgtcgggcggactcgttcgccagaagatgaagtacatgcggttccttcgcaaacgtacgaacaccaagccttctcatggtcccatccatttccgtgcccccgccaagatcttctggcgcaccgttcgtggaatgctaccccataagactaagcgtggagcggctgccctcgctcgtttgaaggcttatgagggtattcctgccccatttgacaagattaagaggatggtcatccctgatgcacttaaggtcttgaggcttcagaaagggcacacgcattgcttgttgggccgcttgtcatcagaggttggatggaaccactacgacaccatcagggagctggagaagaagaggaaggagagggctcaggttgcata

SEQ ID NO: 2782 - DNA, 551 bp, Gossypium hirsutum
  Clone ID: uC-gsronu33B106a01b2
accccattgtctctcggtttggaaaccgctggtggtgttatgaccgtttagattccaaggaacaccaccattccaaccaaaaaagaacaagtcttctcaacctactccgacaaccaacctggagtgttgatccaagtctacgaaggtgaaagaacaaggaccagagacaacaacttgctcggtaaatttgagctctctggcatgcctcctgctcctagaggtgtcccacagatcactgtctgctatgatatcgatgctaatggtatcttaaacgtctctgccgaagacaaaaccactggacataataacaaaatcaccatcacaaacgacaagggacgactcttcaaagaagaaattgaaaagatggttcaagaagcagagaaatacaaatccgaagatgaagaacataaactgaatgtcgaggcaaagaatgcattggaaaactatgcatacaatatgaggaacacagttaatgacgaaaagattggtgccaaactcccagcaactgataaaaagatgatcgaagatgctattgaacatgccattcaatg

SEQ ID NO: 2783 - DNA, 525 bp, Gossypium hirsutum
  Clone ID: uC-gsronu33B106a02b2
cccacgcgtccggaggaaatggcagcaaaaaggaagacccctgttaagacccgaaacccagatcttatacgtggcgtaggcaagtattccaggtctaagatgtaccacaagcgcggcctttgggctatcaaggccaaacacggtggcgtcttaccccgccatgaccccaagcctaaagcacccgtcgcccccgagaaggctcccaaattttaccccgctgaagatgtcaagaagccgctacttaataagcgcaagcctaaacccaccaagctcagagcaagcattactccagggacagtcttgattttgttggctggaagatttatggggaagagaattgttttcttgaagcaacttacttctgggcttcttttggttactggaccattcaagattaatggtgttcctttacggcgtgtgaaccaatcctatgtcattgctacttccaccaaggttgatatctcaggagttaatgtagagaagtttgatgacaagtactctgccaaggaagtagaaaaaaagaag

SEQ ID NO: 2784 - DNA, 372 bp, Gossypium hirsutum
  Clone ID: uC-gsronu33B106a03b2
ctcagatcgctgtctatccggaactgccgggggttgggcgatgctagctcggctgcgttggagaagatgcgccctcaactgcagaatgtggagttgagagggctccacggcataacacatgttgctttattgccattgctcgagagttgtgaggccggcttgacgaaagttaatctgaacgggtgtcccaatttgggtaacacagatgttagccagatggctgagtcgcatggccggtctttaaagatgctgagtctagacggatgcaggaacagtgatgctgacttgagtgccattgcagagaactgtgagtggctcattgatctcgatgagtacaagtgcacagtaaccgactcttgaattgcttctctt

SEQ ID NO: 2785 - DNA, 294 bp, Gossypium hirsutum
  Clone ID: uC-gsronu33B106a04b2
ctcttatatgggtagctactgcaggttccgagaacgggggtcaactgggtcatgagttcagaggacttgcccttcgccttgcaaatcatggcgaattgacacgggtgagtggtttagaaaataacttgatttccctcggattgggacgtgaagcggcattttcagctgctgatttaggagacaatgctcttatggagaaagctaggcaggatactgtgacgcttgcggaggctgtgctccatgcacatgctcatgggcgaccgacactgaataacttgattgaggcttgggaca

SEQ ID NO: 2786 - DNA, 427 bp, Gossypium hirsutum
  Clone ID: uC-gsronu33B106a07b2
atgcttctgcgcggatgaaaacagcccggatgcgtgagactgcttcaagacaggaagtgcgtcttgctcagcagccagccaaatccactttgccttccccacctgcaggctcacctcttcacgagcgctttgattatgcttctagcaatcatgcagccaatcgcttcgggacgggagatcggatgcgtacgctcctagcacgagaaagttgtgtcaaacagggtggtcaaacgacactatcctctgaacgaggcattacctactgagatggcggtgacattctacgagtacgcttatactgggatttctcaagattcaggacctgtaaccagggccgatgatcaacccaggatggcaccaggaggcgaatcattacctacatatgttatcaggacgagtttgatggatctctcacgattcaatcaaa

SEQ ID NO: 2787 - DNA, 472 bp, Gossypium hirsutum
  Clone ID: uC-gsronu33B106a08b2
gtttgttaggcctctttgatcaaactaagtttcatgtctgatcttgacgttcaaattcctactgcctttggtatgatttgatcttaacttccaaatatttacctttgttcttgttaataacgtgtgtatttgttgtgttagatccctttgctgatgcatatgctgaggactcaggtgcgggtgcaaaggagtatgtgcatattcgtattcagcaaaggaatggtcgcaaaagcctgacaactgtccaggggttgaagaaagaattcagctataacaagatacttaaagacctgaagaaggagttttgctgcaatgggaccgtggtccaggaccctgaattaggacaggtgtgtcccgtaaccccttaccttacctgtatctgttattggaacccaattgtttagtctgttattttgcggtatgtatttaggtgattcaacttcaaggtgaccagcgtaagaatgtatcaacc

SEQ ID NO: 2788 - DNA, 177 bp, Gossypium hirsutum
  Clone ID: uC-gsronu33B106a09b2
gtttttctgtttttggttaaaattagaacacatgttggattattatcaaccaaaaagtagcggcatcagttttgtttcggtttaggttaagatggtttagagggtcgtgtcggagtttgagacatggcattcatgttatctttttaaacctctatttactgacgatttcgagttttc

SEQ ID NO: 2789 - DNA, 476 bp, Gossypium hirsutum
  Clone ID: uC-gsronu33B106a10b2
gtcgccgccgagcagagtctctaacccgttcatacaggatgctcgattcggggagcagaagattatgccatcggcgccaccttcatcgggcttgtactcatcttctccctcgtcgtcatcgaggaaaggaagctatgttagggcgaatcttggtagcaaaccagcggtgagagtggaggggtttgattgcctcgacagggatcgtcagaattgtagcatctctgcactggcgtagaccccattgcaatcctgaaaacagtaaatagataagcctaaaaaaggtgcttaaatatatatcacgtttaaaatagagtagcataaaatgacaggagccctttgtcattgtgtaaatatgttcggtagggttcctgatctctatgtcaatgatggtgtcttgtcagtacaggagttttcttgtgcaacagaaatatggcttaggtgtagcgtaagacgctacgagctgcacatgatgggaa

SEQ ID NO: 2790 - DNA, 475 bp, Gossypium hirsutum
  Clone ID: uC-gsronu33B106a11b2
cccactcgtccgcccacgcgtccgcggagccgtcggtgaaggctttaacctcatatgggggaggcaactaaggccctccttgctactagaatgctcgtcggttagcaagccagaggtcctgaaaccggcttcggctgccgcgtcgtcaccggccgcgggaggaagcgattccgccggggatgggaagattgctccggatggattcttcgagaagtatcccgctcttgttaccggatttttcttcttcatgtggtacttcttgaatgtaatattcaacattctcaacaagaagatctacaattacttcccttatccctattttgtatcggtcattcacttgttcgctggggtagtttactgtttggtgagctgggccgtaggcctccctaagcgggctcctattgattcaaacctactgaagttgctgattcctgttgctgtatgccatggacttggtcatgtaactagcaatgtc

SEQ ID NO: 2791 - DNA, 558 bp, Gossypium hirsutum
  unsure (1)..(558): unsure at all n locations
  Clone ID: uC-gsronu33B106a12b2
cagccataaggtgcatcatcatcatcatcaacaaggtgtgcttttgaatgaaggaagtggttataacattagttgtggagtgattcaagatgtttggtgtggacctggaattgggttttcagctgatgctgttggctctgtggatcgtgttgctacaaggagaaatgtgcctgctagagggaagattgatgttgaaaagccttcgtatatagcaaggctgactgtaaattccgaaacactctcatttcttgattctgattcagccttcatctcatcgcgtcctgaacctgatttcttcggatctagatactatcgccatgctcgacatccttctacagaggggcttgctgagatagtgatgctgcagaacatctttctagtgggcggaagattagattcacgtgatcgatttagcgactggaggctagatattgatagcatgtcatatgagcaattactggagctcggtgagaaaatcggtcatgttaacactggattgaaagaagatgagataagtagatgccttagaangatgaagggctcagttatgaatgatta

SEQ ID NO: 2792 - DNA, 353 bp, Gossypium hirsutum
  Clone ID: uC-gsronu33B106b02b2
cccacgcgtccgatttttaatgcccaaagcttggattattttcgtctttaaaaaaaatttttagttaaatacaacaatatactaattgcaaaaccttatatgaaaccttcgtcttggcttgtgtccttgagaggtctatctaagccctcttctatcgtgcatggtgactgtctcttattgcacccatctgggcgtgccttttttggggtcccaccttctcctcccctgggaggcccctttttttcttcttctttggggctcttccacctcatgatcctgccgctttttgtcctccctgccgcgtggatacccctggtcgtccccccctctattgtggcggggccgatgcccct

SEQ ID NO: 2793 - DNA, 452 bp, Gossypium hirsutum
  Clone ID: uC-gsronu33B106b03b2
gggattacccgctgagttggagcatatcaataagcgggggaaaagaaacttaccaggattcccctagtcacggcgagcgaaccgggaaaagcccagcttgagaatcggtcgccatcggcgttcgaattgtagtctggagacgcgtgctcagcgactgaccgggcccaagtcctctggaaaggggcgccggagagggtgagagccccgttgtgcccggaccctgtcgcaccatgaggcgctgtctacgagtcgggttgtttgggaatgcagccctaatcgggcgggcaattccgtccaaggctaaatacgggcgagagaccgatagcgaacaagtaccgcgagggaaagatgcaacaatgcatatccttctgttgattactagtttggcttgcactgatgccttgagataatattggataccatgaatgtgtttgatcaaacctctctacctc

SEQ ID NO: 2794 - DNA, 531 bp, Gossypium hirsutum
  Clone ID: uC-gsronu33B106b05b2
cccacttcgttcgcggacgcgtggggaactattgacgcaagttgatacctggcttattaatgttgagcaacaattggcagatattgaactagcaagcaagcaaaaagcagtctttgatagcttgaaagcaggtcacaatgcaattaaggcaatacaaagtgagatcaacattgatgatgtgcagaagttaatggatgacaccgaagaggctaaggcttatcaagatgaaattaatgcgatcttgggggagaagttatcagcagaagatgaagaggagattatggcagaatttgagaacttggaaactcagatggccgttcaagatatgccagaagtgcctagtaaagcaggatctgaagaacaaaagttggatcttcctgatgtgccaaccaagaaaccagatgcttccaatgcagctacagatgatgctgaaatttccacagaaagaagagttacggaggaacccctacctgcatgattgagacaaagacgtgctgtctcatgataaggagctcgcgattattaattacc

SEQ ID NO: 2795 - DNA, 463 bp, Gossypium hirsutum
  Clone ID: uC-gsronu33B106b06b2
cccacgcgtccgatcgcaggggctcagcgcttagttgaaagacactgtgcctcaaaagagatctgagcccagccctagaaggaggattgcttctatcaccagtaggcgaacagagctttcaggcatcgggatcatagtgtaacctatgactaagctccgtgactagctccattgtcatcatctaagttcttcttcatcacaggccaaccaaaccgctcgaccatagggaaatgaggaacccatagcactggactgaagtgcctgccccctcttcatcttccgagtcatgcccggaatgagtactttgcccttgagatctatccaaagcaaaagaaagaggaaaagagttcagctgcttgccgagctgtctaaaatgactaatagaagctcaatcgaacagaccttgcctaatagaccggaatgggggtaggccggacaaggcaaaaaagaccaggagctggag

SEQ ID NO: 2796 - DNA, 450 bp, Gossypium hirsutum
  Clone ID: uC-gsronu33B106b07b2
caggtatgtttatatggagatggtcctttgaacaatctctccgatcgaggcttcatgtttggtagtggtcctcttcaagctgttcgagaaatagaagatgacgctgtattcaacgcctaatatgttgtgagcatgttgttctaaggataatgtcccggttttacattcaatcatgtcattgctcggttataatatttgctgttgcgtcgccatcattagcataactttgagtttgttgacgatggatagaaagtcaaagagaagaacattgtaattgatctgtagttgcaggttttactttttatatgaacaaatggtgtttcatatatatgtgtgcaaacgtgttttgtttgtaaaacatcatttgtgctcttcttcttagcttcatgaatgcacaaatcaattaaaactcagagccatttgtttgcttaaaatagccatcttcattgg

SEQ ID NO: 2797 - DNA, 507 bp, Gossypium hirsutum
  Clone ID: uC-gsronu33B106b08b2
gtccagggaaaactattccacatcaatgctgctatgcggagctagaggcgatgctaatgctccagccaagtcattgttttggcaaccaaggaaagggcactcttacgtattaacatttgaatcagagagagacagaaatgcagctatcatggttgcacgaaagcatgctctcgactgtagcgtgatgcttggaggaccagatgatgaaatgtagaagctaaaaatgaaaataaaaatactaacttcaagagagtgtctacaacttgtgataaaaaagccaagagtttaattgtgtgagtaaatttttaatattttgtatggcgtgtttgcagtgtgggagagaagaaaggatatgaaaaaaaatttgggttttttttttccactaatttggttggtaatggtggcattgttttaggcagcgtttttttggtttgcctaatattaattatcaccagttgtaacaaatttgtcccctttggtttactttttcttaattgattttatttg

SEQ ID NO: 2798 - DNA, 548 bp, Gossypium hirsutum
  Clone ID: uC-gsronu33B106b09b2
cccactcgtccgcccacgcgtccgaagaagccttactgtaactgtttgattgatctctgtgttaacttagatttgttggaaagagcttgtgatctgttagagctgggactttcactagagatttatgccggaatacaatcaaggtctccaacacaatggtccttgaatctcaagagtctatctctcggggcagctttaactgcactacatgtttggatcaatgatttgacaaaggtacaggagtctggggaggagcttcccccattgctcggaatcaataccggacacgggaaacacaaatactcggagaaaggattggcaactgtcatcgagtcgcatttgaaggaactagatgctccattccatgaagcctcagataaagctggctggtttttgacgacaaaagttgccgccgagtcatggttggagtcgagacgttcacccaacttggtagttgcataggttgtgtgtgttcatgaacgagtctttgccctaggtcagttctttgcatcaatatataatgtctagaaacgaaatatttctgactc

SEQ ID NO: 2799 - DNA, 493 bp, Gossypium hirsutum
  Clone ID: uC-gsronu33B106b11b2
cccactcgtccgcccacgcgtccgcgtatacatggcttacatcatttggccttctacatagcggagtcatagtgtatgtgcacatgcgaaatcattaaaataacatcctgatgtatgagcatttaattgcttagtgttgctattggtgacatgctcatgcctctagttaactttttttagatgaagatgcttggtttcctttctatcttaattaatggaagcttgcttttaattttattttttgagtataatttcaattttcagacataattaaaagaaatgtatcaaagttatttactgtatgtaatgatgtttcaaagatgggaccatagcgacatatttgtgctttgtacatcaatggctattatttttgacttggctttattttgaattgcacaataattttattttggcattgacctataatttcaagataccagtgtgaggtatctcccaggcttctgcacctgtgtccctcaagagtgtagtgact

SEQ ID NO: 2800 - DNA, 425 bp, Gossypium hirsutum
  Clone ID: uC-gsronu33B106c01b2
cccacgcgtccggaaacaatgaattacgcaccattgtgtaatgtgtgaacttaagcattgctaagaataaagagctaagaagaactttaaaagatcatagctatttaatttgagttccacaaaaggatttgataattttgcccttcaaaactaaaaaaaaaaaaaaagggggggccgtttggggggccctatatatgatccacgcttcatgccacgtgcatgctatttttttgggtctcctaaagtaaaacctaagtccaattttttacccgtcgttatacgacaaaaccactgggaaacccatttaattaccctactaaaacatcccgctttacatacctgtttaaacagctaaagggccagcactgagggcctttccaaacagttgttcaaacagatgggcaactggaacgccccctggaacg

SEQ ID NO: 2801 - DNA, 558 bp, Gossypium hirsutum
  Clone ID: uC-gsronu33B106c03b2
attcgcctcttttggcggagcatcttattgtttcgaggggttgttcttcagtttcaaggtttcttgctttttttgtttttacaagtttcagtctgcagccatgggaaaagcaaaaaaggcccccaaatttgctggcatgaagaaaataatcactcaaaaagctattaaacattacaaggaccaagttttgaaccctaacaagaaggacctcagcaaggaaaaactccccagaaacgtgccgaacgtgtcttcagctcttttctttacacacaacacctccttgggaccgccttatcgtgttttagttgataccaatttcatcaatttctccatccagaacaaattggatctggagaagggaatgatggactgcttgtatgcaaaatgcactccttgcatcacagattgtgtgatggctgagctcgaaaaattgggccaaaagtaccgtgtagctctgaggattgctaaggatcctcgttctgaaagattgccatgtgtccatcaaggaacctatgctgatgactgtatctgtgagagagttacacagcacaaatgctt

SEQ ID NO: 2802 - DNA, 500 bp, Gossypium hirsutum
  unsure (1)..(500): unsure at all n locations
  Clone ID: uC-gsronu33B106c05b2
cccactcgtccgggctctctgaaccttacaagggtattggtgattgtttcaagcgaacaatcaaggatgaaggatttggttctttgtggagaggaaacactgccaatgttattcgttatttccccactcaggccttgaactttgccttcaaggattacttcaagaggcttttcaacttcaagaaagacagagatggttactggaaatggtttgctgggaacttggcatctggtggtgcagctggtgcttcttcccttctctttgtctactccttggattatgctcgaactcgtcttgcaaatgatgcaaaggctgcaaagaagggaggagagagacaattcaacgggcttgttgatgtctacaggaaaaccctaaaatctgatggtattgccgggctttaccgtggtttcaacatttcatgtgttggaatcattgtttaccgtggtctatattctggaatgtacgactctctgaagccngtgcttttgactggaagcatg

SEQ ID NO: 2803 - DNA, 570 bp, Gossypium hirsutum
  Clone ID: uC-gsronu33B106c06b2
cccactcgttcggtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactctccaccttgtccttcgtttgcgcggcgggatgcaaatcttcgttaagacgcttaccggaaagacgatcactctcaggtcgagagctctgacacgat

SEQ ID NO: 2804 - DNA, 527 bp, Gossypium hirsutum
  Clone ID: uC-gsronu33B106c08b2
ctcaatgatatgcaatgacatactctcagtcattgataagcacctcattccatcttcctccaccggggaatcaactttttctactataagatgaaaggagattattttcgttatttggcagaatttaaggcaggagatgatcgtaaagaagctgctgatcagtcacttaaggcttatgaggctgccacttccactgcaagctcagatttgcctccaactcacccaattagacttggcctggctttgaacttctcagttttctactatgagatattaaattctcccgagagggcttgtcatctggctaaacaagcatttgatgaggctattgctgagcttgatagccttaatgaagaatcttacaaggatagcacccttatcatgcagcttcttagggacaacctcaccttgtggacctcggatctgccagaggaaggaggtgagcaatcaaaagcagatgaacctcaggctgagagttaattggatgaaagagtattcttttaagactgggcttgtcgagataggaa

SEQ ID NO: 2805 - DNA, 501 bp, Gossypium hirsutum
  Clone ID: uC-gsronu33B106c10b2
gtggttcctgcccttcccccaaccccaaacctagacctaaacctaaaccaaagccaaaccctactccctccccatcttcttctggcaagtgccctagagatgctcttaaactcggtgtatgtgctgatttgctccgtggcttgctcaacgtcaccattggtacccctcctgttcaaccctgctgctctctcatccaaggtcttgctgatcttgaagctgccgtttgcctttgcacggcaatcaaagcaaatattttgggcatcaaccttaatgtcccactgtccctcagattgcttcttaatgtctgctcaaagaaagtaccctctggcttccaatgtcgctaaatcagctctctaaattctttctcttcttagtgctgcgtggttctgatgttcttaaggtccagtttgaagcgatcaaatgtctctcggtaactggtcgtttaatctacgatgttgtagtgttgattccttttggattgattctgaataaatgtaacac

SEQ ID NO: 2806 - DNA, 567 bp, Gossypium hirsutum
  Clone ID: uC-gsronu33B106c11b2
ggtagttgttgcagaagagtaaaatagtaaagagtcacagctgaggcacggaagaagatgccttgcctaaacctttcaaccaacgtcaatctcgacggcgtcgacacctccgccatcctttccgaagccacctcttccgtcgctaaactcatcggcaaacctgaggcctatgtgatgattgtgttgaagggttcagtacccatgtcatttggtggtaccgagcagccagctgcctatggagaactggtatcaattgggggccttaatccagatgtgaacaagaaactgagtgctgcaattgctgcaattcttgaaaccaagctacaagtgcctaagtcacggttcttcctcaaattctacgacaccaagggttccaactttggatggaacggatccaccttctgagcctggcatgttctgaatttctcgaaacatcagtgatgtctattcaaaacaatcttactcgtatgatgaactggtgtgagaagaaattgctaaaacttggcatggtattttaagatgtttatctccgtgtttcttgagggattatgatatgtaacgttcatg

SEQ ID NO: 2807 - DNA, 337 bp, Gossypium hirsutum
  Clone ID: uC-gsronu33B106c12b2
ccctctcgtccgcttcatcaacatggtctaccttctggtaaatattggggtttgcaacaagtccaagttttggaagtttacgtcaggtagaaggtattgctgctctcacagctcgtcgaagtgggctgcatcctagtacctcgatatttggctaggggcatcaattcctgttttagcacatgtggtggcagccaatgcaaatcatgtcttaaccactaggggcattaagaagactactagtgtgctattgggtttaggttgaagacagtgaacttgctgatgctgctactgttagtgctgggaacaacaatgaaatatgaaatatgatagctgtttc

SEQ ID NO: 2808 - DNA, 500 bp, Gossypium hirsutum
  Clone ID: uC-gsronu33B106d03b2
cttgagaaggcaaaacggcagagaggaggctttgttgagcgttgttttctctctgttggtggtttcggttgcgctttggaagagctaagggaggttgattagtgaatttatgtcggctgagtttgattttgctttgattggggctcagttgcagctctgtttttcatcttctacaacaactgtctgtgctcgcttgttcatcaccgctttgttggctgtttcttgcatgattctctgcttctataggcagagactgaatatcgtgttctcgactgtttcgatgcgtttgagacccaaaaagagttgttctggagttgagtgctttggaggttttcacataaaacaacgatttttttatcttttcttgtttctaagaggggctcatacttgatacagctttcatagttttcgactttgtcacccttttttgtcatttgattctgtttaaatagttgtctacagtttttccgggtattttgaggggggtttagttggtttta

SEQ ID NO: 2809 - DNA, 550 bp, Gossypium hirsutum
  Clone ID: uC-gsronu33B106d04b2
cccacgcgtccggtttaaagaacatgactccagcagtaattgccagcgttgaaacaatgctagacaagtggaaagacaaagaaggaaaagagatcgaagcattccaagaatttagaatcttgacttcagaagtcatatcaagaacagcttttggtagcagttacttcgaaggagagaagattttttacatgttgcagaagctcgcagatattgtgagccgcaattcaaacaagtctaggattccaatcctcagcaagttttggaaaactgacgatgacattgagtcagagaaacttgctagagaaatacaagatttggttatagagattgtgaagaaaagagaaaacaaagtttcgagtggaggagcagagagcttcggcagtgattttctgggattattagtaaaagcgtttaataattcagatgaaaaaaacaagatttcaatggaagatttggttgatgagtgcaaaacattttattttgccggacatgaaactgttaacgcctcacttgctttggcagtgctggttttggctatccatagagattg

SEQ ID NO: 2810 - DNA, 106 bp, Gossypium hirsutum
  Clone ID: uC-gsronu33B106d05b2
ggtctgatgaatatcccaattcctgtattatttgctgaattggtaactaagggcttgtaatgtttatattgctatctgtgaatcaaactttgaagatttcaacatc

SEQ ID NO: 2811 - DNA, 488 bp, Gossypium hirsutum
  Clone ID: uC-gsronu33B106d06b2
cccacgcgtccggtcggatttgctccactgacctcccgcggttctcagcagtaccgagctctaactgtccctgagttgacacaacaaatgtgggatgcaaagaacatgatgtgtgctgctgacccgaggcacggtcgatacctcacagcatcagccatgttccgaggcaagatgagcaccaaagaagtggatgaacaaatgatcaatgtccaaaacaagaactcttcctacttcgtcgaatggatcccgaacaacgtgaaatccagtgtctgcgacatcccacctagagggctatcaatggcatcaaccttcgtaggaaactcgacctcgatccaggaaatgttcaggcgagttagtgaacaatttaccgctatgttcaggaggaaagctttcttgcattggtacaccggtgaaagtatggacgagatggagttcaccgaggctgagagcaacatgaacgatctcgtgtctgaatatcaacaatacca

SEQ ID NO: 2812 - DNA, 60 bp, Gossypium hirsutum
  Clone ID: uC-gsronu33B106d09b2
ctgaaggatatgtgcttaagcacgtgtgttttaggtgaaaggttcgagggttggtattcc

SEQ ID NO: 2813 - DNA, 488 bp, Gossypium hirsutum
  Clone ID: uC-gsronu33B106d10b2
ttttatctcatgaaatgcaagagtttctcctctttttgataaatacttaatttcgcttcatttgagtcttctttcttaaatttcgtctaaaaatcctctcccaatttcatttccaaagcttttcaattctcttgattgttcatatattataaatttcttctttttcagccatgggtgttgcagttctaaaaccagacgattgtttgaagctaccaaatcccgtgaaacaacgaaatagtctttgccttaatccgaaccgatcgaatcggtcacacccaaaccgtaaaactcggtctcctactacctcccctccttcccagtcggccggccccaaggtaccggctaaagatctcgtgatgggtcaagttaagatcctcaaacgcggtgaggttctaaaaaaaccgacgccggagaaatccgtcaggttcgaaaaggaaaacattgacgttgcagatctgggttccactaaccgtttgggtcctgaaccc

SEQ ID NO: 2814 - DNA, 557 bp, Gossypium hirsutum
  unsure (1)..(557): unsure at all n locations
  Clone ID: uC-gsronu33B106d11b2
ctttcgtgtttgtctattgaattctttccttcacttggtcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttgtttatgggtttatctngctgtaaatcttataaaatatatatc

SEQ ID NO: 2815 - DNA, 433 bp, Gossypium hirsutum
  Clone ID: uC-gsronu33B106d12b2
cttaatctacgtctatagctgcggatgctgacggaggggtaccttagttttggggtactgatgctaaaagccatcttgagcttgcagatgacaggtagactgtcatgaaaggctgatggaagacttttgatccattcccgaaagggcgctttttcacattctaagcagggttaaggacctatgagcatacccttaacgagtcgaaaccgaagccatgagtggacagagaaggacatgattgtggtgccactctcaaggtggatgcagagaccaagatggaatctactgttatgaaaaagggctgaagtgcctgatatcggatcgcacactactaaagatatatcagtgagcctatagatcctatacaccttagatggcgaatatgacttgactgaacttagttgttatatggaactaaaacaggatcttaagg

SEQ ID NO: 2816 - DNA, 547 bp, Gossypium hirsutum
  Clone ID: uC-gsronu33B106e02b2
ctcttctgggatttgcttcaacagacccccccccaaaaaaaaacccttgaactttttccgcagtcaaaatgggtatctctcgtggttcgatgcacaagaggcgtgccactggaggtaaaaagaaggcttggaggaagaagagaaagtatgagcttggaaggcaaccagcaaacacaaagctatcaagcaacaagacagttaggaggattagggttcgtggtggaaatgtcaagtggcgtgctctgaggctcgacactggaaactactcgtggggaagtgaggccgtgactcgtaagaccagaattttggatgtggtgtacaatgcatccaacaatgagttggttcgtactcaaactctggttaagagtgctattgttcaagttgatgctgcaccattcaagcagtggtatctccagcactatggtgtcgacattggtcgcaagaaataaacagcagccaagaaagaaggagaggaaggtgaaactggcactgatgaggtgaagaagagcaaccatgtcttgagggaagatgagaaacgtcaacagaa

SEQ ID NO: 2817 - DNA, 556 bp, Gossypium hirsutum
  Clone ID: uC-gsronu33B106e04b2
caacataatttccctctgtttctttcttctcatctcatttgcctgaaaatcaaacgagaataaaagaaaagaaaagcaggagaaaaaaaaatgtacagatacgagcgtgtgagcagcacgagtgtcagtaaggcggataaggtagatctagagtcaggagacactctgtacccgggactcagctacggtgagaaccagctccgatggggctttatccgaaaggtttacggcatcgttgcggcacagctagtgttaaccaccgtggtctccgcctttgtggtgttctcggctccggtcaacgagctcctccgtggaaactctggcatcttgctcttcctctgtttagtccctttcatcttgttgtggcccttgcacgtctatcaccaaaaacaccccgtaaatctgatcatcctcggcctcttcaccgtgtctctgagtctcacagttggtgtgagctgcgccaacactgacggaagaattgtgcttgaagcactaattttgacagcatgtgtggttgcatctcttactggctacactttctgggcatctaagaagg

SEQ ID NO: 2818 - DNA, 565 bp, Gossypium hirsutum
  Clone ID: uC-gsronu33B106e06b2
ggttttatggcttcttttttctccttttctgttcttatctggttctgtcaacactcaaaccaaagtaaccgataaccctgcggatgaattggtggctgcgcttaatgccaataggacagctcacaagtcatcggctctcaccgacaacccaggcctggcctgcattgctttgcagtatataaaagcataccaaggtgactgtaaagctgtaggagaggccaagaagcccgctgactctgaattttctgaaacttttgcccccaactgtggtgtggaagcctcaaccctctctccaatcactggtcgtttacttggatgccaatcgaaatatgtagagccttctgaagctttctcgatgttgatgaaaaacgagaagagtttggaaattctttacaataagaaccacactgaagttggggctggtgtgaccggctccgatggtgggggtccctatttctggtgtgtacttttcagcaacggcaagcataacagtagctttgttgcacaaggtggtgtggctaatatctcgagaccgggatgctatagtggtgccaatgatgaatgg

SEQ ID NO: 2819 - DNA, 507 bp, Gossypium hirsutum
  Clone ID: uC-gsronu33B106e07b2
gaatagaaacaaggccttggtttttttagtaggcaaagattatgtttctgcagtgagggaatacgaggagtgtatggaaagggatcccgcagatgttgtggctgttaataataaggcgctttgtttgatgtatttgagagatttgtcagattcaattaaggtattggagaattcactcgaaagagtacctaccgtggcattgaatgagactttggtggtcaatttgtgtagtatgtatgagttggcatatgttaatcactcagagattaagaggactttgagtaattggattgctcgagtctctcctgatgattttgacgcatcctgtaccagggtttgagtctttgtgccaaaaacaaaacaccatttgatgccctttatggtctgatgaatctgaatttgagcagattttgacgagtaaagatgcagagagttggttcaaaacagggctcgcgaggttcaacttatggtgccggccgaacctatagattcattctcaagttacta

SEQ ID NO: 2820 - DNA, 450 bp, Gossypium hirsutum
  Clone ID: uC-gsronu33B106e08b2
aaaccatgaaatatgattggtttggagaacccttctttccccttgttttagggtgggttgatttactaggatgtgactgttagtatgagattttctctatgtgcatgttcccaggaactcgagtatatgtctgccatagtgttcttattatatatacatagcttgtcatcaattattttatggcttgtgtgattgtagttattttttaattacttgccaattcttacagttgattctttttttaaaaaaaaaaaacaaaaataaaaaaaaaaaaaaaaaaaaaaaaaaaaaaaaaaaaaaaaaaaaaaaaaataaataaaaaaaaaaaacagaaaaaaattaaaaaataaaaaacttaatggggggcgccctttttaaaagaacaaattttacggcgctgtgcatggaaagtattttttttttttttggggcacaaaaattaaaataagg

SEQ ID NO: 2821 - DNA, 547 bp, Gossypium hirsutum
  unsure (1)..(547): unsure at all n locations
  Clone ID: uC-gsronu33B106e09b2
atcgttacttgtcttccccaacttcgaattcattgtattccaggtatatggaggggaagctaggatttccacactacgaaagctattccccttgatggaagacaaaaagagcctagcctctttggcggaaagggtccatataaaaggaaaagcttctttgttggctgctgttgattactatgtcgggatgcatagtgacatctttgtctcagcttctcctgggaatatgcacaatgctttggtgagtacttctgactcatagaataatgcaccatggattggtgaatgcaatgaattttcctgccttgtgctgggtaaattgtatacatatgaagctgctaatagatgacagttacaatgatgcaaacaggtgggacatcgaacttttgagaacatgaagaccataaggccaaatatggtattgttgggccaactattccttaacaaaaacatcagttggtcgcagttccatcaggcaatggtggagggcatcaaacagacaggggcactcangttaagtaaccaaacagtccatatatacatatct

SEQ ID NO: 2822 - DNA, 527 bp, Gossypium hirsutum
  unsure (1)..(527): unsure at all n locations
  Clone ID: uC-gsronu33B106e10b2
cccacgcgtccgtttagtcatccctttcttctcttctttcaactcaaaaactcccaagtaatattagaatcatgggtgttgtcacttataactatgagtctacctctccagtcgcccctgccaggcttttcaaggctttttctcttgaagctgacaaggtttggcccaaggctgctcctcaggcagtcaagagtgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgagatcaaggctcanatcaaagggaagtgaggagtttacaaggcttgtgaagcttacctcttg

SEQ ID NO: 2823 - DNA, 548 bp, Gossypium hirsutum
  Clone ID: uC-gsronu33B106e11b2
atatcctaatcttcctcctttttgcagatcaacgatcctctggatttttcttttcagattcctaaatccaacaatacctaaagcctttgagatatttatatagatcgatcgaaatcgaagacagcagggtggcttgagaaaagggtaagtctggggttcggtggttattggaagtaaatggcgaatctgtatgtgaaagcggtgccaccggcggatctgaaccggaacaccgagtggttcatgtacccaggagtatggactacttatattctaatcctattcttctcctggctccttgttctctccatcttcggttgctctcctggcatggcttggaccgtcgtcaatctcgctcacttcctcgttacataccacttctttcactggaagaaaggaaccccatttgctgaagatcaagggatttacaatggcttgacttggtgggagcagatagacaatggaaagcagcttacacgcaataggaagtttctaactgtcgtacctgttgtgctgtacttgatagcctcgcatacaaccgactatcaaca

SEQ ID NO: 2824 - DNA, 524 bp, Gossypium hirsutum
  Clone ID: uC-gsronu33B106f01b2
cccactcgttcggccaatttgattaaaaactaaaaaaggaaaaagcttcaaaaaaaaatggagaagatgatggcattgagatccgtttatagagcagcgtgtttcagatcttcccgttttacccccatcgccgtcacgggcgccgtcaatcacaatcgccacttggtttgcgggagttccttctctatctcatcgcttatcgccactaatccgcttagaaacaccccttctgatgggaggtcgtcctttgcgttgagatcgggaagcatgcgctattttagtgaagatgcagctcatttgcctgacataaacgacactgagattctgaatgttttcaaggacttaatggctgcaagctgggatgagcttccctattcggtcgtacaagatgcaaaaaaagccttgtggaaaatactgatgacaaagccggtcaggatgctctgagaaatgttttccgtgctgctgaagctgttgaagagttctggggtcttctaatgaccatgaaaatggaactcgatgacagc

SEQ ID NO: 2825 - DNA, 105 bp, Gossypium hirsutum
  Clone ID: uC-gsronu33B106f04b2
aaaattatttaaaaaaaaaaaaaaaaaaaaaaaaaaaaaagaaaaaataaaaaaaaaaaaaaaaaaaaaaaaaaaaaaaaccccccgcgtccggttttagatcgg

SEQ ID NO: 2826 - DNA, 419 bp, Gossypium hirsutum
  Clone ID: uC-gsronu33B106f05b2
gcattaaccattgttctgtgtgtgtgtatttctgtgtgtaattgtgtatataataccattaagtaaaaaattggttattgaatttgttagaagcaaaaaaaaaaaaaaaaaaaaaaaaaaaaaactaaaaaattaaaaaaaaaaaaaaaaaaaagggcaaaagaaataaaaaaaaacaaaaataagataataatgaatgaaaaaaaaaaaaaataatatggggggccctttttaaaaaaccaaagtttacttcccctgccatggaaatgaaaaacttttttttgggggcccaaaaataaaatcttggggccggtgttaataaagacgggaaggggaaaacccctggggtccccaaattaaaaccctttaaagaaaatcccctttctgaaagttgaattaaaagcaaaaaggcccgcccc

SEQ ID NO: 2827 - DNA, 534 bp, Gossypium hirsutum
  Clone ID: uC-gsronu33B106f06b2
cggactcgtgggcggacgcgtgggtcagaatcaaaatctctctttctcgtcaatatggcagcaaatggcgttgtttctgacaagagcttgatcgtcagcttcggtgagatgctgatcgattttgtccccactgtctccggtgtttctctagccgaagctcccggcttcctcaaagcccctggcggtgctccggctaacgtggccattgctgttgctagactcggaggcaaagcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagttgaaccttgatcttatcagatcttccaaggtatttcactatggatcaataagtttgatcgtggagccatgcagatcagcttcattaaaggcaatg

SEQ ID NO: 2828 - DNA, 485 bp, Gossypium hirsutum
  Clone ID: uC-gsronu33B106f08b2
ctctctgcaactgcaatcatgacctcgcttgtgcaaggcttttccaagtctttggctatgactgtgctatcggagattggcgacaagacgttcttcgctgccgcgatcttggcaatgcgccatcccaggaaacttgtcttgttaggatgcctggcagctttaattgtgatgactattctttctgctgttgttggctgggcagctccaaatcttatttctaggaaatggacacatcacattacgactgtgcttttctttggatttggcctgtggtctttatgggatggatttatggaggatggcgaggctgaagaattggctgaagttgaagcaaaactggatgctgaccggaaggcaaacccaggaacagtcaaaggggggaataaggctgatgatgattcaaaaaaggagaggcagccatttctcacacagttcttctctcccatatttctgaaggcattttccatcacattctttggtgaatg

SEQ ID NO: 2829 - DNA, 249 bp, Gossypium hirsutum
  Clone ID: uC-gsronu33B106g02b2
cccactcgtactcgaactcgagggcagacgcgtaggtgggacgcttgttaaaggacttgttttttttattttcacaggccatcagtataccgacttgtctctaaagttgttactgtagacagataaagacttgcgcatgagcttccctgattggactaagggtgggccccgataacgggctgtgttcaaaggagatgtgatcagtaatgagttcaatgaccctttcatactgagtctcatgacacctat

SEQ ID NO: 2830 - DNA, 545 bp, Gossypium hirsutum
  Clone ID: uC-gsronu33B106g04b2
ctcatatctcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgctttggactccgacgaccacgaggtggcgtacggtcaaaacaccgacgccgagaagaaaaccaatctgtttgaaatccaagccatcaccgggccgcatgtttcgctcga

SEQ ID NO: 2831 - DNA, 507 bp, Gossypium hirsutum
  unsure (1)..(507): unsure at all n locations
  Clone ID: uC-gsronu33B106g07b2
atacatatccactcccacattaaatattgctgctgaaacaatggcgttttcagctctgacaggtaagcttgaggcagatgtagagattaaggcttctcctgagcagttccatgaaatgtttgcccacaaaccgcaccacgtgcaccatacttgctatgacaagattcaaggatgcgatttacatgaaggtgaatgggggaaagtcggtaccattgtccattggagttatgtgcatgatggaaaagctaaaaaggcacaggacgtagtggaagcagtagaccctgataagaatttggtcactttcagagtgatcgaaggagatctaatggaagagtataagagctttgtaatcatgattcaagtttcgcccaagagcgagggtagtggcagcttagtgcactggactttggaatacgagaagctgcacgatgggattgcgcatcccgagactctgctgncattcgttcaagatgtctctaaagacattgacgcccacctcacccaagc

SEQ ID NO: 2832 - DNA, 537 bp, Gossypium hirsutum
  Clone ID: uC-gsronu33B106g10b2
gttccttttctgggtgctttcgacctacagggactcaaagcacgtacaaagaaactcggtgaaaaacttgacaaagccctcgagacgatcattgacgaccatgaacaacataagcaggatgatttcgtcggtacactgcttaaagagttaaatcaaccaatgaacaatgatggtgatataatggatcggaatagcatcaaagccataacaatagatatgatggtgggtgccttggacacttcagctgccacattggagtgggcattatcagagctcctaaggcatccaagggtaatgttaaaactccaacaagagttagaaagtattgtcgggaacaagagaatggtagaggaaaatgatttaccaaaattggagtacctagacatggttgtgaaagaaatttttaggcttcatcctgttgcacctttgctagttcctcgtgagtcagtggaagacataattattgatggctgttacataccaaaacaatcaagggtcttagtgaacatttgggcactggggagagaccctaatact

SEQ ID NO: 2833 - DNA, 498 bp, Gossypium hirsutum
  Clone ID: uC-gsronu33B106g11b2
cccacgcgtccgcccacgcgtccgctaaaagatccctattagccatcttcctcctcctttccttcctctccatatcaaccgcagcaccaactcgaaaaacccgaacccgaaaaccatgcaagagcatggtgttttatttccacgacataatctacaacggccataacgcaaagaacgcaacatcagccattgtaggttcaccacaatgggggaacaagaccattttaacaggacaaaaccatttcggagacctggtcgtgttcgacgaccccattaccttggacaacaacttgcattcgaaaccagtgggtcgggcccaagggttttatatctacgacaagaaagacatattcacagcttggttgggtttctccttcgttttcaattctacccaacataaaggaagtataaacttcgccggtgctgatccattgatgaacaagacgagggatatatcagtgattggggggacaggtgatatcttcatggctagaggag

SEQ ID NO: 2834 - DNA, 447 bp, Gossypium hirsutum
  unsure (1)..(447): unsure at all n locations
  Clone ID: uC-gsronu33B106h02b2
gaaattttgtaggcatctgatgattctggcaacccttgcatgttggagggttttgatggtacttatacatatggaggaaatcagtataaagcatcagctccttcatcgggtgcaagcatggaagaatgcaggagggtgactcacaaggctcttaaaataaatgacacatgcatgcatatgaagtgcacatttggtggtatatggaatgggggaggcggagatggacagaagaatttgtttattgcttcgttcttctttgacagggctgctgaggctggttttatcaaagctgctgatccagttgcaacagttcagcctcattcttttgcagaagctgctaaacgagcttgtggaaccaagtacacagatattaaagcaacatacccagctgtggatgtgggtaaccaggcttatctatgctnggatctagtttatcagtacaccctg

SEQ ID NO: 2835 - DNA, 512 bp, Gossypium hirsutum
  Clone ID: uC-gsronu33B106h05b2
cccacgcgttcgctcggtctcgctcacgctcacgctcaaagaggattagtggctttgacatggcccctccagcttcagcaatgttagctgctggtgctgtggcagctgctgctgcagggcagattccggggacaactaacccaaccatacctggagtgtttcctaacatgtttcctattgcaactggacagccatttggtgctctcccagttatgccagttcaggcaatgactcagcaggctactaggcatgctcgtcgggtgtatgttggagggctttctcctactgctaatgaacagtctgttgcaactttcttcagccatgttatggctgcaattggtggaaatactgctggtccaggggatgctgttgttaatgtctacataaaccatgaaaagaagtttgctttcgtagagatgagatctgtagaggaggctagtaatgcaatggccttagatgggattatctttgagggagcacctgtgaaggtgaggagacctagtgactattat

SEQ ID NO: 2836 - DNA, 458 bp, Gossypium hirsutum
  Clone ID: uC-gsronu33B106h06b2
acatattctttatgaccagaaaaacaaaaaacaaaaaagggggggcctaaaaaagcttttgctaggttactagaaaaaacaagataattacagagaagaaccggagaggaatctgctaatacccatttcaagagggcgcttgctatgcaccagaaagattgcgatcttgcgaagcacccctagatcgatgtacccaatttgcaggtcattaaactgatgcacagctccaagtccaaggaatatgtccgcgagacttttgcttggatgcactactactggtaccttactaacgatggaattgagtttctcagaacttaccttaatctttcatccgaaattgttcctgctactctaaagaaatctgcacggcccccggggaggctaggtaggccacctggggatcgccctcggggtcctcctcactacgaaggagaccgaccaatgcttggcgacagaca

SEQ ID NO: 2837 - DNA, 402 bp, Gossypium hirsutum
  Clone ID: uC-gsronu33B106h08b2
ctcgtgtcttgtctctcagtctgttatagtaaaagctggaggcaccaaaaaaaaaaaaaaccatgggaagatccatttcctgtttcaaaatcatcacttgcggcactgattcagctgataaaaacgacgacttatcgatgttcctcaggacaagagatcgagtgacaaaaagggatggagtttccggaagagatctgaacggcatcgggtgcttagcaacactttggtacaagaagcttctactggactggaggaaagtcctgaaactgctagttatgttcaacagtctgatgtctccgttgctcctgagaaaacctccaccgttcagtacaccgaagagaaacttcagtcagtggcaccaaaagattacgttgaagaaaaatctcaattattgacccaaga

SEQ ID NO: 2838 - DNA, 512 bp, Gossypium hirsutum
  Clone ID: uC-gsronu33B106h11b2
cttttctcctttttctttttctcagacaagatgggttctcagggatcggttatggctatgcttttgctgatgatgttcactttatcatcagcttccgacatgtccattatatcctacgatgaagcccatcccgacaagtcaacgtctagttggagaacagacgacgaagttatggccatgtacgaggagtggcttgtaaagcatggaaaaacatacaacggtttgggtgagaaagagaggaggctccagatttttaaggataaccttaggttcatcgatgaacataacgccgatgagagtcacagttttaaggttggtttgaaccgctttgctgatcttaccaacgaggagtaccgagccatctacttgggaatcaagaaacccaaccggaaagtttccaaggccagtgaccgatacgccccgcttctcggccaaaagttgcccgattccgttgattggagggaaaaaggggctgtcgctgaagtcagagatccaggaagttgcggagttgc

SEQ ID NO: 2839 - DNA, 464 bp, Gossypium hirsutum
  unsure (1)..(464): unsure at all n locations
  Clone ID: uC-gsronu33B107a01b1
gcgtgcctgttcatcatttcatatttgccttcctaacagtcgcattctgcgccacttcttcagtggccgccgccgccgcttcaaaggagcaaactttaaacacccaagatgctgaattctttaacccaaagcttgccccacgaacccttgcatcctccaaaaggttcgaaggctcgtcgaatcttgtcgaccttcgttaccatatgggtccggtcctttcttcttcgccgataaacatttacctcatttggtacggtcgttggtccctttcccaaaaactccttatgaaagactttattacctgtatatccccttccgccactccttcgccgtccccttgcgtttccgagtggtggaaaaccgtttctgtttacaccgaccagaccggagccaacgtttcccggactctcgttgtagctaaagaacactcctatacngcgttactcccatgggtatcacctcac

SEQ ID NO: 2840 - DNA, 477 bp, Gossypium hirsutum
  Clone ID: uC-gsronu33B107a02b1
tcgctatcgcctgtggacgcgtgcgcccacgcgtggggccactcgtacggccacgtgttctgggacacctgggtgacaaggcaatgactacaggttagatctacatgattgtggaaaggcttgctgattatatcatagaccagtggtgtttgattactccgtgaggagccataccggttgtactatcttcctggctgtcttctatacagcagtggatctagcaccacctctaagatgttggtgtctgtaattatatcctagtattactagatttaatggaagcttgaacctgtttcagaaacaataggcttgtggttccgcatagtgataatgcttggtgatccttttgctttgtggctgtgcatgcttgatggatggtattgtcaagattgtggagtgaggtactttctctaaatttacaatagatagttctactcgttgtgtaggtctaccgtggtaggctttcaattgaaattt

SEQ ID NO: 2841 - DNA, 318 bp, Gossypium hirsutum
  Clone ID: uC-gsronu33B107a04b1
ttttactcttaattttgctttttgttttggattgggtctggtgaatcagagaaaaccctacctttttttttctcttttatttctttgaattggaacgatcaaaagaaggaatgggtactgaaggatcgagggttgttgtgccaaggaactacagattgcttgaagagcttgagagaggtgaaaagggaattggggatggaactgttagtgatggaatggatgacgctgatgatatagacatgcagtaatggactgggactattatcggcccgcctaacactgttcatgagggacgcatctaccagttggggctattct

SEQ ID NO: 2842 - DNA, 447 bp, Gossypium hirsutum
  Clone ID: uC-gsronu33B107a05b1
gcgccctaatcctccccctttattcgaatctcaaaaggccctagccgccattagaccaccccgaacggcgatcgacgaagggagattcgttcactcactaacccggcttgggtcctaagccctaaagacctccgatttcaggcttcaatccctgtctcaacttcgattaaagcgaaggagatgaattccggcggttcgtttgtataggtaaacccctttgcttcccttcaccctttttatgctcgaaataacagtatgtggcatcgaaaaataagaaaagaaaaggaaaacagacaggaaaggagagccaatgccgaataatcacctttctttgctttttctttgtattcaatatgtgaactcgatatctgtgttgtctattgcgcataaaaaattacaatgaataaagactctggctttataagccaaacagaatcagaaagatcc

SEQ ID NO: 2843 - DNA, 381 bp, Gossypium hirsutum
  Clone ID: uC-gsronu33B107a06b1
gtctttgcttcatccagaccagagagttgaatatgaacggggtacctttaacaatgacttgtgtggagaacgctgtgatgagcccactatcatgatccttaatctcaaaggccatgccccagatacttgaaaaggggggttacaccttgttcacaccacattacataacttggtattgtcctcaagcttttatattcagcagtcagtgcaagtctcagtgcataaaccatggaagatattgtgcccctgatccacaacaagattttggagaggggtatcaaggaaaggatgtggtgtttgagaacttgagacagctgtgcgcgcacagagttgccaatgagagcaacaggccttggattttgtgggactacgtcacagatt

SEQ ID NO: 2844 - DNA, 447 bp, Gossypium hirsutum
  Clone ID: uC-gsronu33B107a08b1
gcgccctctcgtgcgcccacgcgtgcgcccacgcgtgggcccacgcgtgcgcccacgcgtcctcggacgcgtgggtgacgagccaatgactccaggtcagtgcaacatgattgtggaaaggcttggtgattatctcatagaccagggtctttgatcactttggtgtaaccttaattgttgcaattcttcctggcttcttctatacaaaagtgcatctaccaccacctcttgtaatggttggctgcaattaaataatagtattactagtattaaagtcgtgtggaaccttttccagaaacaataggcttggtgtttgtaatagtgataatgcttgtgatccttttgctttgtttctgtgcttgcttgatggatggtattgtcaagattgtggagtgaggtactttgtctaaattttacaatgaattgttctagttgatttggtaaatc

SEQ ID NO: 2845 - DNA, 384 bp, Gossypium hirsutum
  unsure (1)..(384): unsure at all n locations
  Clone ID: uC-gsronu33B107a09b1
tttctctcgtccggatgtctgacctaatggtctggggtgtgttctgatacaggatgcaaaggtaactgcctatgcttatcgacaacttaaaccacacgagaagaactgttctacacatgatctataattggaagcaattatatatgccttgcagatttgtagactttacttatatggagagaaatgtcatattttcacatatctgacaacgtctaaaacacatgctgacacagaatgagttaaatctgaaacgtaaatggctcgaattgactaaatattatgatttggttattaactaacattcangtaaagctaacgtggtagctaacaccctgagtcagaaatctctgttaattttgaaagaaataaatactcatttgatcc

SEQ ID NO: 2846 - DNA, 271 bp, Gossypium hirsutum
  unsure (1)..(271): unsure at all n locations
  Clone ID: uC-gsronu33B107a10b1
aataagggaggctttggggttgaaggtacatggtttatgcttacaagtgctaacagaaatgaattgttctgcattttaatgcttgcttatatttaaagcctattattgtactacgagtagtgtaataaaaggtcatctcaagaagctattcaaacgaaatatggtttatttgaagagaaggattcactgtgtttatcaagtttgataatcatagaactgacatttaaacccngaaaataaaaggtgaactgacaggaaaggggaaccaatg

SEQ ID NO: 2847 - DNA, 382 bp, Gossypium hirsutum
  Clone ID: uC-gsronu33B107b01b1
gcgctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttatttgcaaggatgaatgcctgcaaggtctatgactataattatgtctctgtctgc

SEQ ID NO: 2848 - DNA, 417 bp, Gossypium hirsutum
  Clone ID: uC-gsronu33B107b02b1
gctggctcgcccgcctgtacgggcccggactgactgggtggaccgacgcacgcgccctcgcgtacgggatccgggggacgaactcctgcggcgagcgcatgcagatcggagaccatgtacactgggcttgttgtaaccatagagagcctcctttgcggaccagatcatatgctgcgaaggatgaaccattctgctcagacgagggagcccttgatacatgctggagccaaagcactagtatggtctgggctagcctgctaatgacgtgactatgagcattgctgattactaggcccatcagagaccgagcacctaatcctacagaccatgatgttagccatgtaaacgtgagctttgacttcatagtctttggcaaaaccaccttcactactggagtggatcctgatcaatttggtt

SEQ ID NO: 2849 - DNA, 444 bp, Gossypium hirsutum
  unsure (1)..(444): unsure at all n locations
  Clone ID: uC-gsronu33B107b04b1
cttcaatggcatttcatccaccacccgttatgccggtgccatgggcttcatggttgacgagcctgaagcaggctgtgctgagatgatgaagatgtatcaggaggatgaggaggatgtctagtgtgttgttttggatttatttgcatatgaaatatgatgttgtctgctatttgttatgtgaattgctccgttatttctacgtttagaggacttctataacttatttttcttacaaattctattaccaattatataaacctaagctatggcttctatctcggaagtatttttttgggtaattgatgttgtttcaacttgatgaaactgctgtttatttagcaataaggtacattagctatgagttgtattatttaacatatnacaagatacttttaaattgaagaagattatagtatttttaattttacttaattttcttttttt

SEQ ID NO: 2850 - DNA, 430 bp, Gossypium hirsutum
  Clone ID: uC-gsronu33B107b06b1
atcgcgccacgcgtccggtcttccccttatgctgccatgcttgcggcacaagatgtttctcaacgctgcaaggaattgggtattacagcccttcatataaagcttcgagctactggagggaagcaaaaccaagacacctggtcctggcgcccagtcagcacttagagcccttgctcgttctggcatgaaaattggacgcatagaggatgttacccccattcccaccgatagtactcgtagaaagggtggcagacgcggaagaaggctgtgattctgtgcttcatatctgctactcagccgctgctggtggcggtttgacattaggaattctctgttgcttttgaaacacttctctgattagattcaagtttgctttgctctgattcaggtgcacacttgtagctcctgaatggatgtgatcctagatctt

SEQ ID NO: 2851 - DNA, 394 bp, Gossypium hirsutum
  Clone ID: uC-gsronu33B107b08b1
gatgaatcggatttggtgtcggagttccgggatctaccggctaagttccagcaaacacttataccggacttggagaaaatctcgacaacctcgaaagtttacatcaacatatacagcaaagagttgaccaaacagttcaaaccatatgtcggcaacaaacatgctcccaccattgctactgtaatctcttgtgctttccttttaatgccgttactattagtttccctcatttttaaccgcatcaaagcttatttttcactccaaaagattctcatcttcatccaagtttacctgtcgatttactttataatcctttgccttacctccctcgtcactggacttgatgccgttaagttcttttacgccactttgtcgtggacctacaggggtttac

SEQ ID NO: 2852 - DNA, 448 bp, Gossypium hirsutum
  Clone ID: uC-gsronu33B107b09b1
tcctaagtcggaaaggggacttaagatgtgatgtgctatacagcttgcttatgctgtgactaggcatgggagaagaaagaagtaatgctcagaaagccaaacacactagtgagccaacgtatatccaagactacgaatccttgcactatcaaaagatggaaaactgctgattcgttagagacagaaaaacttgaataaggcatacaagattgtgtgatggagataattaagaaacgagaagacaaacttgtgggtggagaagctgacagctctggtgatgattatctgggattactggtgaatgcttatcatgattcgaacgataaacacaagctttcattagaagacttagttcgtgaatgcaaaacaatctactacgctggccaatcaactcttaattcattgcttagatggatagccctacattacgcaatccatggagattggc

SEQ ID NO: 2853 - DNA, 466 bp, Gossypium hirsutum
  unsure (1)..(466): unsure at all n locations
  Clone ID: uC-gsronu33B107b10b1
gcgcccacgcgtccgcagacgcgtgggacagtgcatgggggagtgggttcttaaacaggactacatccataccagaaagattcttcttacgaggcaatctatctacagtacgggctttaaggggggccaaaagcatcatggggatttaagacaagggcaacgagttcctatgaacctaaaagtcagattgatgatgagatcgctagggaaaatccggtggttaaagcggccaagataattaaagtctgatatatattttttttatgaaatcctattaaaatcatattattcggaaacatttttcgacccggaattcggaacagctatggaaattcaacctcgatctcatcatcaatccatggagggaagatgacgacatatctcacaagatcgtttcaaattgaagaagattatagnaattttaaatttacttaattttctttttttggaaaaaaaaaaagaaaag

SEQ ID NO: 2854 - DNA, 402 bp, Gossypium hirsutum
  unsure (1)..(402): unsure at all n locations
  Clone ID: uC-gsronu33B107b11b1
gtttgcctattgaaccnctatgcttcactgtctcgagaaaaaaaaaatgtcttcaggttgcaattgcggatctagctgcagctgcggatctggctgcaattgcggtgagaactgctcaatggaccttaaccttggatactcggagaagacaaccagcactcagaccatcatctgcggagttgcgccagtgaagatgacctttgagggaccagagatgggcactactgaatcaggacatggatgcagctgtggatcaagctgcaaatgtaatccatgcacctgttgaaaagcttgatgaaagccatatatcattgaaaaagaaagcagcataataacaggcctctgtaatgatttattttcaaggatggatgcctgcaaggtctataantatgnctctctctg

SEQ ID NO: 2855 - DNA, 297 bp, Gossypium hirsutum
  Clone ID: uC-gsronu33B107b12b1
cggtcgcgtgggaaataatacgactatatttgttggtaatttggattctaacgtgactgaagaccatttgagagaggtcttcagcccatatggtcagttggtgcatgtgaagattccacaaaacaagcgttgtggatttgttcaatttgctgataggagttgtgctgaagaagcactccgaatactgaacgggactcagttgggtggacaaagtattcgggtttcatggggtcgtagcacatcaaacaagcaggcccaagcagatccaaaccagtggaacgctggatattatggata

SEQ ID NO: 2856 - DNA, 468 bp, Gossypium hirsutum
  Clone ID: uC-gsronu33B107c01b1
gttttacctgctggaatttatcatcgctttactctggatacagacaactatattaaggcaatgcggctctttgttggtgatccaatttggactccgtacaatcgtccgcacgatcatcttcctgcaaggaaggagtatatcaagaactttttgcgggaggaaggtggtggccaagccgttgatgctgccgcataaaatcaacattcatctggtggtggccaagtcgttgatgctgccgcataaaatcagcattcatctctggtatcgtgtcttataaaatatgaaaccccggatttgtggtaataaataagtctaggcttgtctgcttttgatgcgtggatatggatcgtattggatgttgcttgctatatattgcctattccatatcgaaaattcgcaaacttgctatgtatttctacattgtatgtgcttactaccagattggctcttaataatcaaagtttacat

SEQ ID NO: 2857 - DNA, 269 bp, Gossypium hirsutum
  Clone ID: uC-gsronu33B107c02b1
aggctgttcgcaacgcctgcttgcacgaacaatgccgattttcatattgctaagccaatgactagacctggtgggacggcagatcccatgaagtgtacaaggacgaaccctagattagcaggaactgatggggaagctgcaatactgtgccgatacgctccattagatgcaagacaatgcaaccatgccgttcacatgctataaatgtcacatgactctgttacacccagcagtgtatgcatacttgactggatgcctttactctctaa

SEQ ID NO: 2858 - DNA, 333 bp, Gossypium hirsutum
  Clone ID: uC-gsronu33B107c03b1
atgcgtcctgcctttcactacagcctgatcttagagaggtgctcgactcataactagtttagccggctgcccacgagagctggtgtccgcaccatcaacgtggaacagacgctgccctaaaaggccatacccttatgcccagctgtctacgagatgcatctctatgcaaccacgcagagactgctctcaacaacaaggcatccgaggccaatgacaggataccacacttggactgatccggagactccatacccaattaatggctgcctactgccagaccccagaatgccggaatgattgattaaaatgagggggatctggatcacgtccaag

SEQ ID NO: 2859 - DNA, 214 bp, Gossypium hirsutum
  Clone ID: uC-gsronu33B107c07b1
gctattcttgaggaatgcttgatttaaaaaactagggatacagacaactatattaaggcaatgcagaatataagaaggagaaccaatatggactccgaacaatggggcggacgatcatgaggatccaaggatacgagctctgcagaacactttgtagctggaatgtggtggcccctaaattgaatgtactcggccaaaattaaacaacgatctg

SEQ ID NO: 2860 - DNA, 506 bp, Gossypium hirsutum
  Clone ID: uC-gsronu33B107c08b1
ggctgctcccagatccgtcttccaccgacaatgccgagtttcagattgttttgacgataattagagatgggttgaaggcagatcccaagaagtatacaaggatgaaggagagattagttggtgtttctgaggaaactacaaccggtgttaagaggctttatcagatgcaggccaatggaaccttgttgttccctgctattaatgtcaatgactctgtcaccaagagcaagttcgataacttgtatggatgccgtcactctcttcccgatgggttgatgagagctaccgatgtcatgattgctggtaaggtcgctgttgtctgtggttatggtgatgtcggcaagggttgtgctgctgccttgaagcaagccggtgctcgcgtcattgtcaccgagattgatcccatctgtgcccttcaggctctcatggaaggacttcaagttttgacccttgaggatgttgtctccgaggctgatatctttgtcaccacgactgttacaaggaca

SEQ ID NO: 2861 - DNA, 440 bp, Gossypium hirsutum
  unsure (1)..(440): unsure at all n locations
  Clone ID: uC-gsronu33B107c11b1
gatgttcttcccgctcggcccaacatctactgctgtatatggtggaattagtgcgttgattttctgtgggtacatagtatatgacaccgacaacctgatcaaacgcttcacatatgatgattacatattggcctccgccactctttatttggacatcctgaatttgttcatttccattttacgggttctgagatccggggataactagttatacaatatttctcacaaggccagtcggaaagatttcaaggtatggcgaacgagttattgtctgatgaataggaaaaatattagtctatatagtataattgctagacttggcaattactgtattncgactgcatttgtgtattttctcttgttataatcatgttctatttacttatttgatatcgtgtaatcatgttgctagatctaatcttttcttgttgtgttttacc

SEQ ID NO: 2862 - DNA, 160 bp, Gossypium hirsutum
  Clone ID: uC-gsronu33B107c12b1
taataaaaaaaaaaaaaaaaaaaaaaaaaagagggggtgtggatatattttttttttgcataaaaaaagatgagataaaatgatagaaaatgtattatgtggatgagggtgatgttttttagagttgccatggttttacacccttgtgactggggaaacc

SEQ ID NO: 2863 - DNA, 362 bp, Gossypium hirsutum
  Clone ID: uC-gsronu33B107d01b1
acgcgattgtgattccgcgaccgcaagggacgggagccgggaaccttttaaaaccatcatcagtataagacacccacaccgcaggacacactgcccacaccggaaacagcacaatcatgggaagagatccacgccacagagagggactgactgatgaggccaaacagcaaaccggcgatagccctaagccccaaggaggagcgccagaatcagaagcacggtcaagcgggtccaggaactatgtggaccacactgtcctagagggatctgaaaatcaaggaactcatgggaagtctacaaaacggaaccgggaccaccaccaaaggaaacgaatatgagggctacagccggaggaaccaaaa

SEQ ID NO: 2864 - DNA, 532 bp, Gossypium hirsutum
  Clone ID: uC-gsronu33B107d04b1
gtaaagccttagagggtttgcatggggtgcaagtgtttgctcattcacaatctgcattagaggagattaaccaacaaggggatttccaatccagtcatgataaatcattcattacagcaaatcaaccactattgatgcaggtatggcaacagagaccagcttgtttaaggcctgtaagatgttgtatgcaagaatcttgtggagacagttgccaatgtgttgacatcactcccctttattgctcttgggatccaggcccctaggagaaattttaatactaagctgtatgctaattcacttattggagttggagttgcctctactttgtatcattcttctagaggaaagctgaggaaatacttaaggtgggcctactatacaatgatagccactgccctgtgtgtttatcaagagctattccgaatgagaacccaaagtactaatggcagctaccgctttacttctaccagttcagcctttaatggcttcggctattcacacttgaatgatgaggtagcatttgcgaaagagc

SEQ ID NO: 2865 - DNA, 515 bp, Gossypium hirsutum
  Clone ID: uC-gsronu33B107d05b1
cccacgcgtgcgcttgaccaagaacgaagatggtgtcactctttccgcccttagtctcatgaatcaagacaaggtccttatggagagctggtactacttgaaagatgctgtgctggatggtggaattccattcaacaaggcctatggtatgactgcatttgagtaccatggcactgatcctagattcaacaaggttttcaacaggggaatgtctgatcactctaccatcaccatgaagaagattctcgatacatatgatggtttccaagggctaaaaacattggtcgatgttggcggtggtaccggtgccacgcttagcatggatcgttctaagtaccccaccataaaaggcattaactttgatttgcctcatgtcattgaggatgctcctagctgtcctggtgtggagcatgttggtggagacatggttgtaagtgtaccaaaaggagatgccattttatgaagtggatatgtcatgattggagcgacgaacactgcgccagtttttgagaact

SEQ ID NO: 2866 - DNA, 171 bp, Gossypium hirsutum
  Clone ID: uC-gsronu33B107d06b1
gtttgcattatttggtggaccgaaccttagtattatgcgggtttgctctgcttttttgttcagtagtgctgggttgttaacgtcaatatttttatgctttgtgctttctttcgaacaaaactggaagattcgatgttatttttgctttttctgattgactaattttttagg

SEQ ID NO: 2867 - DNA, 479 bp, Gossypium hirsutum
  Clone ID: uC-gsronu33B107d08b1
tgtttaattcagattattgacttcagaagtgatatcaaaaacagctttcggtagcaattacttggaaggggagaagatttttgtcatgctcaaaaagttgaacatacttgtgagccgaaatatttccaagactacgattcctttcactaacaaattatggaaatctgctgatttgctagagtctgaaaaacttgaaaaaggcatacaagattgtgtgatggagataattaagaaaagagaagacaaagttgtgggtggagaagctgacagcttcggtgatgattatttgggattacttgtaaatgcttatcatgatttgaacgataaaaacaagctttcattagaagacttggtaggtgaatgcaaaacaatctactttgctggtcaatcaactcttaattcattgctgtcatggatagtcctacatttggcaatccatggagattgggcagaaaagcaagaagagagtgattgacata

SEQ ID NO: 2868 - DNA, 464 bp, Gossypium hirsutum
  unsure (1)..(464): unsure at all n locations
  Clone ID: uC-gsronu33B107d09b1
gtttgccggcactgtttcgatcaggggtcggatcttagctggtacttgccatagtgctaagatgattaggacaatcattgttcgacggaattaccttcattatatcaagaaataccaaaggtatgagaagaggcattcgaacatacctgcacatatttctccatgcttccgtgtgaaggaaggggatcatgtcattattgggcaatgcaggccattgtcaaaaaccgtgaggttcaatgttttgaaagtgattcccgccggatcttccggcggtgggaagaaagccttcactggaatgtaagctgcgagtgttattctgtgtttttgtctggggtcgtaggagcctatgtttcactgttagatttcttttgttattgtttttctttccatttactttatatgtttggatgctgacatctggaattgtgaagatatcacttgaatatgctngaatttttgcaaac

SEQ ID NO: 2869 - DNA, 516 bp, Gossypium hirsutum
  unsure (1)..(516): unsure at all n locations
  Clone ID: uC-gsronu33B107d10b1
tcccacgcgtccgaaatgataccatgatcttgaaaaaaactctttcttgttcatacccaaacatgcgttttaatgaagcgctgcaaaaggaaaatgaaaagcttcgattggagctacaacgttcgcaagctaattacgatgtgaagcagtgtgaagtaatccagcatttgcttgatgtaacggaagttgcggcttctattcccgataagatttcatccccaaaagtgtctaagaaagttgagcgtaattactcagatgtcgataatgaaaacggtcattcgtacaatgataactctcctaagaaacctgattctcgcatgacttcaagaaacacttcttcagtttcatcaggacatgatctactctccgatgaggatcacatcggtatgaagaatggaatgctgattgctcggttgttgctcggaaccatctctgtgcataagacattctntatgcttgtggtacgtttcaaagattgtaccgttgcaacaaacagcatatgtcttctgctgagca

SEQ ID NO: 2870 - DNA, 464 bp, Gossypium hirsutum
  unsure (1)..(464): unsure at all n locations
  Clone ID: uC-gsronu33B107d11b1
tcccacgcgtccggtcagtggcaacacttcacattgatggcataagcttgatgccggcggtcatctatcacattcatttgaattagaggccaaaaggaagggaatgtttcatggtgctccagcagtcatatatttccgaattcccaccaaggctgttcaacaggaggcgtattcaactccaatcttgcccttagatatccttgaggaaagaccgcctgagaagaagtttgagtgggctaagaggttgatggctaagtatgggtctcaaatctccgtgatatcaattgtggttctgttcatctacctgataataaccccatcaaaagcaagcaagaagaagcgctaaaatagagtgcctccatttaatgcacaacatcctttcnttgctagtttctgtttgcagttaaaatagggtctttggctgtgtctggattttctaatgagattagtgaaagatggagaga

SEQ ID NO: 2871 - DNA, 540 bp, Gossypium hirsutum
  Clone ID: uC-gsronu33B107e01b1
gagtctttttataagcaagtccttgactgcaagcgagggttctgcatcaactccggctgccagtactatgggagaattgtccaatgatcataaaaatgggaagagacgcaattcttttagttcaacaagacctgagaacattgatgaggagccaagggatagtaacagtagcaatcctctttcgcgtgtcatgcaagccacagaagctgcaagagctaaagttaatacaaataactcaccaggatcaagtgcagatgtgcaagatagagacatttatatcaagaagagacattccttaccaggtgcaaatgggaggcagggttctgcaagaatccatcgatccttatctcgagcccagcagggtgcaaaaagaaatggtaccaatcctactcaggagagaagatggcaaaggtgaaggcttatctggagtaccacggcattgaaccctatagattgagatgcgcgttgaatgctgtgcttaatatctagttttatcccattgatttcatcacatcatttgagatatatagatatttatag

SEQ ID NO: 2872 - DNA, 544 bp, Gossypium hirsutum
  unsure (1)..(544): unsure at all n locations
  Clone ID: uC-gsronu33B107e02b1
cccacgcgtccgggctactctagattccgatgtgccgatggtgcccgccggtgaagcttccggtagctccgccgcgtcttcctctactaagaagcccaagcgcttcgagatcaagaagtggagtgccgttgccctctgggcctgggatattgtggtggataattgtgcaatttgcaggaatcacattatggatctctgtatcgagtgccaagctaaccaagccagcgccaccagtgaggaatgcactgttccttggggggtctgcaaccatgcatttcacttccattgtatcagccgatggctcaagactcgtcaagtttgcccattggataacagtgagtgggagttccaaaagtatgggcactagagagctgtcaggccaatactggttgaaccctcttacctttctggtatggtgagagaagaatgcatatatttcattagctnttatgctgattcaaacagtagttgctttaatatttcagagtagaatgtggtcataattctatttgcaccgagtgaatatgctatatttatgagaata

SEQ ID NO: 2873 - DNA, 551 bp, Gossypium hirsutum
  unsure (1)..(551): unsure at all n locations
  Clone ID: uC-gsronu33B107e05b1
gaagcttctcaggcatcttagacatgagaatgtgattgctttgaaagatgtcatgatgccgactcataggagaagcttcaaggatgtttatctggtttacgaacttatggataccgatttgcatcaaatcattaagtcttctcaagtgcttaccaatgatcactgtcagtatttcctcttccagttgctccgaggcctgaaatatcttcactcagcaaatattcttcacagagatctgaagcctggaaaccttcttatcaatgcaaattgtgaccttaaaatttgtgactttggactggcacgcactagcaatgccaagggtcaattcatgacagtagtatgttgtcactcgctggtacagggcccctgagcttctgctctgctgtgacaactatggaacgtctattgatgtttggtctgttggatgcatctttgcggagcttcttggccggaaacccatcttncctggtacagaatgtctcaatcaactgaagctgatcatcaacatccttggcagncagaaggaggaggatctngaatttatagataac

SEQ ID NO: 2874 - DNA, 314 bp, Gossypium hirsutum
  Clone ID: uC-gsronu33B107e07b1
gcttcatttttaagagggggaaaggttgaagtcgagagtcataagcaacatcaagggctccttcaactctgacggctgttgcggaagagaaaaccttgcaggcaagcttcgttcgtgatgaagacgagcgtgctaaggttgcttacaaccaattgagtaatgatctgcctgtcatctctcttgctggtatcgctgatgtcagatggcaagaggggcgagatatgcaagaagattgttgaggcttgagaggactgaggggacttccaagacgtggatcatggggctggtactaaactaccgtgcgcaatgacccg

SEQ ID NO: 2875 - DNA, 482 bp, Gossypium hirsutum
  Clone ID: uC-gsronu33B107e08b1
actgcattcaggcttcttactataaggcctgatgaacgtgttgatgtgatgtttggaaacatcaagcatgccttcttccagccagcagagcgagaaatgatcactctggcgcactgtcattgacataatcacatcatggttggtaataagaaaaccaaggatgtgcagttttatatagaggtgatggatatagttcagacattgggtggtgggaacgagatctgcctatgaccctgatgagattgaggaagagcaacgcgagcgtgaccgaaagaataaaattaacacggacttccagaactttgtgaatcgggttaatgatttgtggggacagcctcaatttaaagcatttgaccttgaatctgatcagcctatgagagagcttggcttcatggggttccccataaagcctctgctttcattgtgccaacatcaaactgcctggttgagctaatagaagactcttttggggtgatcaccct

SEQ ID NO: 2876 - DNA, 428 bp, Gossypium hirsutum
  Clone ID: uC-gsronu33B107e09b1
tggtgtcaggccctgaggtctgcaaggaccagcaactgtgtgaaaccatgatcagtgatgagagtcatatcgtatgggacaaggcactactactatcccgacacatggtggtgtcatattgctgccacagtgggggattgattgatgaggccaaagagcaaattggtgatagctctaagccccaaggttcagagccagaatcagaatcaggttcaagtgggttcaggagcttcttgcaccacactgtactagatgcatttgaatctcgaggaattcatgttccttctagattacgccaccgcgaccaccaccatgataaggaagaggtggatgacaggggagtgaatgcagactatgatgacagtggctacgtcaaaagcacatctctggccctctcaactctaattggaatgctcaaagcagaaact

SEQ ID NO: 2877 - DNA, 441 bp, Gossypium hirsutum
  Clone ID: uC-gsronu33B107e11b1
caaattttcccctaaaatggaggcacgaaagacgattcatctcctttgatgagagtagtagtgtgaggaatgggaattatcttctcatttgttgaaacctgaagccgtggagaacaagaagaggtcgcctaattcaaaagggagcaacgaagaagctatgctttcgtttacttcaggtgtaatcttaccttcatctggtgtggtgaaatcaagtgggggtgccggggattcagatcactctgatcttgaagcttccgttgttaaggaggccgatagtagtcgagtcgtagagcctgaaaagaggcctcggtgaactctgaagtgggcctattctcgtcgaggaacaatcgttgcaccttctccttcttcccgtttcgctgctaattcgcttttttgcccttttttgcttgtaaagtacaccaataccactctgtatttttt

SEQ ID NO: 2878 - DNA, 467 bp, Gossypium hirsutum
  Clone ID: uC-gsronu33B107e12b1
cccacgcgtccgcccacgcgtgcgcaaaaagggaagctaagagaaccctattagccatcttcctcctcctttccttcctctccatatcaaccgcaacatcaactcgaaaaacccgaacccgaaatccatgcaagagcatggtgtttcatttccacgacataatctacaacggccataacgcaaagaacgcaacatcagccattgtaggttcaccacaatgggggaacaagaccattttaacaggaaaaaaccatttcggagacctggttcgtgttcgacgaccccattaccttagacaacaacttgcattcgaaaccagtgggtcgagccaagggttttatatctacgacaagaaagacatattcacagcttggttgggtttcttcttcggtttcaattgtacccaaaataaggaagtataaacttcgcccgcgctgatcccggtgtgaaccagacgagggatatat

SEQ ID NO: 2879 - DNA, 359 bp, Gossypium hirsutum
  Clone ID: uC-gsronu33B107f01b1
cccacgcgttcggttttcttgaaaacaataactgcgcaactgcagacacttttgggaatatccttgatcgaaatcctatcaaggcattcgtcagatgaggtttatctggggcagagagccaaccctgaatggacgtgagacgaaaccccacttgcagcttttgatgaattcagaaagcggcttaccgagatagaggaacggattgtagagatgaacaatgacgagcaattgaagaaccgtgttggtcctgtcaatatgccatacacatttgtgtatccaactagtgaaggtggacttaccggcaggggaattcaaacagtggataatctaatgcatttatcttcaaactctttaacaaa

SEQ ID NO: 2880 - DNA, 344 bp, Gossypium hirsutum
  Clone ID: uC-gsronu33B107f02b1
acctcgcgttcgataggagcttacctaagtgctcatgaagggccacatatacttcgctctagaccacaggctcgtaatgcgccactgaaagcttctatgacagctacagatgaacctggatattacgaagatgggaccttagagataggactcgagaacgtactcgcagtcactgaggctgatactgaatacaatggagacgattagggatacttatcatttgagcatctcacttgggcaccatatcagatcaagatgcttgactcgcgcctgtagacacctgaggagattgcatggcagactacctgccattcaaaatgcacggcaattctggcaccatccat

SEQ ID NO: 2881 - DNA, 444 bp, Gossypium hirsutum
  Clone ID: uC-gsronu33B107f03b1
gatattgtttctaaccggttcatttacattcagtgagaatgggggtgtaaaaagcagaaccggtggtttgagtgtttcattggctggatcggatggtcgtgtaataggtggtgggcttgccggtgtactgttggccgctagccctatacagattgtggttggaagcttcatgctaaatggctacaaagtgcataaaaggaagccttaccgtgagcagcacacagttgcagcttctgcagtcgccaccgctccttcggccatggcgatggcagaagaaggaaggccaatcatctcacaagcaaaactagattgtgaaaacaacgtgaaaccaacatgtgctttccaagtggggagccttgaggaagcaagtaaaaacataactgatcataaaaacatagcaaatattgcagcagcctccattgattctggttggaacaatggctc

SEQ ID NO: 2882 - DNA, 533 bp, Gossypium hirsutum
  unsure (1)..(533): unsure at all n locations
  Clone ID: uC-gsronu33B107f04b1
ctcctcctggattccgaggggaaccgtgttgctgtcaaatattattccgatgagtggcccaataacagtgttaaggaagcctttgagaagtctttattttcaaagactcaaaagaccaatgctcgaactgaagcggagatagcaatgttcgagagtcatatcattgtgtacaagtttgttcaagaccttcacttttttgttactggggctgaaaatgaaaatgagctcattctggtaactgttcttaagggttttttgatgcagttggccttcttctaagagggactgtggacaagaaagaggcactggagaacttagatctcattttgttatgccttgatgagattgtcgacggcggcatcatcctagaaaccgatgcgaatgtcattgcgggaaggttgctagtcatagcatagatgcngctgctcctttatctgagcagacaataaagtaagcattggcaacttgttcggaacatttagcaggatctcttctcaagtgatgattacaaggggaagggagcaaagcaagag

SEQ ID NO: 2883 - DNA, 446 bp, Gossypium hirsutum
  unsure (1)..(446): unsure at all n locations
  Clone ID: uC-gsronu33B107f05b1
catttcgaatccaaggctgatgccggcgcctccaaaacctatcctcagcaagccggtactatccgtaagaacggctatatcgtcattaaaggccgtccctgcaaggttgtggaagtttccacctccaagacggggaagcacggtcatgctaagtgtcacttcgttgggatcgatatcttcactggcaagaagttggaagatattgttccctcctcccataactgtgatgttccgcatgtcaatcgtactgactaccaattgattgacatttctgaggatggatttgtgagcttgctgactgatagtggtgatactaaggacgatctcaggctcccaactgatgagaacttgttgaaacatatcaaggatggagaaggtgagggaaaagacctggtggtgtctgatatgtcggccatggnggaggagcagatctgtgctctcaggac

SEQ ID NO: 2884 - DNA, 321 bp, Gossypium hirsutum
  Clone ID: uC-gsronu33B107f08b1
gctttgtatattgaagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctggtcctccgtctgcgcggagggatgcagatcttcgtgaaaaccttgactggcaagacaatcactc

SEQ ID NO: 2885 - DNA, 377 bp, Gossypium hirsutum
  Clone ID: uC-gsronu33B107f09b1
tcttgtcatatgaccgcatgataagcattcagagagaatccgtaacctaaaagcaaggctcggctctgagggctgggcacgggtgtaccagacccgaacccaataggtggcgcgcactgctcgagctgctcccgcggtgagagcatacacgactcgtgccggacgctggacgcactgtgaacgcgatccctcatagagccatccccttacgacgaacagtcgactcagaactggtacggacaaggggaattccactgtgtaatgaaaacagaacatagcgatggccctgctgatgctcacccaagtgatttgtgaccaaagctctgatgtcaagtgttaaattaaccagcccggtaacagggagaacatactcttta

SEQ ID NO: 2886 - DNA, 478 bp, Gossypium hirsutum
  Clone ID: uC-gsronu33B107f10b1
atttttccttttctttctactcttaactccacagcggacaggtcgataccagtttcactctttagcagctcgcactctttcgttgtttattgtacagaatgtttctcaaggtgcagatgccctggaatgtcataattcctgctgacagcttggatgccaaaggcttgatgctcaaaaaggcaatagtgatccgccttatggatgaatttgcttgcaagaaggccaccaaggatcgcggatatttcatggctgtaacaaccctagagagcattggcgagggcagagttagaccagaacacagggatgtgcttttccctgttgtcttcagcggaattacattcaagatgtacagaggagagattctgaagggggttgacataagatactaaaactggagtgtttttgaggtgtggaccaatccaaaacatatatttgtctcacataaaaatgcctgactaccactatgtgccccgggaga

SEQ ID NO: 2887 - DNA, 470 bp, Gossypium hirsutum
  unsure (1)..(470): unsure at all n locations
  Clone ID: uC-gsronu33B107f12b1
gaaaaaaagtgggggaagagagggttcattgttgtggtagggtttttcactgagaagaaactagaaacatagaaaccctttgcagatttgtttgttttcaacagttttaagctctaatactaacgaaatcgtaaatcatgcacgccccggttctcgttctaaaggattcgttgaaacgggagtctgggacgaaggttcaccatgctaacatgcaagcctgcaaggctgttgctgacattattcgaacaacattgggtcctcgatccatgttgaaaatgctccttgatgctntctggaggtattgttgttactaatgatggaaatgctatcctangcgagttatgatcttgcacatccagcagcaaagtcaatgattgaattgagccctacccaagatgaagaagttggagatgggacaacatctgtcattggtcttgctggtgagatgcttcatgttgcagaagccttta

SEQ ID NO: 2888 - DNA, 322 bp, Gossypium hirsutum
  Clone ID: uC-gsronu33B107g01b1
cttaacccttcgtgctgccaacttgcacacccatgcgaaaatgacaacccgcttcaagaagaaccgcaagaagcgcggccacgtcagcgctggtcacggacgtattggtaagcataggaagcatcctggaggtcgcggaaacgccggaggcatgcaccaccacaggatcctctttgacaaatatcaccctgggtatttcggtaaagtcggtatgaggtacttccacaagctgcgcaacaagttttactgccccattgtcaacatcgacaagctctggtctctcgtcccacaagacgtgaaggcaaaagccaacaaggacgct

SEQ ID NO: 2889 - DNA, 467 bp, Gossypium hirsutum
  Clone ID: uC-gsronu33B107g02b1
aggaaatggcatctatctcttccaataatggctactttgcaccggcttgctggacagctgctttctgatttgattgaccgtaattatttctacttgtttgacatggagtcattcttcacagctaaagcattgaacatgtgcatacctggtggtcctaagtttgagcctctataccgtgatatggagaaaggggatgaggactggaatgaatttaatgacataaacaaactaattatccggtcacctcttaggacagaatacagaattgcttttcctcatctttataacaataggcccaggaaagtaaagttgtgtgtgtatcacactccgatggtcatgtacattaaaacagaagaccctgatttgccagcattctactatgatcctgtgatacaccccataactaccacaaacaaagaaccgcgtgagaagaaatttatgatgatgatgatgaagatgattttgtc

SEQ ID NO: 2890 - DNA, 53 bp, Gossypium hirsutum
  Clone ID: uC-gsronu33B107g04b1
aaatttattttaaaaaataaaaaaacaaataaaggggggggtttaaataaaat

SEQ ID NO: 2891 - DNA, 487 bp, Gossypium hirsutum
  Clone ID: uC-gsronu33B107g05b1
cccatttccaatctccagctcccaaggtaaatatgccgatcagaaacatagcggttggccggcccgaagaggctactcaccccgatgctctcaaggctgctttggctgagttcatctcaaccttgatcttcgttttcgctggatcgggctcaggaatggcctttaacaagttgactgacaacggagcaaccaccccggctggtctcgtagccgccgctctagctcatggcttcggtcttttcgtcgctgtctccgttggcgccaacatctgaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctgggctgtacccgttttgggttgtcatcaagtgtgggcgtgtctaaccattggttttcaaatcgtgatgacct

SEQ ID NO: 2892 - DNA, 288 bp, Gossypium hirsutum
  Clone ID: uC-gsronu33B107g07b1
gcttcctcgcgtacgtccacgcgtacgcccacgcgtgcgccgaaatatgctggacaggtgctttctgattagaaagacccaaattatcgctacttgtttgacatggggtggggcttgcagatagggcccaggccatgtgcctcccgggggggacctaagattgagcctatataccgcgatatggacaataggggatgccggactgtttacaacttgagtgacgtaaacacactgattatccggacatctattacgtcggaatacatacccgcttttcctcatgtttat

SEQ ID NO: 2893 - DNA, 344 bp, Gossypium hirsutum
  Clone ID: uC-gsronu33B107g09b1
tccatctgcgtacgtccacgcgtccgggtttatgtgtattttggtttgcgtgattaatttcaaaccccaaagctatgatctctttgtttccaattcaattttaccagattatctctgctagaaaaaaaaatcttaggacacccttttttctgggtttttttttcttatcaattctcatggaagccatgtatcttgcatttcatcatcatttcttgagttattcttgtcacctatatgcttgcaagcgaacgatgttcatcacttttcttattatcccccgatctttcaagaaaaacatagaagagtgacgtgaaaccctgcaaagagcatgaaaacacgaagct

SEQ ID NO: 2894 - DNA, 284 bp, Gossypium hirsutum
  Clone ID: uC-gsronu33B107g10b1
atcctttttccctcctcgtcctcctcggcctgcttgccgcttggctcttcttatacttgttccgaccgtcggatcaacctctcgtaatcttcggccgtacattctccgatcgtgagacgcttggcatcttggtggtgctgacggtattcatcgtgttcttaaccagcattggctcgctcttgatctccgccatcttgtttggagttgccattgtttgtatacacggtgcgtttagggttccggaggacttgtttttagacgatcaggatcctgcaaactctgga

SEQ ID NO: 2895 - DNA, 448 bp, Gossypium hirsutum
  Clone ID: uC-gsronu33B107g12b1
cccacgcgtccggaccctttttttttttcttaggggtatgctttaagcaatgcctctgaagcgtcaccatttccatcaactgctgtaaacaccctggcaggtctcaatgaaatcaaggctttttactgaaatgtttatagttgtttgcatgtgaatatcatcatcatcatcacaatggttttggtgaattgaaacatgggaaatgaaatggggaacaacaacacttctgggtttcaagaagaaaataacacagttgacgataaatctgtacaagaatttgatcatgcagatggtttgaaaggacaaaatcaagtagttcaagcaattctagatactgattctcaaacagcaaataaagaagaaggcgagaaaactcaggaagatgctgctcgaacagattacgaaaaggaacaaaatatgaaagtgtggtatctgaagatgtatatgt

SEQ ID NO: 2896 - DNA, 415 bp, Gossypium hirsutum
  unsure (1)..(415): unsure at all n locations
  Clone ID: uC-gsronu33B107h01b1
gcgcccactcgtccgcccacgcgtccggatcttcctgccaatactctagtaagtgccgctggagaaacattcaagtatcaaatcttgatcattgcaactggttcaacggttataaaattgacagattntggagtgcaaggagctgatgctaaaaacatcttctacttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataangggatcaaaattataaaggggaacagtg

SEQ ID NO: 2897 - DNA, 458 bp, Gossypium hirsutum
  unsure (1)..(458): unsure at all n locations
  Clone ID: uC-gsronu33B107h02b1
attcttcacaaaaaagaaaagaaaaattacagtggggatggcttcccttaaagttgcagctcatgtacctgccccttctgaggatgctgagcaacttcgtaaagcttttgaaggatggngtacatatgagcaattgattatcgacattttggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacatagaggttcacatcaagccattgggttctcatggaaattgcttgcactaggtcttcacatgaaactgtcaatgtgaggaaggcggtatacgatctttacaagaaatcccttggaagagatgttgcgcaccata

SEQ ID NO: 2898 - DNA, 429 bp, Gossypium hirsutum
  unsure (1)..(429): unsure at all n locations
  Clone ID: uC-gsronu33B107h03b1
tccacgcgttcgaagacaaccagcactcagaccatgatctgctgagttgcgccagtgaagatgacctttgagggaccagagatgagcactactgaatcaggacatggatgcatgtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaggatttttgctgctcattcatggtgacttggtttatgggtttatcntgtgntggtaaaatcttataaaaatatata

SEQ ID NO: 2899 - DNA, 478 bp, Gossypium hirsutum
  Clone ID: uC-gsronu33B107h04b1
gcttcacagagcaagatcttgatgaacggatcatcaaacagcaggatgaagaggaagagcgaaagcgccaacgacgagaaagaaagaaagagaaaaagaaagagaaggccgcagaagaggaacctgaaattgatcctgatgtggcagctatgatggggtttggtgggttcggatcatctaaaaaatgatcgcatttgtttatgtatgattacatattgttttatttgactctagttattcaggcttttggtggttgactgacttgtaaggtttcccggttcaaaagggtagaaaagtaaaaattgctcaacatgcttcatgtcgtcttccagattccgagttcagtcatggaaaaattactaaacttgagcatctatggatgcatgggtagatctcctggcgcgtgacaatggtttatgacttaattatttaaaaaccatgcctgtttatgttatgccatgcagtatgctacttttat

SEQ ID NO: 2900 - DNA, 370 bp, Gossypium hirsutum
  Clone ID: uC-gsronu33B107h06b1
tgctctcttctgcacctggaatacaaaaacaaatggaaagggcctccacgtgcttttgctcccttacttggcagccatgattattccagagaagaaccgcagagaaatctgcaaatacctatttcaagagggagtttgctatgcaaagaaggattacaatcttgcgaagcaccccgagatcgatgtacccaatttgcaggtcattaaactgatgcagagcttcaagtccaaggaatatgtccgcgagacttttgctgggatgcactactactggtaccttactaatgatggaattgaagtttctcagaacttaccttaatcttccatccgaaattgttcctgctactttaaagaaatctgcaaggccccc

SEQ ID NO: 2901 - DNA, 420 bp, Gossypium hirsutum
  Clone ID: uC-gsronu33B107h08b1
ttcctccgtccggaactggacaataagaaggcggtggatctcggtggcttgctaaaactcattcttaaaaagatggctttgcagttgaataaccccccattcaattttatgatccatacttcaccaatacaggttactgactctgagttaccttatagtcactggtttttacagatgatacctcagttaaccggtgtaggaggttttgaactcggatctggatgttacataaaccctgttgttcctgatgatgctgctaaaattttgagggaacttaatgttcctatatagggattaggagctgattaacatcatactagtactgtgaaatcatattgcaataagacaatggttcaaacaatgtgcgtgaggaaatctcttgtaaacctatttaagccaaagctttctaattttatctat

SEQ ID NO: 2902 - DNA, 388 bp, Gossypium hirsutum
  Clone ID: uC-gsronu33B107h10b1
tgaacgaattggccctcgatggtgttggacaatggcggtcatgcgaagaacaagggtctgactccagaagttgtaaacaatcaaacgggcgcttttcttcataggttccagtggctcgaagatgatgaaatcggatcgatcccgtctatttggaatttccttgaagggcataacaaggttgtcgagaatgactcataaacgtttcctaaagccatacattatactcgtggagggccatggtttgaggcatggaagaattgtgagtctgccgatctttggctgaatgagatgcatgactacatcgaagaaacgaagttgaatggcagttaatcagaatcggcatggtgcagtggtaatgtcctattacatgtcaattgattcatgctcc

SEQ ID NO: 2903 - DNA, 405 bp, Gossypium hirsutum
  Clone ID: uC-gsronu33B107h12b1
cggacgcgtggggggatcgacactaatttcacagggacatcaaagacaacagatgatgaagagtttggagaattgtacaccttcaaatggactactctcctcattcctgcaacaacagtgttaataattaacctagttggagttgtagcaggcatctcagatgccataaacaatggataccaatcttggggaccactttttggaaagctcttcttctcattctgggtcattgtccatctgtatccattccttaaaggtctaatggggaggcaaaacaggacgcccaccattgttgttatatgctcagttctgctggcttcaatcttctccttgctttgggtcagaattgacccatttgtgttggaaacaaaagggtccagacaccacacaatgtgggcatcaact

SEQ ID NO: 2904 - DNA, 454 bp, Gossypium hirsutum
  Clone ID: uC-gsronu33B108a01b1
cccatgctaacgcccacgcgtccgcccacgcatccggagcaaatataaaaaatgctggggtggtctagacaggtttactttcaatggtctcagctgttcatggatatggtggtggatggactaatgctcatgctactttctatggtgggagtgatgcttcaggcacaatgggtggtgcttgtggttatgggaacctgtatagccagggatatgggacaaacaccgcagctttgagcacagctctgttcaacaatgggcttagctgtgggtcttgctatgagattaagtgtgtgaatgatggcaagtggtgcctgcctggttccattgtggtcactgctaccaatttctgccctccaaacaatgctctcccaaacaatgctggtgggtggtgcaaccctcccctgcaacactttgacctttctcagcctgtctttcaacacattgctcagtacaa

SEQ ID NO: 2905 - DNA, 538 bp, Gossypium hirsutum
  Clone ID: uC-gsronu33B108a02b1
cccatactatcgcccaaaccaccagtgtatgaaacctggagaaaaacctacaatgtacggggtgaaccaccaaaaccaccggtttatacacctccaaagaaagagaaacctgaacccaaaccaccaatgtatgaacctccaaaaaaacctccaatgtatgaacctaagccaccgaagccaccggtttatacacctccaaagaaagaaaaaccagaacccaagccaccaatgtatcaacctcccaacaacccaccaatatatgagccaaaaccacctaagccaccagtttatgcaccaccaaaggaagaaaagccaaaacctaaaccaccagtttatgagcctccggcacatgagccaccatacggtcactatccaggacatccacctttggggaagcctcaatagaatgctcccatcgactagccattcccaacaattgagctactagaaaaattagtatttataataagaggaactgccggctgatgttctgttttattcttgtatggaatgtagtaatgttttctttcatgtttga

SEQ ID NO: 2906 - DNA, 417 bp, Gossypium hirsutum
  Clone ID: uC-gsronu33B108a03b1
gtagattttaggaagaaggatatggccgcaagaaacatggggatgactacagtgatgatgatgatgaagagaagcgtcaccaccaccgctataagcaccaccaccataagcgccacgatgactatgacgactagtcagactggccattccctctacaaatggaaatctgcagtaatagctattaaataaatgatcgaggcatgccacctttgatcgtttcttctaccatttccgtgtgctttttgtgtgtgtgtcagtgtttgatcgtcaataaaatgcccgaacattagggttagcgcaattgcgcttgttgattatcaatctgatgatgataatatactgccatgatctacttgcatgttaactacttaatgcttatgatataataaaatgcttacgcatgtgatgttcttgctt

SEQ ID NO: 2907 - DNA, 336 bp, Gossypium hirsutum
  Clone ID: uC-gsronu33B108a04b1
gaaagttttatctcctatgacattcgaagctggagaaattgtggagaaactaaaggagaagagggcggaatatgaagcgattgcttcgagtgatagttctgttaatcttgagaacattgataacagaattatcactgaagttttgggtcctgaaaggtacggtcgggttcgatttcaaggatctggtgttaccccgacccaatattttagatccggctcccagcaatacatgccttccggaagtcaagctcaagctgaagttcaaaggttaagagaccaaatagctcaaatgcaagcgaacacggttaagcaaattaccgaggttcaacgaaaata

SEQ ID NO: 2908 - DNA, 413 bp, Gossypium hirsutum
  unsure (1)..(413): unsure at all n locations
  Clone ID: uC-gsronu33B108a06b1
ccagacttgcagagcagaaggaatgtgctggaccagattgctgccgagtgcggcattgctttacaactcgaggaaaccactgattccagcgagggaaatctggatgtaagcaagaagcaggagatatcagctaaggcaagtcatgatgcaggagatgatgatgagttctctgattcaataaaaacaaggagaaaatacagggatgtagccgatgcagctcaagcagcctttgagtcagctgcctatgcagcagcagctgcaagagcagctgtggaactctctcggtctgattcctatgatcctgatgatcagaacggtcccaatactcgacagaacacagtgtttgacaaacaagaagcanattctaaagatatggaaaatcatggtagtcaagcagtggagttgaatcatac

SEQ ID NO: 2909 - DNA, 560 bp, Gossypium hirsutum
  unsure (1)..(560): unsure at all n locations
  Clone ID: uC-gsronu33B108a07b1
cccactcgtccgcccacgcgtccggtatggttcatttgcagttcaacataggaaaagctgcggcggctgcctttgctggtctcagcagccaaaatgctggggttatcaccatagctaacgcagtgtttggctcaaacccaccgatcaacccagatgttttggccaaggcgttccagttgaacaagaatgtggttaagtatcttcagtctcggttctaatgggattaacaactactttaagagtcaaatcaaaaccccaaaagtttgtttgcttgtttgaaacaatgtttgcatgcattttctaaatcaagtcatactattctgctaagtatcatgtaataaacagagaggtttaaatttacttctccagtctcctctcttgacattatcctttcagatataagaccagaatttgtagtgctctcggatttaaattacgaccacaatcaagggcaccaatgcatatgtagttcatgtntgtattgttgtatttatgtcatgctagccctacttgcttgtattcctctgtagttggacttgaatgcaatgttggatttcttc

SEQ ID NO: 2910 - DNA, 458 bp, Gossypium hirsutum
  Clone ID: uC-gsronu33B108a08b1
ctgtttcgtgggtttttctaagaaaccctaaactgtggcttctcccaactgtcctctggggtccagccgcaagcaaggccaacaccaagccttcatttgcttccgtaacgaccaacagagggccggagaacccctcttgcgaggcgaaacgagaggccgtgaagttgtggagaacgaggggcatagagtatgggcgcaaacatggagcgaggcgcacggggatcgtgcgtggagtgccgacgtgggggttgcggcgtggggctgctgtgcaaaaggggaacttagggtctctaaaaccctaaaactttgggcctatcgggcgttgtaaaattttgggcttgtaaaccgaacctatttgatggactatttaattattgtgttatgattttggtttcaaaaaaaaaacagtttcccgttagctttaaaaattaaaaaacagggccagctccccctcactg

SEQ ID NO: 2911 - DNA, 519 bp, Gossypium hirsutum
  Clone ID: uC-gsronu33B108a09b1
atttttcagttcttgttaacatggacatgagtctgcagtcaatggaagttgtgaaccgggttacaactgctgttgaacttccgaaggaatttgttcgtacatacataactaattgtatatcatcctgtgaaaacatcaaggataagtacatgcagaataggcttgtgcgactcgtatgtgttttcttgcagagtttaatccgaaacagaattattgatgttaaggatctgtttatcgaagttcaagccttctgcatcgagttttcaaggattagagaggcagcgggtttatttaggctgttgaaaaccttggaataaagggtgcctgtgttctatcccttacctgcatttaaacaaagttctacctcgtaagaaagtgtagataatatgattgtagtttgggacccgataactgctggctttagatattccgaaactgaaaaattagtccgcaatgcgtttgcaggaataatattagcagaaagaacgtaggcaggcaggcatcatgtaattaagcgta

SEQ ID NO: 2912 - DNA, 374 bp, Gossypium hirsutum
  Clone ID: uC-gsronu33B108a10b1
ctgatatatatcccgagatcaagttcaaaagaatgttggtcttcatataacgatcaccgcggaagatgtatatggtggacacttgaatagatgccccgagtccaaattggatatgttggcccaaaaaggttgtgtaacagacgagccttatgaaaatgatattggatatcatgaggatttctctggcttggagaagcaacattgtttctttgggggatgttctgatggtttgaactcttcccaaacagaagaggatatagatatggagttacaaagaagatcgaaagaagcagaggatagagttttgcttctttccgaagctcttgggcaggaaacctttcttcgtgatgttgggtttaatgtttcgtctctca

SEQ ID NO: 2913 - DNA, 417 bp, Gossypium hirsutum
  Clone ID: uC-gsronu33B108a11b1
gtatattaggagtatattggcctggttcaagattggtgctttctcacacaagtcattggggacttgatgtggcaaatcgattgtaaacctctgaggaaactctatttcattgggattacagcggtcagacttctccctcatttatacgactatataagagctccagttcccaatccttactttgcagaggagtacgagtttgtaaatccgacattggacttcttctcaaattttggggatgttgccattcccatcacagcaggtttgcttgcagcagtcatctattgtcagcaaaggtggaactatgatcagcttagccagattctgaccttcaagcaatgtaagcttgttgctgcacgatcaagagcttatgagaagttgtcttctaagccttttgaagctgagcttgcctctgat

SEQ ID NO: 2914 - DNA, 386 bp, Gossypium hirsutum
  Clone ID: uC-gsronu33B108a12b1
agttgttgcagctttataagaagaaatgtcaaggggggattaatacagagataaagcggggtttaatcagcggaacaggattcggagtttccttcttctttctgttttctgtttatgcaaccagtttttatgcaggggctcaacttgttgagcatggttatacaacattcagagatgttttccaagttttctttgctttgaccatggcagctataggaatttctcaatcgagctcctttgctcctgattctggcaaagccaagagcgctgccgcttccatatttgcgattattgatcgtgagtctaagatagaccccaacgacgagtccgggatgaaactagaaaacgtgaagggagatatcgaacttcatcatgtcagctttaag

SEQ ID NO: 2915 - DNA, 345 bp, Gossypium hirsutum
  Clone ID: uC-gsronu33B108b01b1
atcattttttccttcattctgaaattcgatgaagacgctgtcagtttcctgatgaaatccaagaatctgcaagtgtttgcggaggatgaagatttcctatctgctgcttttcctaatgaatagtgtttaaggtatgagctatagtatgaatcatagtatggtgttcagttgtgtgtattaaaacatagcttatgaaacatatgctggtgcgtgaactttaatattttgatgcatctgtaagaactggtttggatgaatgtctacatgcatgtatatgtatgaatggtttcttatgatctgtttttttaaaaaaaaaagaaaacaaaaaaaaaaaacaaccaatag

SEQ ID NO: 2916 - DNA, 281 bp, Gossypium hirsutum
  Clone ID: uC-gsronu33B108b06b1
gtatttttcggtttcttgtcctttctaggtggtgctgccgccaatgccgccgttgccgctgcccctgctgttgccgctcgtgtctgaatccgatccacggttccgcctctttgaatcttttcctcttggattacagtaatggttcacatgtcattgattcaatttcagttttttctttaagaacaataaaattcctattggggaatttatagctgtagtttattttttacgaattagagtttatattaacatttgtggaatgtatatggatctcgtttatt

SEQ ID NO: 2917 - DNA, 250 bp, Gossypium hirsutum
  Clone ID: uC-gsronu33B108b07b1
tttactcgtggcctcgcttgggaattgctcgtgaagcttgcaattagtttcttattggctttatttttttttgtttgttctttgtttgctttcttgtctttatgcgtaagctcttttttttagtgtttttatatgatgaaaaataggtttagttaataaacatcacaaaaaaaaatcaccattttgtgattatatatgtaatttcttttaagtttttaattgtgaaaagaaatggaagtaacttaactta

SEQ ID NO: 2918 - DNA, 391 bp, Gossypium hirsutum
  Clone ID: uC-gsronu33B108b08b1
cttttttaaacaaagccagtaattttgttgtggtgggtgctgtttaataattaaaacgtgttggaataactccagaaatgttgttgtgggcaaggtccaagttttgaagaaattgaagatcacaaattttatgaggaatatgtcaatcaaagttatttgatcgaaggcttagaatcacaagatttgagagcttatcaccaatccatgctggtacacttccactgaaacgattttcactaagatcaaacataatgaaatgatatggttatgcttgttttgaattaaggttttattatatggatttaaattagctgtgactgagtttctgaatttttggatgtttgttttggttgcttaaatttatagataaatgcttaagactgttattgcc

SEQ ID NO: 2919 - DNA, 460 bp, Gossypium hirsutum
  unsure (1)..(460): unsure at all n locations
  Clone ID: uC-gsronu33B108b10b1
ccttctcgtccgcccacgcgtccgcccacgcgtccgaaggagacatatctccttgtgtctagcttagatgtacatcccatttattgtcacggtataatatctctcactggttgtcttcagtgatcaggatacagtcttaacttttgggtgtctgtttattatccggaaaatgagaaatgaggttgtgtttcgagccggccaaccgtcatcaattaatttcattagagaggcacagaattactctgataccgtcagggaggccttggaagccatatcttacaatggtagatgatgaatattgaacaaaggatctatacccaattagttgacgagtaaaaattagttggtccacagcgtttcatctcttgcagcataaacttccctttgtagttttttttatttattttgtaaattttttggtattttaaatgtcccttttactgtttgtgttccatnnaat

SEQ ID NO: 2920 - DNA, 401 bp, Gossypium hirsutum
  Clone ID: uC-gsronu33B108b11b1
gccgaactaccaaatcccacctcatgggggcccactctaaaaactaccctggggggccacaaccccataacagacgtggcaactaccgtccacggcgcaactactgatgctgctgctgtttctggatcatcctcatagtcctcgtgctcgcccttttagtagccataactggcaccgtcctttacgtcttttaccgccctcaccgcccttcattcaccctcgcttccctccgtatccaccgcttgaagctcaaaaccgccggcgactcctcctcttcccatctttcaacccttttcaacttaaccctttcttccaaaaaccccaactctcatctctccttctcgtacgacccattcgtcatttcatgtgtgaccagcaatggcgacgttctgatagggaac

SEQ ID NO: 2921 - DNA, 392 bp, Gossypium hirsutum
  Clone ID: uC-gsronu33B108b12b1
gatgtgtcttcattctctccgccaacggcactggtggtgcagatcacatgtgccacgtggggtgaaggcttgtatgagggactggactggctttcgaacaacattgcaaacaaggcatagatggcatcattgagttgtcagtctcaccaatgctggccccttttagagttccggatgtttatcccgttcaagtgttattggttgttcgtggtcatttgtttcttgcaaacattgccatttgttacttatagtttaacaataattgataaattgcttgtttcctttgtggtattatcccgatagctgaaaaaaaaaaaaaaacttccccaagtttgggcagctattttcttggtggaaatttaaggatagcaagcttcttgaatgcttctttt

SEQ ID NO: 2922 - DNA, 493 bp, Gossypium hirsutum
  Clone ID: uC-gsronu33B108c01b1
gtgacttttattctttggattcctattcgtgctattgatgataagctagcaagggggtgatcttcaggggccccgcagaaacaaagtatcgtggatggaatgcggacagtagctttgaaacttgagtttggaatatcaaacaaccagatctatgaccaaacaatagctttgcatttcaccaaccctttccatgtgagcacacgtgttgcagatcaatgcaatgacggtactttgcttttgcaggtaacactgcactcccaggtgaaggccacattgactgtcaatgatgcttggcttgatcttcaagacggatttgttcacgctggacaagatgatggaagaccagtttccggctttttccctctcgtcatatctccaacttcaagagcaggactcctattccgtgtatgtttggggaatggaacagctctagatgaaaataaggctcaaccagagagcatattaaacatcagctatagaattgctggtgata

SEQ ID NO: 2923 - DNA, 568 bp, Gossypium hirsutum
  unsure (1)..(568): unsure at all n locations
  Clone ID: uC-gsronu33B108c02b1
cttattactaaggcatacaagacccttgttggattgaagggtgttaccgcttacggtttggatttggttcggggaacccagaccattgatttggtcaaggctggcttccccgaaggaaaatacctctttgctggagttgtcgatggaaggaacatttgggccaatgatcttgcttcttctcttagcaccttgcagcagctcgaagctattgtgggcaaagacaagcttgtggcgtctacctcctgctcgcttctccacactgccgttgatctagtaaacgagactaagctagatgatgaaatcaaatcctggctcgcatttgctgcccagaaagttgttgaagtcaatgcacttgccaaggcgttggctggtcagaaggatgaggccttcttccagccaatgctgctgctcaggcttctaggaaatcctccccgagagtgactaatgaggctgttcaaaaggctgctgctgctctgaaaggctctgaccaccgnccagcaacaaatgttagtgctagactcgatgcccagcagaaaaagcttaacttacctgtccttccaccacacct

SEQ ID NO: 2924 - DNA, 64 bp, Gossypium hirsutum
  Clone ID: uC-gsronu33B108c04b1
cccactctatcggcttattttacattatttatatatataggcttttaatcaaagagattgtggg

SEQ ID NO: 2925 - DNA, 490 bp, Gossypium hirsutum
  unsure (1)..(490): unsure at all n locations
  Clone ID: uC-gsronu33B108c05b1
ctcatttttcacaccgatgtcgtcccttctgagcgtgggaagtgggattatcatccttggggtgcccacatcgatgaaaatggtaatatattcgctagaggctcccaggatatgaagtgcgtgggcatgcagtatatggaggctgttcgtaggttgaaggcttctgggtttcagccaaaacggtcactttacttgtcgtttgtccctgatgaagagattggtggccatgacggtcttgagaagttggctcaatccgatgttttcaagaatatgaatgttgatattgtgcttgatgaagggttggcttcacccaatgagaattacaggttattctatggagagaggatgccgtggtggctggtgataaaggctactggagctcctggacatggggcgaagctttacgacaacagtgcaattgagaaccntttcaagagcattgagagtatcaggaggttcagggcttcgcagcttgatttggtcaaaagct

SEQ ID NO: 2926 - DNA, 553 bp, Gossypium hirsutum
  Clone ID: uC-gsronu33B108d04b1
gtcttttttgatgatatggataataagcttctccaggtgtgtgagtatgaaaagtcccggggacatgggaagacaatggattctgtttattatgagaatgcacgtgtcctccttcacgaagagaatgtttatcgattgaaatgttcgtcttcgccgcctcatttgtctatccagctgatggacaatgtcattgaaaagccagaggcatttgctgtttccatggaacctaacttttcagcttttttgcacaatgattttctgacggtgtttcctggcaaaaaggagccacatggcattacactaaagagaaacaagacaaaatatgcaaccctggatgaatacggtgctacatgcatggccatggaaggtgttgaagtggttaatggtttagagaacaagatagcttgcaactcatacaagatttcatatgtgttggacacagaagatttcttctttcgtagaagaaaatcaccacaacacaaatcttcaaatatttatcaggcaaaagtacaaaggttccatagattttatctgcttcacataatataccatt

SEQ ID NO: 2927 - DNA, 524 bp, Gossypium hirsutum
  Clone ID: uC-gsronu33B108d06b1
ggatttctcatgttaaagttaggcatgaagcctgttactggtgtaagcagggtcaccattgagagaacaaaaaatgtgctatttttcatctcgaaacctgatgtctttaagagcccgaattcagagacctatgtcattttcggtgaggctaagatagaggatttgagctctcagctccagacacaagctgcccagcagttcaggatgccagacattggttctttggcagctaagccagacacttctactgcagctgctgcaccggctgatgaggaagaggaagaagttgatgagactggtgtagagcctagggacattgacttggtcatgacacaggctggggtttcgagggccaaggctgtcaaggctctcaagagtaacaatggtgacattgtgagtgctattatggagcttaccacttaggcagtctctatcgtataagtcggccctggtcgactgtcaatgagtgtttcggaattagtatcaatgttctagttgttatagtcaaggtggctagattttta

SEQ ID NO: 2928 - DNA, 569 bp, Gossypium hirsutum
  Clone ID: uC-gsronu33B108d07b1
tcttattcccacggttccactgttaatctttcttcactttcatacctttcacattatcccctccaaaacgctttttacaaaggaaaccccaaaaatatacctatcaccaaaaagtgaaatccaattctcctccaaagcaaagcaaaaacagggacttagtgagtgagtgatgggttcccagaactttcttcaagttgttgccaagaactttgatgttcttgctctgtatgtctctctttttaacaaagattctttcatttgtgctactttgtgtgttcttttttcttcttaactgagctttgctttttttgttctggttttacaggcctttagtcactcttgtttaccctctgtaagtagggttttttccccctttcttttgaaccaccttaaaaccattgattatggtttacatgttctaaacgcttccaaggtttgtcgtgtttttttcgtttttggcagatacgcttcaatcaaggctatagaaacgaggtctaacaacgatgatcaacaatggctgacgtattgggtcctttactctttgattacacttttcgaacttacttttg

SEQ ID NO: 2929 - DNA, 541 bp, Gossypium hirsutum
  Clone ID: uC-gsronu33B108d08b1
gtttttcaggattatctgaacatgtactttaggggcgtttacaggcccatccctcccatttacaacctggtgatggccatgctatggcgccaccctgagaacattgagctagacaaggccaaggtggttcactactgtgctgctggctccaaaccctggaggtataccggcaaagaagacaacatggacagggaagacattaagacgctggtggctaaatggtgggagatttacgatgatgagtcgcttgactacaacaatgtcgtggcttctggccaagcagcagaagctgatgaggataagcaaagcggcctgcaactgcttttggcagctttgtcaaaggccggcggctttgttcaccgtattaacgccccttccgctgcttaatttggtgacgatacagattagtaatacaatacaatccacctaagctaaagcagtgtaagaatgaatgtaaatgtgttctttttcttgtttgtagtatgtatttgatctgtccttccatttttgaaatggacagatgttttatcatcaggaacat

SEQ ID NO: 2930 - DNA, 464 bp, Gossypium hirsutum
  Clone ID: uC-gsronu33B108d10b1
ctgttatcttcttctcaaactcttttcttggggggtgggtttaattattactcaaaggagaaggagagatgatgagaatggaatcacttggaaaatcatttgaaggccaagttttgaagaaagattttaaatttacattcgagtcatggcctatataaaaaatttgcagcaaaggtgatgatgctgatgacgacttcgaggaattattaacctcctaggcaagtctaatgcttggctttttatcctccttttttttattttctttttcttttttggggtttttatcatgtttggttgctgagaaaatggaggatagatactatatgaataagatttgaaggctatgtatgtctttcagtaaccaaacagctcttcttctttttcttgatttggagttcttggatgctccgacactgtaagagaaagctttgtgaattgtgaagacattaaattacttttaattc

SEQ ID NO: 2931 - DNA, 399 bp, Gossypium hirsutum
  Clone ID: uC-gsronu33B108d11b1
gtgttgtctaccaagccggagctttcaccgacttgggtgttgtttggaccggttcgatggccgatgatcaaattttagagaaatcagcgtttcaccaaagagccacaaggggacatttgaaggacgtttgcgtcgtaggcaacaaagggtacccactaatggactgggttttggttccttacagtcaccaaaacctcacttgggctcaacatgctttcaatgagaaaatcggggagattgaaaaggtggccaacgaggcattcgcgaggctgaaagggcggtggtcgtgtttacaaaagagaaccgaggttaagcttcaagagttgccgatcgtgcttggagcttgctgcgttttgcataatatctgtgagatgagaaactaggtgatggatccggagc

SEQ ID NO: 2932 - DNA, 82 bp, Gossypium hirsutum
  Clone ID: uC-gsronu33B108e07b1
attttttttggtgcctttttgggaggttttgttagtgattatggagaaagttcttaatgataattgctgttctgtttctggt

SEQ ID NO: 2933 - DNA, 499 bp, Gossypium hirsutum
  Clone ID: uC-gsronu33B108e08b1
aacctgtgacagtgatgggaagattgataagttcatcggaggtgaaacaagcttgcctttacatgggttggaaggtaatggtggtggtagcagtggtggtgctaatgggcggtactatttggggatgttcttgggtggggcttaccaggaatccctcggtggagttcacaacctctttggtggcccaagtgttgttagcgtgtcgcagagtgatggtccatatagctttgcggttacgcgggcggcgcctggtccgtcatgtggggatgtcctccgagtgatgcagcacgagcccgagctaatgtttgagaccctcaagcaccgtgcggaagaattttgtggacaggaccatggcaatgaaagcacccatgctgctttagttagcaccattgctcgttctttccacaacatgccttatcttgtagtggcatccccttgttcgttgactgccatgaataacaatggcttctactattgcaatgaagaagattacaatgct

SEQ ID NO: 2934 - DNA, 539 bp, Gossypium hirsutum
  unsure (1)..(539): unsure at all n locations
  Clone ID: uC-gsronu33B108e10b1
atttttctcaaaactggaagaagagacggtagaaggggcagagcagatgttgtggaggagtatcttccggaccacaatgagaccatctctggcgttcttgacaggtttgccgccatgggtattgacacccctggagtcgttgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgttgattgtggatcaccaactggcgtacgacaaaaggaccagaccttatgtgaagaaaatggccaagagccaagactatttcttcaggagttctcaagggccattactctcctctctgagaacaatcctctcactggtnagcagggtgagatcaggaagcaatgcaat

SEQ ID NO: 2935 - DNA, 410 bp, Gossypium hirsutum
  Clone ID: uC-gsronu33B108e12b1
ctgatgcgtgggtcgcccacccgtccatcgcatcatgtttcttgatgaaaaccccaggggatttgaacaagctaacaggtttgggattacagaatttgcgaatccaaaagactactataagccaattcaagaggtgattgtcgagatcaccgactgaggagtggatcgcagtgtggagtgtacagggagcatccaagccatgatttccgcttttgaatgcgtacatgatggctggggtgtttgcgtgctaattggtgtgccaaagaaagacgatgcattcaaaactcatccaatgaatctactacatgagaggacccttaagggtgctttatatggcaactataaaccacgcactgatattcccatggttgtcgacaaatatttgaataatgagagctcatttggttctt

SEQ ID NO: 2936 - DNA, 567 bp, Gossypium hirsutum
  unsure (1)..(567): unsure at all n locations
  Clone ID: uC-gsronu33B108f02b1
cgaactctatcgccatgggaagatttgaagagagaggattcgattcagtggtttgccctagagcctatccgaacctttagatggtctaccaacagctgttatcagactgagatggctgattcaaaaactggtgcagagcttcttgatataatcctccccgagggagggtatggggccgagaatcccaccaaccaaatggcttcatcaccaccgtatttctgtggatcaccgccgagcagggcgtcgaatccggtaatccaagatgcccgattcaacgacgagcagccggtgctacctccactaacatccccagcaacctcctcaaggggaggatgcgtgagggtgaaattcgggcagatgccagctgctgtacgaatcgagggatttgattgcctcaccagagatggccgccatcgcagcatctccgccgtggcttaaaaaaaaccaagatatgagaacaaaaatgtgagaggagagagggagatgataaaattaagtaacaacttggaatagtgtnggtagtgttggatttgtaaatagaagattaaaatgagatgatggtgttaa

SEQ ID NO: 2937 - DNA, 261 bp, Gossypium hirsutum
  Clone ID: uC-gsronu33B108f04b1
caccgccccaaaattcccgtctcgacctacgcgcccgccttttagcagacataccaccttctcaaaaacaaagggccacttataaaaacatgagcggttacagacacgaaaactgctactagctcattacctcagactagacatgtcgcatgcatttgctactcaagatatcctgctatctataaactcatatactatctaaacacgcaaaatcctattatcttttactcaagtatatatattgtatactacctcttttcc

SEQ ID NO: 2938 - DNA, 566 bp, Gossypium hirsutum
  unsure (1)..(566): unsure at all n locations
  Clone ID: uC-gsronu33B108f05b1
ctacatttggaatttattccctcaatgatttaagcttagacaatattactcaatagaactgtgtcttaatttttataaattacaggaatgaaatttatagttaaatgtgtaataattacataatcaaaatgcttgaactatattaatattattctattaatattttttttggtgaagatattttattttaatgattggattatgatatttgtatatattggttgaatattgaaggttgtcatctttccggtatggtttggtaatttatttggaaagctttatacactaccttttcaatggccctcatttagcctcagacactcaaaacacacctccatgtatgtgttttttttttaaattttttaattaattaaaatttagggtttaaggtttatgttacatttttatgtacaaataattttttttatgacagcatcatacactacctcattgatggtaacaggtacattttggtttctaattgaattttaaatattaaaatgttaagtatcatttaaaaataatatatatattnttttgaaaggtggaagtttgataccaagaca

SEQ ID NO: 2939 - DNA, 577 bp, Gossypium hirsutum
  unsure (1)..(577): unsure at all n locations
  Clone ID: uC-gsronu33B108f06b1
aagatgtcttcgccaatcagctgtccgccttgactgaccgtgcggcatcgacttggccctgggttttgcccttttgtaaaccttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtctgttaggatgcatgctgagaagactgggaacgaagctttccttaaccttatccctttgcttcagggaaatgtgggtttgatctttacaaagggtgatttgaaggaagtcagtgaggaagttgctaaatacaaggttggagctcctgctcgtgttggtctggttgcgcctattgatgtggtcgttccacctggaaacacttgtcttgacccatcacagacctcttttttcangtgctcaatattcccaccaagattaacaaaggtacttgtgaaattatt

SEQ ID NO: 2940 - DNA, 516 bp, Gossypium hirsutum
  Clone ID: uC-gsronu33B108f08b1
ccttttcgtccgatagtttccaatggctgctctgcaacttacgattgtattggttatgttcgtcttccttcaactattctcaggtgctcgttcgtcgacgtttaccatcataaacaaatgcagctatacagtttggccaggagtgttgtcaagtgctggaatcccaccactttcacctacaggttttgttcttcaacaaggagaatcgaaatctatcgatgttccgacatcttggtcaggtcggttatggggtcgaactctttgtacccaagactcttctggcaaattcacttgtctcactggagactgcggttcgtctacgatagaatgctctggtgctggtgctatccctcctgcaacccttgcggagtttacattgaacggagcttcgggattggatttttatgacgttagccttgtggatggatacaatttaccaatgatggtatctccacatggtggctaaggaggtaattgtagttcagccggatgtgctgcggaattgaacagtaactg

SEQ ID NO: 2941 - DNA, 427 bp, Gossypium hirsutum
  Clone ID: uC-gsronu33B108f11b1
ctagtgaccgccaagcggcaccaagaccttccccaaaggcagtttacagtcatgaagggggtgatccatcagattgttattgtttgcgacattgagctgaaatggaacccgaatccaatacattccgaaggaaattggtatttacatggatgaccagagtgggaattaaagcatgaatcttttgcggttaaaccagcaagggggatatatgctttaatctcccaacaaagaacctacaagcaaaaatcaataaacattcatggggctgagctgatatttagtagatttagggatattttgtcttttctcatgtctttgttatctttatttatagtttttattcaggttcagctctcatcgttttcttgaaaggtacaataatgtatagttttgtctcttaaaaaaaacgaagaatatgaaaagttcc

SEQ ID NO: 2942 - DNA, 492 bp, Gossypium hirsutum
  Clone ID: uC-gsronu33B108g03b1
aaaacttgtagaggaaataaggaaaggggctgcatcgggtgaaggtgatgaagccaaagggtggcaggtctctgagactctatcggaagaagttcttggaaagatgagtgcacctccaaaaagtgatgtaccagttattacaccgaacgatcttgctgaggccgatgggtttgtttttggtttcccaacaagattcggaatgatgtccgcacaattcaaagcttttctggatgcaaccggaggtctatggagaactcagcaacttgcaggaaaacctgctgggatcttctatagcaccggatcacaaggcggtggacaagagactacagcgttgactgcaatcactcaactcgttcaccatgggatgatatttgttcccatcggatacaccttcggtgctggcatgtttgagatggagcaagtgaaaggtggaagtccatatggtgctggaacatatgccggggacggatcaagaatgccgtcggaacttga

SEQ ID NO: 2943 - DNA, 393 bp, Gossypium hirsutum
  Clone ID: uC-gsronu33B108g06b1
aaaacatacacaaaatggatagccgattcaacttaaaagctaccttgtaaaactagatggaggtctacacaatgtcaatatcattgtcctcatcatcctcacaagccacaacaacatccatgtgcaattctggtctgccccaaaaagattccctcagccctttcagttctcagtcgctgatccaactcatctgcaatttaatgtatctgcttctatacatagggcctcaacattctgcattcctattcctgattgtattgaacatccgaagatcttgtctgatgctatcgagacactattagacccaaacttttatcctgataaagatatcaaaattgttactgatgagaaggctactacactctttcatgaatctatcaactatacagcact

SEQ ID NO: 2944 - DNA, 442 bp, Gossypium hirsutum
  unsure (1)..(442): unsure at all n locations
  Clone ID: uC-gsronu33B108g09b1
cccactcgtccgcccacgcgtccgcccacgcgtgcgatttgtctctgtactacgatcaaggccaaacttttgaatatcaatattataatccccatagctcttcaggtcctcatcgactgtggcaaaactccacctccagggttccaatgtccagcacaatgatgaaaaacataaaaaccccctgttttttttctttcgaaataacaaatattttcatgtcttattatatgtttcttttaataatttatggtgttttgctggttgatgaagatcataaagacgtgtctgaggttagatcgttttaatagatgttgatgaatccacgaacggatcaatgtagtacgatgttgtgattttagttagttcataggatcatattaattgtgtgtgtgtgtgttatttttcttatttcaaagctaagcttgttttggagtgaaanaaa

SEQ ID NO: 2945 - DNA, 537 bp, Gossypium hirsutum
  Clone ID: uC-gsronu33B108g10b1
gtttgtgtcttttcttggaggcatgtaatgggagtgcttgctcgccaggttggttgttcagttgccgcttttgatcggcctggttggggattgacttctaggcctagccggaaggactgggagggaaaagagttgcccaatccgtacaagcttgaaactcaggttgacttgcttctttccttttgctctgagatggggttttcttcagtagtgcttgttggccatgatgatggaggcctgcttgctttgaaggctgcacaaaaagtccaaacttcaatgaattcgttcaatattacaatcaaagcagtggttttgctaaacgttagcttgtcaagagaagttgttcccgcctttgcaaggatactcttgcgcacttcacttgggaagaagcacttggttcgtccgcttctgcgaacagaaatcacacaagtggtgaatagacgtgcatggtatgatgcaaccaagttaacaacggaagttttgagcctctacaaggccccactttgtgtagaaggtgggatgaagcacttcatgaga

SEQ ID NO: 2946 - DNA, 417 bp, Gossypium hirsutum
  Clone ID: uC-gsronu33B108h01b1
gccacttgtacggagacctaatctgcgagatgtggcgggagtcttatcaaccagattagggtgctccacctcgcccccagacggacgaaacagctttcggtaatggtggaggctggacaatctctggcacccctctggatcagcgtgattctcgccttttggccattgcagaggcagaacgccaattatcggaaactgggtctgacgaatatgctgcactcaaatgccactggagctgcatatcgccgctcagctgctgaaattgtaatggcactgctgctattgcatgatgcagtgactgatccagatgccgcatcagatgatgatgtctcttctttcttctatattatctagctacgagctgctgggtttctctagccatgctacatcatggcttgggccatcagtgtattacag

SEQ ID NO: 2947 - DNA, 397 bp, Gossypium hirsutum
  unsure (1)..(397): unsure at all n locations
  Clone ID: uC-gsronu33B108h02b1
gggccgctccgcacattcttggctcgtcccactcgtccgtgtttttctactaataggctgatcacctcgaaggatggtgggtctgttcagattaatggggggcattaggatgagcttggcagatacactggaactttctccacttttgctctttgtggttttgtccgtgcccagggtgatgctgacagtgcacttgacaggctttggcagaagaagaaagctgaagtccgacagcagtagtgggagttggattgctttttactacttgcttggtctctgaattttggagggaaaatgtgttttttttttaaatcagtgacctttaagttctatcttggtttttttaaaatggattatgttgaatttgatctgatgatgtttcgtacctcannnaaaa

SEQ ID NO: 2948 - DNA, 469 bp, Gossypium hirsutum
  Clone ID: uC-gsronu33B108h06b1
ggtgatcttgtcgccgttaaaaggttaccggcaatggggggcgggttttaccatgatcgtgggttcaatgctgagatacaaactctggggaggattacgcacaggcatatcgagagactgttgggcttttgctcaaatcatgaaaccaatctctaggattatgaatatatgcctaatgggagtttaagagaggttcttcatgggaagaaagggggtcattagcactgggataccatatacaagatcacggtcgatgcggttaagggactatgctaccttcatcatgattgcatccctatgatagtccaccgggatgtgaaatcgaacactatcctcctcgactcagagttagaagctcatgttgctgattatggccttgctaaattctcgcaagattctggcacttccgaatgcatgtacgccgtagctggttcatacggttacatagctgcagaatacgcctacacac

SEQ ID NO: 2949 - DNA, 565 bp, Gossypium hirsutum
  unsure (1)..(565): unsure at all n locations
  Clone ID: uC-gsronu33B108h08b1
atttttgaaggagtgaagtatggtgctggaatgggggctgatgtgaaagacatgcggtggcccanaataccatcaaccgaagagattgctgaccgaattaacaagatgcttgctgtgcttgagaccaacatcttgtgggttaacccagactgtggtctcaagactcgcaagtatgccgaggtgaagccagccctgaacaacatggttgcagcggccaagctgctccgcacccaacttgcgagtgccaagtgagaggcatatctgaggtcggacatcatcctttatatcgaagatggtccagaggaaatttgtcttaaatcatttgaataactgtgtgttggaagtatttgttaggcgtatcatatgcccctctattaggccaattgatttcctttttcttttttggttatttaccctctaaatttttgtattttcgggaatatatgaattgccttcaattactttgaaaggcacgaaatttggtagtgtatcttttatgagcctaatgaaaatgtcaatacttgctgtggctgtggactgactataatagcttctatctctattt

SEQ ID NO: 2950 - DNA, 165 bp, Gossypium hirsutum
  Clone ID: uC-gsronu33B108h09b1
cttactcgtccgcaaaagaaaaaaaacactaagggcggcccttttataacccctttgggggaaaaaaaacaacaaaccaaacattttcgttctccaaggtccggcctctctatcttatccaatctgcctgccgctctcttacatcttcctccttcttccataccc

SEQ ID NO: 2951 - DNA, 511 bp, Gossypium hirsutum
  Clone ID: uC-gsronu33B108h10b1
cgtgtatgtggaggcggatactatcgccatattggtgtgttcttttccaaaggtcgggggttccaaaacgagtatgcgtttaaggcagtgaaagcagctgggattacatcaattggtgttcgagggaaagactccgtctgttttgttactcagaagaaagttcccgacaagcttttggatcagactagcgtcactcatcttttccctattactaagttccttggattgttggctactggcatgacagctgatgcaaggaccttggtccagcaggcaaggaatgaagcagctgagtttcgtttcagatatggatatgagatgcctgtggatgtattgtccaaatggattgctgacaaatcacaggtttacactcaacatgcttatatgagacctcttggagttgttgctatggtgttgggtattgatgaagagaaggggccccaactctacaaatgtgatccagcaggccatttttatggccacacggcaaccagtgctggatcaaaagagc

SEQ ID NO: 2952 - DNA, 514 bp, Gossypium hirsutum
  Clone ID: uC-gsronu33B108h11b1
ttcacataatgctctccattttagagtagtctttcttatacaagacatctggggggattcaacttcaacacaacaaagagaggaaagccatggcctcttcacatggtgtgtatggcgcggtgctgctgacatggcgaggccgctcgtgaggtgtgacgcgaaggcttccagaagtttcactgtttggggctgctgtggtgcttgcggcgcatggagactgcagaaacccttagggtttctgaaagaatttagacattgggcctttttaggttaattttgtttgggccaaaggtttatttttgggcttttattgggtgttgggttttgtactaggctattataatttggggttaatgagtttttgaaatttgggctgtaaatggactgctaaagtttggactttttatttttattttaatttattattgggttattctctgttaacgggcccgggcgaaatgggcctattacaatatttttacaggatcctcatttatttatccttcgggttttt

SEQ ID NO: 2953 - DNA, 468 bp, Gossypium hirsutum
  Clone ID: uC-gsronu33B108h12b1
gttgtttgattttggagcatcaaatatagagcctggggttcaaacatgcatgaccagtgggtcctcaaaaattgtgaaccgatgcaagcgccatttggctgagatttctgttaaagcagttctttctgttgctgatctagagaggaaagatgtcaatttagatatgattaaggttgaggggaaagttgggggaaaattggaggatactgagctaatatatggaatcactgttgataaggacatgagtcatccacagatgccaaagcaaattgaagatgctaaaattgccatattaacttgcccatttgagccccctaagccaaagaccaaacataaggtagacattgatacggtggagaagtttcaaactttgcgtctgcaagagcaaaagtattttgatgacatggttcagaagtgcaaggatgttggtgccaccttggttatctgtcaatgggggtttgatgatga

SEQ ID NO: 2954 - DNA, 321 bp, Gossypium hirsutum
  Clone ID: uC-gsronu33B109a02b1
ccatttataaaatacttaactaaataaaaaaaataaggggatctaataaaaatataatgggactacatatcgagggtaaaacaaatattacaacattgcatgaagctgcccttccttcttttgctgtcgcggatgttgatgtcagtcctccatttgtgtcacttacccttgtgtttagtctcttgtgtactgattctcacttcgactttcatagctgctccgtttgtaaggtggcagcttttcccggtgatcttagcgcaaagctgcttgttaatctggcccttccttgactcattattgaccactccgtgagacgggttt

SEQ ID NO: 2955 - DNA, 504 bp, Gossypium hirsutum
  Clone ID: uC-gsronu33B109a03b1
caaactcatgacttcatggctcggaaattcttcgtcggcggcaactggaaatgtaatgggacaactgaggaggttaagaagattgttacaacattgaatgaagctgaagttccttctcatgatgttgtggaggttgttgtgagccctccatttgtgttccttacccttgtcaaaagtctgttgcggtctgattttcacgtcgcctctcagaactgctgggttagcaagggtggtgcttttaccggagaagttagtgcagagatgcttgttaatctaggcattccttgggttattattggtcactccgagagaagggctctcttgaatgagtccaatgagtttgttggagataaagtagcgtatgcgctttctcaaggcttgaaagtgattgcttgcattggagagactcttgaacagcgagaatcaggctctaccatggctgtcgttgctgcacagaccaaagcaattgctgataaagtaacaaattgggataatgttgttttg

SEQ ID NO: 2956 - DNA, 74 bp, Gossypium hirsutum
  Clone ID: uC-gsronu33B109a07b1
cgaattcaatgctaaacagaatggaggaaattggagcatatgatatacatacttttgtgcccggactcgggggt

SEQ ID NO: 2957 - DNA, 463 bp, Gossypium hirsutum
  unsure (1)..(463): unsure at all n locations
  Clone ID: uC-gsronu33B109a09b1
cttgtttcattcatattgtcatataccttctgagtgatccaccgctttctcccttcctgaatgaggttttcatcaagctggatgatatatggggtcttctgggtactgttgcatttgcattcttttgcttctaccttctgcttgctgtgattgctggagcaatgatgcttggcctgcgattggttttcattacaattcatcctatgaagtggggagctacgctaatgaactcttttctgttcaatgtggggcttattcttttgtgctcaataagtgtcatacagttctgtgccaccgcatttgggtactatgctcaagcaactgctgcccaggaaatattcggccacacattgcagtctcttcgtggaattaaatatttgtacaagtataatgtatttcaaatcgcattcattgntttagcggcattgaccttcgtgtattatgttgcctttggatggagaag

SEQ ID NO: 2958 - DNA, 215 bp, Gossypium hirsutum
  Clone ID: uC-gsronu33B109a10b1
gttatcaatgaacatgatgtcgctgacctccgcccctgcgccattgctagtggtgaaagaaaaaaaaaaacaccaacaaaaaaaaaaacaaaaacaaccaaaacaacccaaaaacaaacaaaaaaaaccaaaaaaaaaaaaaaaaacactacaaacacaggccgcccccccaaaagaacccaacctaccctccccggccatccaacccaaaaacc

SEQ ID NO: 2959 - DNA, 399 bp, Gossypium hirsutum
  Clone ID: uC-gsronu33B109a11b1
gttaaacctgaagggattagtactattactagaaagggtgtggtgattatagaaggggatcctcgtcctggagcaactgttgggcggatgtcatttcgaagtttcaatccttctattgataaactgaatgaagaagcatcaaatgtgtctcagccggatgcctctggtggaagaactttgtctagtgaaaatggatctgcatctgaagcaactcactcaaaagttggcactgataaacacgaaggtaatggagaccttaagagaaaacaatctgtcatggtttctgaaccagagtatccaaataaatcaccaaaaaatggttatggcattcaatctacccctagcagcggtaaagcctcatccaaaaagcagtcaaagcgcgagaaactggactggaat

SEQ ID NO: 2960 - DNA, 462 bp, Gossypium hirsutum
  unsure (1)..(462): unsure at all n locations
  Clone ID: uC-gsronu33B109a12b1
gtgatatgtgcgaaaagaaagaggaagaaccagtagcgtggaatccggcagcgcccatggggtaaatgggctgctgagatccgtgacccaaggaaaggggttagggtctggttaggaactttcaatactgctgaagaagctgcgagagcttatgatgctgaggcacggagaattcgtggtaagaaagctaaggtgaacttccctaacgagactccgcgtacctctccaaagcatgcagtcaagacaaattctcagaaaccactttccaagtcaaatttgggcccttgtcagcccaaatctaaaccagatttacaattacttngaaccagcctgagcaggaatactttgataccatgggtttcgtagaagagaagccatcggtcaatcagttcgcatacgtggaccctgttcctacgtctatagatgctggatttaatcaatcagataatgcccccttgtact

SEQ ID NO: 2961 - DNA, 486 bp, Gossypium hirsutum
  Clone ID: uC-gsronu33B109b01b1
cccattcttccgaacaaagtgaatcacttccagctggggctttgaccacttcatgcgagccagtagaactgaactacgagtgcttcaacagcagcaacaatagagtggctgacgccatccttttcccagaactgaaagatgggtcatcagatagtgactcaagtgctatcttgaatgaagacgaccacaccaacaccaacaatggtgttgtttcgtcatctggggtcctacaaagccaacatcttttgatgtcaccaacgacaacctcttcattcaatttcgactcatcttcttcgtcttcaccatcctccatgaattgattccagttctcaaaaacaacctatcttgtgaagatggaagagcacaatttctttactgcagatgaagcttgcaatttcttctctgatgagcaagctccaagtcttcaatggtgttacccggagcaatggaactaaaagcagaagccaaaatgaacatgtatgtaac

SEQ ID NO: 2962 - DNA, 520 bp, Gossypium hirsutum
  unsure (1)..(520): unsure at all n locations
  Clone ID: uC-gsronu33B109b02b1
cccactcgtccggttgtacctgacattgtcacaatggcaaaggggatcggaaatggcatccctctaggcgctgtgataaccactcccgagatcgcggaggtcttgacccgacgaaattacttcaacacctttggtgggaaccctgtatgtacggctgcagggttagccgttttgaacgtaatcgaaaaagaaaagcttcaagacaatgccttcgtcgtaggatcttatttgaaagagagactaattgcactaaaagataaacatgaccttatcggggatgtgagaggacgaggattaatgcttggagtcgaacttgtcaccgatcacgagctcaagacaccggcaaagcttgaaacacttcatttattggaccaaatgaaaggttaggtttcttcacattaagcctgccatggaatgtactttgtttaagctactgatgtactggtaatcttatagtagagatcggtgtattggttgggaaaggtggattttatggcaatgtatttagaattacacctnc

SEQ ID NO: 2963 - DNA, 445 bp, Gossypium hirsutum
  Clone ID: uC-gsronu33B109b06b1
cttatgaggtcttgaaattgctcgaatcccgtttttgttaaatttttttcatctaattctcagttttcttttctatttatttttctcgagttctttttttgggataaattatcatggggactgaaattttacggcctcaggattgtttgattgaacagatccgtgtttcttcgacggcttgttctcgtcggagatatggaaatggtagctttaatcctacctataattataataatagtaatagcaataacagcaacggaaacgttagatttaccaggaaaccggtccagaggaagcgagtcgggtcggagcagcgggtttcgaagagatctggctccgtcgatgacttgaagacggtggcgaacaatttcaagatggagaaggttacgattttgaggcgcggagagtcgttggattcgaagatcaagagcaacaacggcggtgg

SEQ ID NO: 2964 - DNA, 462 bp, Gossypium hirsutum
  Clone ID: uC-gsronu33B109b07b1
cttatgcgcgggttgctaagttgacaagatgatgagaggagagaacaatgaaggacctgattatgcttctacggaatgcgggcacactcacacttatttctgattctaagaacctgacattgaactctcatataatctgtgtggtactgtctattcaactgatagttaccatctgcgaggatgagttgggaataagtaagcagcaatcttgaccatatcaaaactgtcatgcctgtacaacatgctggtatggaaccatggaccttgagatcttatgggatgataacagacgatgaaatgctctaaccatgactggagcgtcctggaatcagacgggactgaaatagcacatggggtaatggcctagagatcttgcatgtacgataatcaggatggatggataccttgagaagactctgcctttgtggattcatgcagtagcattcaatttagctatgtgaa

SEQ ID NO: 2965 - DNA, 528 bp, Gossypium hirsutum
  Clone ID: uC-gsronu33B109b08b1
tccacgcgtccgcccacgcgtccgcccacgcgtccgatttcttctcttctttgaactcaaagtcccaactaatattagaatcatgggtgttgtcacttatgactatgagaatacctccccagtcgcccctgccaggcttttcaaggcctttactgttgaagctccgaaagtttggcccacggctgcacctaatgcagtcaagagtattgaggttgaagctaatcctagctctggaagtatcgtaaaaatcaactttgttgaaggccttccattccaatatatgaagcaccagataggaggacatgatgaaaataatttttcatacagttacgatttaatcgaaggtgggcctttgggggacaaacttgaaaaaataagctatgagaacaagtttgaggcagctgcaggtggaggaagtatttgcaagtgctcaatgaaattctacactgttggcgacaatgtaatcactgaagatgaaatcaaggctctcattaagggaagtgagggagtttacaagcctgttgaagc

SEQ ID NO: 2966 - DNA, 130 bp, Gossypium hirsutum
  Clone ID: uC-gsronu33B109b09b1
attgtcttggcttaacagaactgtaaaatgttccctgttccttcttatatcccattgtcatatgtaacaaaagattccatttgcttttcttgccagaaatatataatacttaaaacatattttttgcttg

SEQ ID NO: 2967 - DNA, 525 bp, Gossypium hirsutum
  Clone ID: uC-gsronu33B109c01b1
cccacgcgtccgcccacgcgtccgcaaaaatggtatcgaaactgccgttcgctcttcggtcaaatctcgatcgatcaaagctcaagcctctggtggagacattgaggatttgacaccgatcaaccctcaggcgaaatcttctggggcagttctgccatttgttggtgttgcgtgtttgggagctatgttatttggttaccatctaggggtggtaaatggtgctcttgagtatctatctaaggatctgggaattgctgaaaatactgtcatgcaagggtggattgtcagcacactccttgctggtgccactgttggttcatttactgggggaacattggcagacaaatttggcaggacaaggacttttcaattagatgctattccacttatcattggagcatttctcactgctacagctcagacagtccagactatgataattggccgctctctggctggtattggtattggcatatcatctgctatagttcctctatacatatctgagatctcgccaactgaaat

SEQ ID NO: 2968 - DNA, 526 bp, Gossypium hirsutum
  Clone ID: uC-gsronu33B109c02b1
tgattttcattcttgtttactgcaccgccggtatctgaggtggtcacattaacccggcggtgacatttgggttgtttttggctaggaaggtgtcgttaataagggcggtggcttacatggtagctcaatgtttgggtgctatttgtggtgttgggttagttaaggcattcatgaagagtgaatacaactcccttggcggcggtgttaacacggtggcgactggttataacaaagggactgctttgggagctgagattattgggacattcgtgcttgtttacactgttttttcagctactgaccctaaaagaagtgcccgtgattcacatgtacccgtgttggctccacttcctataggatttgcagtgttcatggttcatttggctactattcctatcaccggaactggtattaaccctgctagaagcttcggcgccgccgttatttacaacaacgacaaggcttgggatgaccactggatattctgggttggaccaatggtgggagcacttgcggcggcggcata

SEQ ID NO: 2969 - DNA, 498 bp, Gossypium hirsutum
  Clone ID: uC-gsronu33B109c04b1
caatttctcggtgcaaatgccattcttgccgtgtcccttgctgtttgcaaagctggagctgaagtcaagaaacttcccctttacaagcacattgctaaccttgccggtaacagcaagttggttcttcctgtccctgctttcaatgtcatcaatggtggttcacatgcaggaaacaaacttgctatgcaggagttcatgattcttcctgtaggagcatcatcctttaaggaggccatgaaaatgggtgttgaagtctatcaccatttgaagtctgtgattaagaagaagtatggtcaagatgcaaccaatgtcggtgatgaaggtggctttgctcctaatatccaggagaacaaggaaggacttgaattgttgaatactgccattgctaaagctggttacactggcaaagttgttattggaatggatgttgctgcatctgaattttacggaacagataaaacttacgacctgaacttcaaagaagagaacaatgacggt

SEQ ID NO: 2970 - DNA, 475 bp, Gossypium hirsutum
  Clone ID: uC-gsronu33B109c06b1
gagttttgctggtttaattactgcaatgtgcacatttagaaggaccggtgatgcaatagagttagtgaagcaaatggtgcaaaaagctagattgacaccaaggcagggaacagtgaaaaaagttgtggcaactttgcgggcaaatagagagatatggaaagctgttgagttgattgaattcttggagaggaaaggtatccctgttggctttgagagctatgagctagttgttgaaggatgcttggaatgttgtgaatatgttttggctggaaaggtagttgtagcaatgactgagaggggctttataccatatattagggtccggcaaaaggttgttgagggcttagttagagtcaatgagttgaaacttgcctatttagtaagggaaagattttcagaattggggtcttaggctcttcgctgcttttagctcggcatgagtcacctaagtgaagaaaatcagtcattgtcgtga

SEQ ID NO: 2971 - DNA, 426 bp, Gossypium hirsutum
  Clone ID: uC-gsronu33B109c07b1
ctgtttgaagccattacttgggttgtcgttttgaagagaaaatctagaaagtccaccaaaccttgcgacggatacaacaatggccaaagttgatggcatcagcaagcctccaattgcagattttgtaacacccttgtgctttctcatccttgttgggatgttctatttcctattttcagtgtcttgtataattgcttggttccaaatgttggttttttttagcactcgatccttagtacatgttatatagttgtagtataccactgaatatttcagccatcattttgtgtgtttctagtattcgcacagacaccaatacgcaccatgttcacctaaccaaattacaagtcaccaaaccccattgtaattggaattgaaagattgttgtaacacccttgtgctttctcatccttgttgggatgttct

SEQ ID NO: 2972 - DNA, 533 bp, Gossypium hirsutum
  unsure (1)..(533): unsure at all n locations
  Clone ID: uC-gsronu33B109c08b1
tcgccctttcgtccggagagagaaaaaaaagaaagaaaaaatggttctgctagacaaaatgtgggacgatgtagtagctgggcctcaacctgaacgtggtctcggcaggcttaggaagatcaccacccagcctttgtccatcaaagatgaaggagaaaagaaaaagtaccagaggtcgttgtcgctgccgaatagtccagtgtcaggtccgacacccgtgacaccgacgactccgacggcgcgtaaggagaacgtgtggaggagtgtgttccatccgggtagcaacctagccaccaaaagtataggttctgatgttttcgacaagccacaacccaactctcctaccgtctatgactggctttacagtggggagaccaggagcaagcatcgctgagagggtggcgactgacaggcggctagcaggctgctctcgtgagccagggctgcatgtaaatagngngtcttctcttttcttttctttttcaatgttctattttgtctgtctttgtctcttgatgctattttgatgtctc

SEQ ID NO: 2973 - DNA, 430 bp, Gossypium hirsutum
  Clone ID: uC-gsronu33B109c10b1
aaaaatttgtagatttagcaatgagatgtgttgaagaagcaagaactgataggcctacaatgggtgaagtagtgaaagagattgaaaacattatgcaggtagccggtttgaatccgtatgcggaatcagcttcgagttcggctacttatgaagatgcaaataagggaactcctcaacatccgtacggtaataaaatttaaaggtattcattaaatgaaccggatttgatttgggttgaaccgattgagtgaggacttaaaagcctacaagatagaggcctttggaatttggatgtcatttctattactagtttgatttgctttctaggagcaatgaactttgtaacaatgagaggtgcttgagttgattgtgggatcttctatttttattttgttgcatattatatgataaaattgtaatataaaatttg

SEQ ID NO: 2974 - DNA, 499 bp, Gossypium hirsutum
  Clone ID: uC-gsronu33B109c11b1
tttactcgtccgcttttatttagggttttcgattccttcatctttatctgcgatcaagcaaccatgactggcgaagccaagccaaagaagcacacagccaaggaaatagcggcgaagatcgacgccgccacaaccaatagaggcggcggcaaggccggatttgctgaccgttcgggtgtggagaaaggtggacatgctaagtacgagtgtcctcattgcaaaataacagctccagatttgaagtcgatgcagattcatcatgatgccaagcaccccaaggttccctttgaagagtcaaagcttgtgaatctacatgctgttcatgtggttgagacttccaagcctcgtcctggtgttaggggcagccttaaaaagtgataaaaaaccccaaaaaatgtgtttttcgtcaagctttggtgttttgtgatgtttcgaaatatgggtttggttcctttttcatcttttaattgtttgtcacgcttgcagtagagatgggaat

SEQ ID NO: 2975 - DNA, 451 bp, Gossypium hirsutum
  Clone ID: uC-gsronu33B109c12b1
atgctacaatgaatcccgaatatgactacctgttcaagcttctgcttattggagattctggtgttggaaaatcttgtcttcttttgagatttgctgatgattcatatgtagaaagctacataagcaccattggggttgattttaaaatacgtactgtggagcaggatgggaaaaccattaaacttcaaatttgggatactgctggacaagaacggtttaggacaatcactagtagctactaccgtggtgcccatggcataataatcgtttatgatgtgacagaccaagaaagcttcaacaatgtcaagcagtggctgagtgaaattgatcgctatgctagtgataacgttaacaaactactggttggaaacaagtgtgaccttacagctaataaagttgtgtcatacgaaacagccaaggcatttgcagatgaaattggcatacctttttt

SEQ ID NO: 2976 - DNA, 494 bp, Gossypium hirsutum
  Clone ID: uC-gsronu33B109d04b1
ctgtattcgaagggttcatgaacatgtttcttgaggaagaagctgactttgctataacgatgatagaggctttcggaggcagaatggatgaaatccgggaaaatgaattaccttacccacatagagcaggcatcttgttcgaatccacttacattgtccaatggacaaatgaagcagaagcgggaaggtacataagctggatccgaagactctacagttatatggccagttatgcttcgaaatctccgagagaagcatattataattacaaggatctagatcttggaactaacaacattgttggttacacaagttacgaacaagctagcgtttggggtcttaaatatttcaagaataactttaaaagattggtgcagataaagaccaaggttgatccaatgaatttctttagaaacgagcaaagtacccctcctctttgatctccatgaaagaagaaggtcgtcagggttgaagattgagtttttttcttaaac

SEQ ID NO: 2977 - DNA, 115 bp, Gossypium hirsutum
  Clone ID: uC-gsronu33B109d06b1
aataaaataccaattatatacaaagaggggatatgttaaaaaaatttgggggggggggcggcctctttataggttccaggctctttgtctcgtgcgcgcgacacaataagtttgt

SEQ ID NO: 2978 - DNA, 241 bp, Gossypium hirsutum
  Clone ID: uC-gsronu33B109d09b1
cttacgcgttcgcccacgcgtccgcccacgcgtccgcccacgcgtccggtccagtagctaatgatctttcagctgctaaagatcctatggtgataattagtattattttgtattttgtatttgggctatgactatttgaccaaaactgtcatggcctccatgttgttgctgaatttcaattttagttattttggttgggatttatcagtaataaattatgtgaatagatattgtggaattc

SEQ ID NO: 2979 - DNA, 490 bp, Gossypium hirsutum
  Clone ID: uC-gsronu33B109d10b1
atttatccttgatcagcaacccataaggtttcttttctgtttttgtttttttgtcaatcaatcaatcatgacaggcaaagccaagcccaagaagcacactgccaaggaaatcgcagccaagatcgatgccgccactaccaaccgaggtggtggcaaggctggattagctgaccgttctggggtggagaagggtggacatgccaagttcgagtgtcctcactgcaaaacaactgctccagatttgaagacgatgcagattcatcatgatgccaagcatcccaagcttccttttgaagaatcaaagcttgtgaatcttcattctactcatggtgctgattcttccaagcctcgtcccggtgttaggggtagtttaaaaaagtgatattaataaataaatttagccgttttctttatgattttgtgctttgctgctgtttttgaatcttggtttcatttcttaactattagttctagtaagtttgggtaaaaa

SEQ ID NO: 2980 - DNA, 409 bp, Gossypium hirsutum
  Clone ID: uC-gsronu33B109d12b1
gatctctctcaagaacacagttgaccctgactgtgggggtgttggtatcctgggtattgcttgggcctttggtggcatgatctttattcttgtttactgcactgctggtatctctggaggacatatcaacccggctgtgacctttggactgttcttaggacgaaaggtatcactgatccgagccatcatgtacatggtggctcagtgcttgggtgccatatgcgggtgtggattggtcaaagctttccaaaagacttactacaacaactatggaggtggtgctaatgagctccaaagtgggttcaacaagggcaccggtttaggtgctgagatcattggtacctttgttcttgtctacaccgttttctccgccactgatcccaagaggaatgctagggattcccatgtt

SEQ ID NO: 2981 - DNA, 516 bp, Gossypium hirsutum
  Clone ID: uC-gsronu33B109e01b1
cccacgcgttcggaaaatatcacaaatcttcttctgcttctcagaaatcttagtatcatcactatggcctcaaatcccaaggtcttctttgacatgacgatcggtggtcagcccgctggtcggattgtgatggagcttttcgcagattgcactcctcgcactgcggagaacttccgtgccctctgtactggcgagaaaggcgtcggccgcagcggtaagcccctccactacaaaagctcttctttccatcgtgtgatccctaactttatgtgccaaggaggtgacttcaccgccggaaacggtaccggaggtgaatccatctacggatcaaagttcgctgacgagaacttcatcaagaagcacactggtcccggtattctctcaatggctaacgctggaccgggaactaacggatctcagttcttcatttgcacggctaagactgagtggctcgacggaaagcacgttgtgtttggacacgttgttgaaggcatggatgtggtgaaagccattgag

SEQ ID NO: 2982 - DNA, 260 bp, Gossypium hirsutum
  Clone ID: uC-gsronu33B109e03b1
gtgaggcaccttctccttctccggacgccggtgccggtttctccgtgggcgtttccaccgctgctgttgggttttctttggttgtgtctcttcttgctttgttgaaagcttaaatttatgggatttttttttgggggggttttttgtaccattgatttattattgggttttgtttttaatttcattctttgttacttcgtgggattgattgtaatgaagttgattcattgaatattataattatatttttttatggtgtt

SEQ ID NO: 2983 - DNA, 492 bp, Gossypium hirsutum
  Clone ID: uC-gsronu33B109e04b1
atctgtcttgatccccagtgaataattataatttgaaaggtgaagaaacgaaacagggggtggggttttattttcttgtggcccagaccacttttaggtttcagaggaatggcggagaaatcgtgtgttaagcgccttcagaaagaatatagagcactttgtaaggaaccagtttctcatgttgttgctcgtccatccccaaatgacattcttgagtggcattatgtgctggaagggagtgaaggaacgccttttgcaggtgggtattattatggaaagatcaagttccctccagagtatccctacaaacctcctggaatcaggatgatcacccccaatggacggtttatgacacagaagaaaatatgcttgtccatgagtgattttcatccagaaagttggaaccctatgtggtctgtatctagcatacttaccgggcttctctctttcatgatggataatagtcctaccactggcagtgtgaacactact

SEQ ID NO: 2984 - DNA, 111 bp, Gossypium hirsutum
  Clone ID: uC-gsronu33B109e06b1
gttggttggatgacaaagtatgcatgttgtgttacatgtgctttccagttcagtggatgattatgatatgtttggaagtttgtttggctatgttgattatattagaccttt

SEQ ID NO: 2985 - DNA, 511 bp, Gossypium hirsutum
  Clone ID: uC-gsronu33B109e07b1
ttcttttgcttgcgcggctgggcttagtttaagcggagagggtgtgcaggattaaagggtcaccattgtttccaacatgatgcttaataacaagtttttgttcttatcagctttgttttgcattgctgtagctggcgctttaggccaagctcctcctactcctagtaatcctccgacatccacgccggtgccgccgaccccacccgcttccacacctccgcctactacccaaccacctccaacacccaccaccagcttctcctccaccggctactcctcccccagctaccccacctcccgcaactcccccaccggcttctccaccgcaggctaccccaccacctgcttctccccctcctgctactcctcctccagctaccccaccaccagctcctttggcttctcctcctgccacggttccagctccggcccctagcaagaccaaagctaagtctccagcgctatcaccttcggtctgcagcccaccgtctccatcaactgaggcccctac

SEQ ID NO: 2986 - DNA, 497 bp, Gossypium hirsutum
  Clone ID: uC-gsronu33B109e08b1
tccacgcgtccgaaaccagttgcatgcagcaggggaatgtagaacccaaactctcttcttcgtaaaccaaacgtctccaagaaactcctctcccccaaaatggcgatttcttatattcatctcttcatactatcgttcgtttccatttctcgcttccttgaaatttcaaaagctggagcggaatcggagcttgtagccgatcttttaacccttcaatcgcaatcagaatcgggtgttatccacttagatgatcgaaccgtctcgaaattcatcacttccaccaaaacccctcgtccttactccctcctcatcttcttcgacgccatcccattacacgacaaatccgacctccgcctccctgtgctcgtccacgacttcgccctcgctgcctcttctttcatcgccaaccacaacagttccaacaccaagttgttcttctgtgacctcgagttccgtgaatcccaatcctcgttcaaactcttcgacgtcaatgccct

SEQ ID NO: 2987 - DNA, 459 bp, Gossypium hirsutum
  Clone ID: uC-gsronu33B109e10b1
atatctctcactcaacgcagagcgaataggcggagacttccaagaatctatcgcatcagctaatcacgctctaaagaatggatcaggttcaacacccatctatcatgcagaaggtagcaggccagctccttcgttctagccattctcaagattttcaaggttataatgggtctttcaggagtcctgctctataccaaaggcgtgctgcatatggcaattactccaatgctgctctgcagcatcctgtccgggcttttggagacctgtctatggttccatcaacagcttctgctatttgcgttcaggctcctgctgagaaaggatttagcggctttgctattgatttcctcatgggtggagtttctgctgctgtatcaaaaacagctgctgcaccaattgagcgtgttaagcttttgattcagaaccaagatgaaatgatcaaaaagtggaggctctctg

SEQ ID NO: 2988 - DNA, 415 bp, Gossypium hirsutum
  Clone ID: uC-gsronu33B109e11b1
ttttcgaggagcatagtaggagtgaaggatgttagggaccctaacactactaccgtgaagaagattaatggagaatatgaccacaagagtcaagcaaatgtttatgacgataatcatgataatgatgatggttctgttaagggaactgaattaccaactgattaatggcttttaagtttgtagttaagatgatgtgatcatggatagctttcattatataaaaaaattatgaaagaatgatgattagatttcgtagtataaataagcttagtttcctttcattttgcttgtaaaaaatattaatctctaggcatgtagttcgatgtataccatacttaatttagttgatgaaatctttataaataattgtctttcttttttccccttgtttggtgaaaaaagaaaagcattaagc

SEQ ID NO: 2989 - DNA, 440 bp, Gossypium hirsutum
  unsure (1)..(440): unsure at all n locations
  Clone ID: uC-gsronu33B109e12b1
ctttaatgagggtggtgcagttggtgaaagaccaggcatccaagttggaaactaatctaaggtccctcaaagattcttcttcttcttcttcttcttcatctaagcaagcgaggcgtttctctaacacggtggattccgggactgtgaaggcggctgccgccacaaatgacaggttgaagcaagcggaggagtcattgaggaccgtcatgttcttgagttgttggggtcctaactcatgaaccccccctcccttattttatgttaaaagtacaagggaattgtataaattacttggatgtacatacacatcttttttttaatcttatatatgaattatatagataatagatatgcaattgtttcaggattttgcatgaggttctttttatgtctatatttcctctaataataacangtaatgctttagatcatgtttttat

SEQ ID NO: 2990 - DNA, 524 bp, Gossypium hirsutum
  Clone ID: uC-gsronu33B109f01b1
caatcttgaagtagcccatcatcatatcatacggtggaaaacaaaagtaaggcatccagttactgcagctttggtcatctaccggttagtctaataatacactactctaagatacgatacatatgcctttggttctgctgtaatggatctcttgtagtactgcaacaagttgtttcaagagtgcaaatgtagacacccgaggttgggtttgtactcaccctcagggaggctacatgattgatacaaataggataggggagccctgaaagttagaactgggatttgatgcgagtttcaacaggttttaatcttatataaatcttttgcaaaaaaatcgtttctcatcatttttaacaggcttcaacttgagcaatcaggaatttgctagtttaaacgcaatcatgatggcagtactacaagtgaatgcatctctgttctgtttctgaatatatgtatgtaaagcttatggtaattaataatgcatggtacttgcatgcttaagataaaattgggatcaaattttg

SEQ ID NO: 2991 - DNA, 89 bp, Gossypium hirsutum
  Clone ID: uC-gsronu33B109f03b1
aaaatattaaaacatacatttcatagattactgaaaacatattctgaaacaatcattcacatacatattttccttaaattgaaccctct

SEQ ID NO: 2992 - DNA, 498 bp, Gossypium hirsutum
  unsure (1)..(498): unsure at all n locations
  Clone ID: uC-gsronu33B109f06b1
gtcaggttcaggttcagctgagggttgttggattattttcagataacaaaagatggcagctgcaatgaaactcatctctgttctgggattgattgtgcttattagcctgggaaaggtggttgatgcagcaggggaatgtgggaaatcagctcctgataatgaggcaatgaagctagccccatgtgctgaagctgcacaagacgagaatgcccctgtttcagccagttgctgcgcccaggtgaggaaaatcggccaaagtccgaaatgtctctgtgccgttatgctctctaacactgctaaagcatctggaatcaagcctgagattgccataaccatccctaaacgctgcaacatagccaaccgtccagtcggttacagatgtggagcatatacacttccttgaatggaaaatttgggagacataaaaagtgctggagctcacttgttgtaccacttaatatgtagctttaagcttgtctntgtatgaataacagctta

SEQ ID NO: 2993 - DNA, 451 bp, Gossypium hirsutum
  Clone ID: uC-gsronu33B109f07b1
tttgctttaattagttgctataaattctcatgtgaaatcctctctcaattcttcttcttcttcttcttcttcgctgctaaatcatagtcattatccgcatattatgttagcccttcaaagctccgtcaacaatggcgaaaacgacccaaaccacgaccaacatcacgatcacgacgatcaagacggtgaacgtatcagagacatccatgctttaaccccaccacaccctcccgccgtcaacgcccgtcgtcgttgggaaaccggaagcagccgtgcatcgtcatcgagcgaagtagctccgagtgaaaacttcaccaccatgagccgagaattcaatgctctggtcctcgccggatcttccatagaaaacaacgattccgattccgtacatactttgaataacaatcagctgacgaggatcggtgaagatcatgaactgcaagaggaaact

SEQ ID NO: 2994 - DNA, 479 bp, Gossypium hirsutum
  Clone ID: uC-gsronu33B109f08b1
ttgtttaaaggttaaaacatacccgatagcactcgcaatactattttagcaattttaacctcttgcatttgcatccgcttttgtgcttggctgatggtgtgttcatcttgtcaaacacttatgaaattacacaaatttaaagggaaaaagtgtaggattatagaagttataattacaataacattaggggaatcattaggtgggttaacaataggtggagcaaatgcgagagggttatgcaattcaatttgatgtcgaatatcaagaacaatatcttcataatctggcttgttcaaacagtcatcacatgcacaacaatccttgcagtaaatccctgctgcaaagcactcacaataactgccaatcacaacaaacaacaaaactcaacagatgttccaaacatcttcactttttttgagcaccctctgaacattcagggtatgatgttccaagcatcttctaaatacatgaagaaaact

SEQ ID NO: 2995 - DNA, 465 bp, Gossypium hirsutum
  Clone ID: uC-gsronu33B109f09b1
tccgccgcacttttttttgacatccatttcaactatcaaggctagggtatggctgatctggtacttggtggtgtagatgtcaccggaccccatttacatactatatacccccatggatctactgacacgttgccatttgctacgatgggttctggttctctggcagcgatggcagtttttgaatcaaattacagagaaggccttaccagagatgaaggaataaaacttgtaactgaggccatatgctctggtatcttcaatgacctaagaagtggaagcaatgtccatatttgtgtaattaccaagggcggtaaagaatacttgaggaaccatcttcaacctaaccctcgcacttacaccagtttcaagggctattcgttttcaaagaagacagaaggcctattgacaaaaatcacgccattgaaagagaaagttgagatcattgaaggaggaggagatgtgatg

SEQ ID NO: 2996 - DNA, 486 bp, Gossypium hirsutum
  Clone ID: uC-gsronu33B109f10b1
ctctgtttcatctgcgtaaattgttccaaaaggggtcaacaaaaatgggttatttgaattgcattgctttagcattcttgatggctttgtcgtttccaagcattaaggttggccaagctactcgtcaccttcagcagctgcctccaatgccaactttgcctacagcaacactcccaccatttccatctatccctaatatcccacagccaaccataccaacaatgccaaggcctggggcgcttccaccacttcctaccatgcctgctttgccctcattgccaagtgtaccaagggccacactgccacctctgccgagcatgccctcaatcccaactgctattccctctattcctttcctctctccaccaccttgtgcttctccttctactccttgaatacccctttgttttttatctgctgcataatggatttggtttaatatgtttctagtcgaccttgtctgttgattttgaggatttgttttta

SEQ ID NO: 2997 - DNA, 456 bp, Gossypium hirsutum
  Clone ID: uC-gsronu33B109f11b1
accagcaaacttaaaagcttcggtgttgattttcactttgaaaaacaaaaagggataggatgaagactatgatgcgcgctgttcaatacaggcaatatggcagtggagtcgccgatctcaagcaagttgaagttccggttcccagtccaaaaaaggatgaagttttgatcaaagtagagacagctagtattaacccaatcgactggaaactacaggacggggtagctcggccatttttacctcggaaattcccccacattcctggtaccgatgtagctggagaagtcgtacaagttggatcagaagtccagagtttcaaagttggggagaacgttgttgccgcacttggtaatggaggtgcactagctgagtatgctgtcgctaatgaaggttccacagtttcaaggccttcagaggtatcagcccgtgaagcggcggcttttgccattgctggcc

SEQ ID NO: 2998 - DNA, 526 bp, Gossypium hirsutum
  unsure (1)..(526): unsure at all n locations
  Clone ID: uC-gsronu33B109g01b1
gtgcgctctcgttcgttgttccttccgctcccctggcaggcgcttgggtgggctgttgggcggtgtgcatgggcgctactactagtacgcaataggcatatgagtggtgttttggttgtgtgtattggcaggctccatgctactcgcatcgaactgtcgagccgcactcctcttcattaactccccttgttgtaatcgaactcaaggggtgcgatcgggatcctgtgctgcgtacctaagccagatggaattatggatgtgttgccgtcccttctccatcccgtgcccttcggggtgcgtggtggacctcaatcgtgccttgtgtcccgagtgcgcccccttaaatcggtgtggcctcgtcggtgcactggtgctcgatcgtgctttcggatgcggaaaatgtttttgagagtagggttcatgccctcatctctcgatgcctatgcattttgtctcttgacacggacgatgctcgtgctctgttatgacctcttcgtagctcacggngcatgttgagggccatgca

SEQ ID NO: 2999 - DNA, 425 bp, Gossypium hirsutum
  Clone ID: uC-gsronu33B109g02b1
cagactcattatctccggagttgcgccagtgaagatggcctttgtgggaccagagatgggcactactgaatcaggacatggatgcagctgtggatcaagctgcaaatgtaatccatgcacctgttgaaaagcttgatgaaagccatagattatgaaaaaagaaagcagcaaaataacaggcctctgtaatgatttattttcaaggatggatgcctgcaaggtctataattatgtctctctctgtcttgtgtaatagaagctttgtttgtggtgaaaataatgtataagccatttggttgggagcaaattttccttttgtccaaaggatttttgctgctcattcatggtgacttggtttatggttttatctgttgttgttaaaatcttataaaaatatatatcgattgctgcttttggtttgtatt

SEQ ID NO: 3000 - DNA, 493 bp, Gossypium hirsutum
  Clone ID: uC-gsronu33B109g05b1
gaaagatctcttctcatgtctcagaagagactagagaagcgatttggtcaatccccggtatttatcgctgctaccttcatggaacaaggaggcattccaccatcaaccaatcctgcaacgcttttaaaagaagcaatccatgtaattagttgtggatatgaggacaagactgaatggggcaaggagattggatggatttatggttctgttacagaagatattttgactggttttaagatgcatgcccgcgggtggatatcaatttattgcatgcctcctcgtccagcattcaagggatctgctcctatcaatctttctgatcgtttgaaccaagtgcttcgatgggccttgggttctattgagattttgctgagtagacattgccccatatggtatggttacaaaggaagattgaggcttctggagagactggcatacattaacaccattgtttaccccctcacctctattcctttgcttgcttattgtatgc

SEQ ID NO: 3001 - DNA, 445 bp, Gossypium hirsutum
  unsure (1)..(445): unsure at all n locations
  Clone ID: uC-gsronu33B109g08b1
gtcatgactgattggagccatgcaccatttgtggcctcctacaaaggcttcgaagtcgacgcatgcgagtgcccggtttccgtaacagtagatgagatcgccaagaaatgcagcagcagtgctgagaagaggttctggtgggacgagccgacaatgtcggagttaagtttgcaccagagccaccaactggtgtgggttagggcaaaccacttggtctatgactattgtactgatactgctaggttccctgtcaagcctgtagagtgtgagcaccaccgtcactagtagaccagctaaggcaaaaggggttcttttgggtacattgtaaaaacatgttgtatggggcactgggcggtggaagaaccttagtcataaaaaaaacatgtactccatgtttcatattttggtttcttttagtttccanannanaaaannnnnnnnnnaa

SEQ ID NO: 3002 - DNA, 397 bp, Gossypium hirsutum
  Clone ID: uC-gsronu33B109g09b1
ttcatgcgtgcggtagacacagttgttgatgtgggtgatgaagatgctgatgcaggtgctgtggcaacagctgctggaggcggtgaaggaaccgctgtcaagggctcctttaatgctgcggatctgagatcacacttgatgtcacagtacatgtcagcccaaatgtcaccgattcagcccttgcgtatgctagatcccacaagttatccaaatcgatcccacgtgctattagacaaggtcccagttgaagtcagcgaccagtacgaagacctttcagtaaaagcgaagatatagttgagtatattattgcaaactatgtcacaggctatgacacttggggcgatagcaaggacatggcatgccagtgcccgtgccattgtttatgagcatgcacaac

SEQ ID NO: 3003 - DNA, 451 bp, Gossypium hirsutum
  Clone ID: uC-gsronu33B109g10b1
cccacgcgtccgaaaaaaaaaaaaaaaaaaaaaagcacccccgaaaatgcgaagctctagattctcgatgttcctcgcgatttgcgcaatcctggccatccacgtggcggttacaacttcttctccgacgtttgatttcgccggcgaccatttcctccagatcaaatcggaatgcagcggatccaccgctgagtgcctgatgcaaggcggggaggactcgtcggacttcgatgccgagttcgccatgggatccgagatcagcaggcattttagcggcgagacggtacatcagctacggtgcactgaggagaaacactgtgccgtgctcgcgacgcggcgcatcttattataactgccgacctggagctcaggcgaatccctactcacgcggatgcagtagaattacacgctgtcggcggtagatttatttttacaagtctttttaaataat

SEQ ID NO: 3004 - DNA, 416 bp, Gossypium hirsutum
  Clone ID: uC-gsronu33B109g11b1
gttttaccgtggatgacatgtacaaggcatgcgagagatttgaaagtcttggagtagaatttgtcaaaaaaccaagcgatggttttgcattcatcaaggatcctgatggttattggatcgaaatctttgatttgaaaggaattagacaaatagttaacagtttagcttaagttaatgcttcaccaagttcaggaaattgatctgacaaactcaagtgaaatcttaattgaagcacatttcattctagttatgtttatgttttctttatgtttgatgtgtataacaagtaaggtgaaaataaagagttttgtaagagaaaattcaaccttgaaatttactaaattctatttatattacatataaatttgtatgccaatgtatcatgtacgtgctttacaaagtcatgaatgaagtag

SEQ ID NO: 3005 - DNA, 278 bp, Gossypium hirsutum
  Clone ID: uC-gsronu33B109h01b1
gaagtcttgaaactaagattaataaattagcattggggaataataaataccacggcaaagctaagggtaaaaaaaaaaaaaaaaaaaaaaaaaaaaaaaaaaaaaaaaaaaaaaaaaaaaaaaaggggggaacggtctaaaaggaaaacaaaacttaaaaagcccaagcaagcaaaagaaaaaatactataaaaggaaaacggagggccatttaaggggcggcgatttaaaaagaggcgaatggaaaaaacctggcattaccaaagtgaatccaattg

SEQ ID NO: 3006 - DNA, 407 bp, Gossypium hirsutum
  Clone ID: uC-gsronu33B109h03b1
cgcagtattcggggggccacccacgcctccgattcttgaacggacgcgtggccggacccgtgggtgcggatttctgcggcttactgtctctgttgatttgatgtttcataaattataataatatataatcatatcaaagcgcgcccattaatatctatcttcttcttcaaagcttggctttttcagccaacccagattagttttggactcaattctgcagaaatttccggttgagagttcttgggaagagattaattgttgtaaatatcggaaaccaaccacttcagaggaatcttggcatatttgcaagtcatttagattgatatttctgtatagatttggggataacaccatattgggtagggtttagattttggaagaatgctagtgtacaagatcagttggag

SEQ ID NO: 3007 - DNA, 454 bp, Gossypium hirsutum
  unsure (1)..(454): unsure at all n locations
  Clone ID: uC-gsronu33B109h05b1
agaatatgttagattgggagctaacaagttctcagaagggcagcctattgggacagcagctcagtcccaagatgataaggattacactgagccaccaccagcacccttgtttgagcctagtgagttgacctcatggtctttttaccgagctggaatcgctgagttcgttgctactttccttttcttgtatatctcggtattgactgtgatgggagtccttaaggacaaaaccaagtgtacaactgttgggattcaagggattgcttgggcttttggtggtatgatctttgctcttgtttactgcactgctggtatctcaggtggtcatatcaatccagcggtgacatttgggctgttcttgggaaggaaattgtcgttgacaagggcaatatactacantgtgatgcaatgcttgggagccatatgtggnngctgtgtggttaaagggttcatg

SEQ ID NO: 3008 - DNA, 138 bp, Gossypium hirsutum
  Clone ID: uC-gsronu33B109h06b1
ctcatttattttgtctgtggaatgtgtctttgttgacaggatatactggtttgcatgattagcttgtttggaaggtaaaaaatacactgaaccaccaccaaaacccttgatagagcctaataaagctgacctaacggg

SEQ ID NO: 3009 - DNA, 400 bp, Gossypium hirsutum
  Clone ID: uC-gsronu33B109h08b1
gtgtgttgtgtcaggcccttaagcagctgatgctgggttcttgtcaccagttcagttcttgtacaaggtctttcataaaaccatatgatggcttgactatggggatagagagatggcttctgtattcacttcttgtatgctagctgcttactctactggattgcgcttgagcttagatgcgagggatatactcctattgatatgagtgtaggtggaggatacaatgctttctacatgttcgttagtggcacctgtgtccatgtgcagggacattgaggcatctctggtgatatggggcctacgggcatcgattatatgaggacatgtacatacactctggtgtttctaggctagcttcaccttattaacaacctagatgttgccctcaaaaaaggttgaa

SEQ ID NO: 3010 - DNA, 443 bp, Gossypium hirsutum
  Clone ID: uC-gsronu33B109h10b1
ctttctcgtacgaaactctactgtatgactatggatggattttcatcataataacaaagatgtatgaagaaaaataaactagtttgttgttaccttttggtagcttaatttttccattttgaaagtccgattgtcacagcaggtaatttaatggaattaatacaggttggaatggttggtgcgaaaatgctgcaattgctgctgcacctgaggtgctatcttattacattttccatgtcagctacacaaagttcccgatgcagatactgtacaaactaacaaccttcggtcaactcttgtttcttgtctttattttctgcctttcctgtagctgctagtactgctgacccattccgttgatagaattttcacaactgcataagacaaaaaaagaaaaaaaaacatttgtgacatgattcttcaaacatgtcattacttttgag

SEQ ID NO: 3011 - DNA, 504 bp, Gossypium hirsutum
  Clone ID: uC-gsronu33B109h11b1
gttgttctagctgcagctgcggcgacagctgctcaggcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggctttatctgttgttaaaatcttataaaaatatatatcgattgctgctcttg

SEQ ID NO: 3012 - DNA, 418 bp, Gossypium hirsutum
  Clone ID: uC-gsronu33B109h12b1
gtcttttgactctgcagtttactgtcaccagactggggaacttatcacccttccatacaatgctgccatgccagtgtccctcaaggtccttgagcatgaaattttcacaatagcacctatcaagaatttggctccaggattcagttttgcacccttgggactcatcaacatgtacaactctggtggtgccattgtggatttaaagtatgaatttaaagatggtgccaaactatctgagcttgatattgaatatggaagtgaaagcagtggtcttaatgtgagggcggagaattctagcaatgaactggtgggaaaggtttgcatggaaataaaaggttgtggcaactttggtgcttattcatcagccaagccaagaaagtgcagcgttgggtacagtgaagttcagttcgactatgat

SEQ ID NO: 3013 - DNA, 425 bp, Gossypium hirsutum
  unsure (1)..(425): unsure at all n locations
  Clone ID: uC-gsronu33B110a01b1
tttctgctttccattttgccctttttgtctgtgtgtttgagggttcagtcaatcgaagaagatgatgcacatgaccttgtactggggaaaggacgtgactctgctcatcgattcctggaagactgattcatggctgagttacctcctcactttgcttgcttgttttctcttctcttccttttaccagtacatggaagatcgacgcctccgtttcagatcccttgcttcctccaacccatccccgccttcctccgccggcgcttctgttcctctcctccccaaataccgccgctccgctaaattcgcgacggccttgctcttcgggatcaattcggctatcggttatctcctgatgttggccatcatgtctttcaacggaggcattttcttggctattgttttgngactggcttgtgggtacctga

SEQ ID NO: 3014 - DNA, 466 bp, Gossypium hirsutum
  Clone ID: uC-gsronu33B110a03b1
tttaaaaagggctttcggttatggaaagaatgatagattctctatgtgtatgggaatattggcttgcttgtttgtttgtttaattatagctaataggctgagaagattgcaactctagtcaaagctgcaaatgtctctgttgaatcttattggccaagcttgtttgctaagctttttgaaaagtgtaacattgaggatctcataaccaatgttggtgctgccggtgctggtgccccagttgctgcagctgcacctgttgcagctggtctggtgggtggaagctgctgctccacctcctgccgaggagacgaagaaggaagagccagaggaagagagcgatgatgatatgggattcagtttatttgattaggagctcctttcagtttatgaattcgttgattactggttcattgcagtaagctatgacagtagttacctattgagctttattgattctggtatatgt

SEQ ID NO: 3015 - DNA, 336 bp, Gossypium hirsutum
  Clone ID: uC-gsronu33B110a05b1
ccctctcgtccgtacatcttcgctttgagattagatccaaaattctcctttcctcttatttccgattccccaatttttcctgaaaccctaatcctaatcccagattcctcctgtctacatcgtttagcaaatggcaaccgaggacccggcagtcgtggcagaccccgcacccgagacggaggaggacaagactgctgagaccaaagctacttcaaaatccggcagagcaaagaaagccaaagaacccaaaaccaagaaagctgcaactcctaggaaaccacgggctgctcctactcatgctccttacgaagagatgatcaaagatgcgatcgttac

SEQ ID NO: 3016 - DNA, 368 bp, Gossypium hirsutum
  Clone ID: uC-gsronu33B110a08b1
cttctattgatccctcgatcggtgcaacaagatttcaacaatcgtagaagcctccgctcaatctccgccgtcaaaccagaaggagctccggaagttgaccccagaacccaccgcttgaaaaaaccagcacccccggtcaagcccggagctccacccgtcctcccaatctacgacgcaatggctccaggcccatcgctagctccggcaccagctcccggacccggcggacctcaccatcatttcaacggaatgaggcaagtcaaagatttcatccaaactctgatacaatacggagggtacaatgaaatggcggacattttagtgtacttaacatcgtatagccaccgaattgggacgtctggccttcc

SEQ ID NO: 3017 - DNA, 501 bp, Gossypium hirsutum
  Clone ID: uC-gsronu33B110a09b1
catttgtatagatgaaattcccgaatacatgaaaccaagctacaaggctctattagatgtttatgaagaaatggtacaattggtggctgagcatgggagacaatatcgtgtcgagtatgcgaagaatgcgatgatacgacttgctcaatcttatcttgtggaggccaaatggactcttcaaaactataaaccatcattcgaggagtttaaggctaatgcattgccaacttgtggttatgccatgcttgctattacatctttcgtcggcatgggagatatcgtaacaccagagacctttaaatgggcagctagtgaccctaagatcattcaagcgtccacaattatttgtaggtttatggatgatgttgctgaacacaagttcaagcataggagagaagacgattgctcagcaatcgagtgttacatggaagaatatggcgtaacagcacaagaggcatatgatgtattcaacaagcatgttgagagtgcttggaaggattt

SEQ ID NO: 3018 - DNA, 375 bp, Gossypium hirsutum
  Clone ID: uC-gsronu33B110a11b1
tctccacgcgtccggcttgtagtagtggaaaacatgagtagaggttggagctacggtggcggccaaagttccttgggctacctctttggtgccgatgagcggccaagtgcacccaccgtcacaccaccgatccagcctccatatggcatagatattaccccagagaacccttccccttaatataaaccaagttcaaaagaacaaactgagaaaaacaccaccaacaactatcagagggctaaaggacagaatgcaggcaactttataactgatcgaccaataacaaagtgaaatcaagttcaggtggagaatcctcccctggttacctgtttggagacaagtgatgcaatgattaattccttcttacaagttttt

SEQ ID NO: 3019 - DNA, 457 bp, Gossypium hirsutum
  Clone ID: uC-gsronu33B110a12b1
gtcaatttggtaacttattagtattgttgtgtttcaagtgttgtcttccaatgcatttggttagattggtaatacttgcttcagctgccaactttaaccaagacatcgaagttacttggggtgatggcaggggcaagattctcgaaaacggaaaccttctcactctcaccctcgacaaattctccggctctggttttcaatccaagaaccagtatctgtttgggaagatcgatatgaacattaaactggtcccaggcaactctgctggcactgttaccacttattatcttcgttcggaagggtcgacatgggatgaaatcgacttcgagttcttggggaacctaagcggagacccatacatagtccacaccaatgtatatacacaaggcaaaggtgacaaagagcaacagttctacctttggttcgatcccaccatagactttcacacctactccct

SEQ ID NO: 3020 - DNA, 478 bp, Gossypium hirsutum
  Clone ID: uC-gsronu33B110b01b1
tttacgcgtccgtgaatatttggcggaaaacatgaaagaaaaaggaattaaaataaaaaaggaaatgaaatcatagcaaaaagatgtggtattgggtcatttgtcctatatgcgcaaatcaaaatcgggcggatctttactcggagtagagcataaacctaaaaaaattgaataaaaaattgatgaaacccattcaggaacaagaaaatgacatcgtgatttggattgaatcccaatgaaaaaaaaatagatcaatgaaaagtttgtgcgataagtttagcgaatttttctatattatagattataggaaaacgggccaaaacttatctttctttaatttcattttatttaaaaaatgtaagataaagccccttcgttagaaattagaagttagaaaaggcacactagaacaaacgaatgatggctggaatctacacattgattctttgttcgcaatttttgttgatccgtatgcatc

SEQ ID NO: 3021 - DNA, 331 bp, Gossypium hirsutum
  Clone ID: uC-gsronu33B110b02b1
ttttgtccatccgtatagagttaggcctttatgcttatggtggctcatggcccgcagcatatcaccacagtcctgtgcagtactcccgtgtaggtatcaaggacattaagaatggactgcacgttaactgtaaattctgactagaccaaagactcgcatgggcagaggatgagatcttacaaggactaaacaggccggggaaacacataaagtgcaactggctcaaatgtaactatgatcaatgtagatactataccagaacttatcactctaggtatatctaatggatctgaatcgactatgcaccttatggtgggaaccatactgacac

SEQ ID NO: 3022 - DNA, 129 bp, Gossypium hirsutum
  Clone ID: uC-gsronu33B110b03b1
ttctcgggcggccgttcgccccacgcgtccggtcatgtactaattttaggttttggactgcaatgatttggtttgtaaaaggatactaaaatgggctgtttgtgttttaaactttttgtttattgattt

SEQ ID NO: 3023 - DNA, 348 bp, Gossypium hirsutum
  unsure (1)..(348): unsure at all n locations
  Clone ID: uC-gsronu33B110b04b1
ccttctcgtccggagtttctcaaaagtgtttgaatcttacatgcttttggattctgaagcttggtgattgttgtctcaaaggtggattttctggaattacatactttttgtttgacagaaaacaataaagaacgaaatttcatggtttttacgtagaagaaataccatactatatccactaccttactgtaactattaaacaaagttaaaaggcataaagcctctactttgagaatgattcatggagaagatgattgtttnaatcaaanatgaaaaaaaaaaaaaaaaaaaaaaaaaaaaaaaaaaaacaaactttataaaaacaaaaaaaaaaaaaaaaaagggcgg

SEQ ID NO: 3024 - DNA, 343 bp, Gossypium hirsutum
  Clone ID: uC-gsronu33B110b05b1
agtttctatactcatcattattaaatctttgtgcttaccaaaagttttttcacctataaaataggttgatgttgtggaacacttccacgcatatgtaataatagtgccagaaagatgttgtggtaattccctaaaattccatcaaactcattttccgaatctcgtgagattttgaagtaaagggggattcagttacgtccatcatgagatattacctcctttctttcaagtcttttttttaaatacagtgtaccactattgatgagctgaatgctggaaaaatatgtgttaaatgtagttcaaaaaaaaaaaaaaaaaataaaataaacaaaaatttaacacc

SEQ ID NO: 3025 - DNA, 483 bp, Gossypium hirsutum
  Clone ID: uC-gsronu33B110b08b1
attgttatgccctggagttgccccttgcgctgatgtccttgttctgcctgctagagaaggcatcgacccgttgggaggcccttacattcctctcaaaactggaagaagagacggttgaaggagcagagcctatgttgaggaggagtatcttccggaccacaatgagaccatctctggcgttctcgacaggtttgccgtcatgggtattgacacccctggagtcgatgccctactaagagctcacagagtcggcagaactcactgtgtgaagctggtgcatcgaatgcacccagaggttgaccctgccctcagacccgaccatgttgcacacatgctccataaatgccctgatcatatcccagaccccacggccgtccagtatgtgagaaacgatcgtgggacacccattgatttggacaacaactactacaggaacatactggacaacaagggtttgatgcatgtggatcaccaactggctta

SEQ ID NO: 3026 - DNA, 619 bp, Gossypium hirsutum
  unsure (1)..(619): unsure at all n locations
  Clone ID: uC-gsronu33B110b10b1
tcttcacgcgtccgcccacgcgtccgcctcgtatgaaatttcaaattccctctcacgctcaccattttgttctctcaaaatttgaaaccctgtttctaaaattccaatcattcctttcgaaatatattattttccttcatggaatatgagatgaacagtgcggcagtggcgtcgacggtgtatgtgagcatctcttctccaatggcaccatttccaccctttccatattgtgcacatcttttcgtacttgtctagggatctgaacttcgttgagcaacaagtagcattggttggaaagagggttataacaactttctatgagagaattgaaggacttgaatcatttgaaagaaatcaagtattttgtttttttggctcaggtggtagatgacaattcaagggacgtgttttaatgattaaggttctaacaaagacatatctagtnttaagacaccttctttgtgtttctacanggtttgtcactttgtagtcaggaaatttataatgttttatgtaaactcatatacatatgaatataaatattgttccttcttattttaatttatagattttttatgatatatatttatattcatataaaaattatgctaagaattga

SEQ ID NO: 3027 - DNA, 178 bp, Gossypium hirsutum
  Clone ID: uC-gsronu33B110b11b1
tttacgcgtccgcccacgcgtccgaagttgttgtggcagccatggcagatgtgaccttaaatcactccctagcttgtatatagcatatatgtatcctgaggttgggaaaactcatttaaaaatgtaaattaaatatggattttcgtctcttttcactctctcaagaagtgaagggatg

SEQ ID NO: 3028 - DNA, 426 bp, Gossypium hirsutum
  unsure (1)..(426): unsure at all n locations
  Clone ID: uC-gsronu33B110c01b1
cccacgcgtccgcagcattccagggtactatgatgggaggtattggactctatggaagctgccgatgtttgggtgcaacgactcttctcaagtcctgaaagaaattcacgagtgcaaaaaggcataccccaatgcttatatccgttgcctggcatttgacaacaagcaccaaggtcagtgcatgtcctttgtcattcacaaacctaattgaaaccaccaccaccgactgatcagcagctagctgcctactgggttttccccaatctattcctattcctttttattagtagaataatgctatatgatctctctttcttctgtcttttcgatggatgacaataggacagccggtggatgattataagtgtgtgggttgttttgtttcggacacttgtttgcttttattaaaacaactatgattattnt

SEQ ID NO: 3029 - DNA, 455 bp, Gossypium hirsutum
  Clone ID: uC-gsronu33B110c03b1
tcgcctacgcgtccgatttgtcccaatctctggatttgagggtgataacatgattgagaggtctaccaaccttgactggtacaagggtcccactctccttgaggctcttgaccagatcaatgagcccaagaggccttcagacaagccgctccggctcccacttcaggatgtctacaagattggcggcattggaactgtgcctgttggtcgtgttgagactggtgttcttaagcctggtatggtagtgacctttggcccctctggcctgaccactgaagttaagtctgttgagatgcaccatgaagccctctctgaggctctccctggtgacaatgttggattcaatgtaagaacgttgctgtaaggatctaagcgtggtttcgttgcttaaactctaggatgacctgcaaggaggctgcagcttaccttcagtcatcatatgaccacctggcaga

SEQ ID NO: 3030 - DNA, 521 bp, Gossypium hirsutum
  Clone ID: uC-gsronu33B110c04b1
cttattcgtccggaaagagaaggccggagtgaaagacaagacacagagagagagacagagagagagatgtcgggaggaatagcgcgtggtcgactcgccgaggaacgtaaggcatggaggaagaaccatccccatggttttgttgcgaaaccagagacgttgcctgatggaacggtcaatttgatggtgtggcattgcacgatccctggtaaagcaggaactgattgggagggtggctacttcccgctcacgctccatttcagtgaagattatcccagcaagcctccaaagtgtaaatttccccagggctttttccacccaaatgtttatccatctggtactgtttgcctttcaatcctaaatgaggataggtggttggagaccagccataactgtgaagcagattcttattggaatccaagatcttctggatgctccaaaccctgctgatcctgctcaaactgaagggtatcacctcttcattccagatgctaatgaatataagagaagggttcgccagc

SEQ ID NO: 3031 - DNA, 478 bp, Gossypium hirsutum
  Clone ID: uC-gsronu33B110c07b1
gttaattatgtaagttggaaaagaaaattctaaataacagaaccacaaaggagacaaagaacaaatcttcaaaataataagataaattttccttactgaagaaaccaaaccaaatgataaaatatgcttctattaaagatccaacacatgaaagaagaatgccttaatattaggcagatttaaaaccaaatccatgagatatctacacttacacactacatgtattgtttgaaaattgctgaatgacaccagctgcagtccgagacatggacactttaagaactttcccatattggccaaaatattctagctgttggagaagctgcacacagagatgcatgtttaggtcatgatacaaggagaacaactagtttgagaacatgcgcaagaggaaagaatgagacagcacatcttcatctgccagaccaagtggcaacccgactatgtaaacaagattcctttggataactcgcacact

SEQ ID NO: 3032 - DNA, 541 bp, Gossypium hirsutum
  Clone ID: uC-gsronu33B110c08b1
ctttgttgcagctttctctggttctactgataatttgttagatttgagttcgactgttcctgctatactgccatgggcacaagttttctataatgttcaaacaactgtgaatacagaaattaaaaatatattttctcgtggagaatttacggttcttagagaacttcttgctgttgataattgtgccaataaattgtatcctttgcttcaagacgggttcagtcctgctcaagaggaatcgttcaagcattccgtttcagatttgaggaagacggcagagaaactatcgcaagggctggataatctttcaaaggtagtagatgactttttcaaaatagttttgtctgggcgtgatgctttgctttgtaatctaagagcaggttgtgcttccccaaattcagttctgggaagaaacaccgacaagcaaagtgtgaggtgaatcatgaatgaagtagagctaaactcttctgtatacagactgtttaggtatgagaccttctgttttctaactaatagggatatgcaaccttgttgggtaatg

SEQ ID NO: 3033 - DNA, 560 bp, Gossypium hirsutum
  unsure (1)..(560): unsure at all n locations
  Clone ID: uC-gsronu33B110c10b1
ttcttctttcctcctagccaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggttggtgtcctccctggcatcaaggttgacacgggtacggttgagcttaatggaacccatggcgaaactttcacccagggtctagatggcctngcacagcgatgccagaagtactatgaagctggtgcccgctttgctaaatgcgtgctgtcctaagatagtgctatgaaccaccgagctgcattcaagaaatgcaacggc

SEQ ID NO: 3034 - DNA, 315 bp, Gossypium hirsutum
  Clone ID: uC-gsronu33B110c11b1
tcctcacgcgtccgcccacgcgtccgcccacgcgtgcgcccacgcgtccgtgttcatccaaatacccaaaagtcaagagtagattaaactaatggccggaatcggacctttgactcaagattgggagcccgtcgttattcgtaaaaaagcccctaccgccgtcgccaagaaggatgagaaagtcgttaacgccgcccgccgtgccggtgccgagatcgagtccatcaaaaaatcaaatgctgggacgaatagggcggcttcaagatagacttctttgaacacaaggaagctcgatgaagacactgagaatcttgc

SEQ ID NO: 3035 - DNA, 318 bp, Gossypium hirsutum
  unsure (1)..(318): unsure at all n locations
  Clone ID: uC-gsronu33B110d03b1
ttttcacgtgcgaccagtctaacggaggtgaagcgtttttctaaacgcgtgctgatcgacaggggcgcttgcggcaagtatagtctggagcgaactcacatgcaccgacggaaagaaggctctctgagaacccgtgaatgcggacatatgacaaacagatacatataccctgatggaatctaggagacttgaattgatgaacatacaatattaggcctaaggtatggccggataaggagcgggtgattttagggtattgggtttattcgnggtttttctaggctgcttaggtatttcgggttttgtaatcggaaaagg

SEQ ID NO: 3036 - DNA, 477 bp, Gossypium hirsutum
  Clone ID: uC-gsronu33B110d04b1
gtcggttgaagataagatcatggacattgcctcactcgaaaagttcctccaggaacggatcaaggtaggcggcaaagccggtgctcttggcgactccgtcaccgtcacccgcgacaagaccaaaatcaccgtcacgtctgactccaacttctccaagcgttatcttaagtacttgaccaagaagtacttgaagaagcacaatgtccgggattggcttcgagtgattgcttccaacaaggacagatctgtttacgaactccgctacttcaatattgccgagaatgaaggggaggaggaagaatgaagaatcagttccacattttttttctagtttactgctttattatttcttaggaacgtcttttatctatttaaggtgtcatgttctgcttttttccttcagaccttactctaatttgcaatgaaattttgattgctgatagtaaattttgctataaaaaagatgcatttttcttt

SEQ ID NO: 3037 - DNA, 547 bp, Gossypium hirsutum
  unsure (1)..(547): unsure at all n locations
  Clone ID: uC-gsronu33B110d05b1
attttccctttatccgcactggggaaaagaatagagaaaaattgcagtcgctttttttgatcgtcataaagaaaaagcgccggggcgtgacctgagatcatcaaaacctaaacacggtcctttgatttccgaaatatgtggagaaggctacttacttcacagttcaaatctctggcagcacttccatgccgatccgcgtctaaaacggcgccgtttccattcaaatctcacatttctccttccccttctgcttccctcctcgttttccatttctccgccgagtcagcggatactgctgtgaagaagagagttgaggatgtaatgcctatcgctacaggtcatgagcgagaggagcttgagtctgagcttcagggaaagaaaatccttgaagatgtaaacaaccctgttggtccttttggcacataggaagctcctgctgttgtcaagtcctactatgacangagaatagttggatgcccaggaggtgaaggcgaggatgagcatgatgttgtctggttttggctgagaaggcaaaccacatgagtgt

SEQ ID NO: 3038 - DNA, 388 bp, Gossypium hirsutum
  Clone ID: uC-gsronu33B110d07b1
tgtagtcaaacaactaagaaataaaagtgttgcacttgtgaaagtgttgtggctaaagcatggggtagaagagactacatgggaacctgaagaaactatgagaaaccaatacccacacctgtttaccgttttggacaagccagctcaggagtcgggatacgtcgaaggctcagtcacactatccggaagacttttggtaaatggcttgtaaatttaagtatggcatgtatagcaatatacctattttgtgtaaatgatcttatggtatggttgtggaatggttgaggaaatgcttgataatgataaattatgaaaatggttagtgtccaaaaaaaataaaaattaaaaaaaaataaaaaattttaattctctttttctttttttcttt

SEQ ID NO: 3039 - DNA, 157 bp, Gossypium hirsutum
  Clone ID: uC-gsronu33B110d08b1
cttattataagcagccgttttctttctctttcatctgcacattctttttcatcctccggacatgttactttttgaacctttttcagcaaaatcttagaccaaactgttggaattaagatgtaataatcccataaagtagttgatttggtttagagct

SEQ ID NO: 3040 - DNA, 498 bp, Gossypium hirsutum
  unsure (1)..(498): unsure at all n locations
  Clone ID: uC-gsronu33B110d10b1
tacttcaccttatccatcatcatctatttccccatacaaaagtaaatccccatttttgttctcttcaactttattgcataccaaaaaaacttacaacaatggcaactgccccagttacctacactccacccatgttggctgctgccaccactaaccccaagaagaagaccaacaccaatgtgaattacataacaggcttgaattcttttggtgggttgaaagctcataacaaagtggtctcactaggccaacgtgtatgcaccgagctatcatttgcaaacattgttagctcactcaaagctccgacaaagggcaagacaggtagaagcggcggcggtgcactgtcttcaacctgcaatgctattggtgagatattcaggattgcagcaatcatgaatggcctngttcttgttggtgttgctgtcggatttgtgctgcttcgaatcgaagcttctttggaagaggctgagtaagagaattttaagacataacttgttt

SEQ ID NO: 3041 - DNA, 439 bp, Gossypium hirsutum
  Clone ID: uC-gsronu33B110d11b1
tcctcacgcgtccgcccacgcgtccgtttatcctgacttttgttttttctctctctctctataacccttcaattttcaatttcattatctttccaaatttctcccctttttttttccctaaaaatagagaaaattttgggaaaaaaagaaaaaaaattcccagcgtgggagtgagtgtttagggtttttttttgaattttgtactgcggggggttttgaatgaggagaactgaaatacttttgggaaattgaaaatcttcaatcggcggattagatggccaccacggagttgcagatgagtcctcagttggagcagatccacggcgaaatccgggatcttttccgtgctctttcaaatggcttccagagactggataagatgaaagattccaataggcaaagcaaacagctggcagagcttactggcaagatgagggaa

SEQ ID NO: 3042 - DNA, 546 bp, Gossypium hirsutum
  unsure (1)..(546): unsure at all n locations
  Clone ID: uC-gsronu33B110e05b1
gtctcttacaaaaacgtgatcggatctctacgcgccgcgtggaggatcgtttcttccatcgagcagaaagaagaaggtcggaagaacgaggaacatgtggtgctcgtcaaggagtatagatcgaaggttgaatctgagttgtcggatgtttgcgctagtatcttgactttgttggactcgaatctgatcccatctgctgctgcgagtgaatcgaaggttttctatttgaagatgaaaggggattatcatcggtatttagcagagtttaaggttggtgatgagaggaaagctgctgctgaggatactatgctgtcttacaaggctgctcaggatatcgcactgacggatctagcaccaacgcacccgatcaggctgggacttgcgctgaattactcggtgttttactatgagattctgaatcagtccgataaggctcgtagcatggctaaacaggcatttgaggaagccattgctgagctcgacacgcttggagaagagtcttacanggacagcactctcattatgcaactnctagggataacctac

SEQ ID NO: 3043 - DNA, 421 bp, Gossypium hirsutum
  Clone ID: uC-gsronu33B110e07b1
tgtttcgaggagccagataggacaaactaacggagaattgttatctgggtcagaaccacaggcctatcccacatgcggttcggatccggattgtctacgatccgattgacattcatcgctttaattttcattctgatctgatcccaaacgaatctattcggccgtgaaaaatgactcgtcgctgctcacattgcagccacaacggccacaactctcggacatgtcccaaccgaggggtcaaactcctcggagtccgcttgactgacgggtcgattcggaagagcgccagtatgggcaacttaagccaatattccgggtcgaattctggcgcgcataacgggaatgtgtcgggttcgcccggtgagggtccagatcacaccgatggttatgcttctgaggatttcgtccccgggtcgtcttc

SEQ ID NO: 3044 - DNA, 396 bp, Gossypium hirsutum
  Clone ID: uC-gsronu33B110e11b1
tcctcaaaatgggtcacttcatctccgatcatatattcactcaagctagcaaagtgtgggattaaaatgaacttagacacttggaagccagcggaaacttacttttatgactacattgatttatcggagaatgagataacaggtagcccagttgatttattgaatcgaacggatttcttggtggaatttaaggccgccgggaataagttgaagttcgatttggggaaattgagaatcgttaaaacactgaaagagttggatatatcacggaatttggtgtacggcaaggttcctgcggccattactgggttcaataaattgaatgtgagttataaccatctgtgcgggcagcttcccaagaacatatttcctgtttcttcatttgtgggaaacgat

SEQ ID NO: 3045 - DNA, 564 bp, Gossypium hirsutum
  unsure (1)..(564): unsure at all n locations
  Clone ID: uC-gsronu33B110e12b1
tttgttgatcaagccaattctgttcacaatggcaaggcttgatcgtgtcaagatcttaaccggactcgccgagtggtacggcaagaacgcaaagttgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggcgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaagtgtaagaaagatcatctcactgngataaaatctcccaagaggcttgaacgtatcgaggagaatatacatggaagatta

SEQ ID NO: 3046 - DNA, 360 bp, Gossypium hirsutum
  Clone ID: uC-gsronu33B110f01b1
ccttcttcgtccgtcaggagtgtactttgagccccaatattcacttggtagaaagatgttgacaaaagtgatagcaatggcatctattgtagatgatacatatgactcatatgcaacatatgaagagctcattccatatacaaatgcaattgagaggtgggatatcaaatgcatagatgaacttcctgaatacatgaagccgagctacaaggcactattagatgtttacgaagaaatggaacaactggtgcctgagcatggaagacaatatcgtgtcgaatatgcaaaaaatgcgatgatacgacttgctcaatcttaccttgtggaggccagatggactcttcaaactacaaccatcat

SEQ ID NO: 3047 - DNA, 535 bp, Gossypium hirsutum
  unsure (1)..(535): unsure at all n locations
  Clone ID: uC-gsronu33B110f02b1
ctttcttcgtgggttgaaacgtgtaacgatgaagccaatgggacatattgtttcaaggcatcaatctgttgtgattacagaccccaacttctaaccgacctacgacaagctctcgattgtcttccgattaagatggttaaagcggaaatatcaaccttgggtagtcggctgaggaaagattttgtttttaccggttgccgaaccaccgcacatggtgatgacgccgagtcatggcaacatctggcctgttccgttcgccgggccttgaattctgtcctggagaaggcttctatctctccggaatacttgccatactcgacgtttccaaagaggcagaggatctcatactttgattcctcaagctcatcttcataaaaaagatgattgccattgtttcgtttgtgtcaatccactgcgacatctcctttattttctgcaggtgtttgtctgaatgtgaaaaggttnngcttgaaatgaaaattcagaaaacatgtcatatatatacatatcattagatgtaagagttcactattag

SEQ ID NO: 3048 - DNA, 133 bp, Gossypium hirsutum
  Clone ID: uC-gsronu33B110f03b1
gctggttaaccccatgacatgccatggacgaattgttgtttctttctgcttcataaatgccatcactacctgtttgaaattgatgaatttttgtttttttgttttgtgtttatgttatatgtctgtatttctc

SEQ ID NO: 3049 - DNA, 503 bp, Gossypium hirsutum
  Clone ID: uC-gsronu33B110f04b1
atttctagggccgccctttttttttttttttgaagaggcgaaagccgcttagcttgtttgaaaacgaagcataaacgtttgttcgtaacactaatacggaaaatatacatcgaattacttacgatggaagctgatcctgatcttataatgggtcactataaccgaatgagcttcctagattcagattcgaagcttgatgaagggagattttgatggtgtgagtttgagatgatttgtatatatcgatacactcctcgaggtcggcatcgcacgtcaaaagaacccattcattgtcgtcgtccaagtacttgagattgattctgtcgacatcttcaatattgaaatgcttcgcgatctctcgttgcaagtctataaagccccaattcggttgcaaaccgaacagtaacttgacttgtccgaacatagcttttactctcaagtcacccctggtttgattgtgaagtagcttcatctcgtggtgatttgaggcgtgcaatttggca

SEQ ID NO: 3050 - DNA, 507 bp, Gossypium hirsutum
  unsure (1)..(507): unsure at all n locations
  Clone ID: uC-gsronu33B110f05b1
cccactcgtccgggcaccgctcatcgacgtggctgagatcaagctttggtctttttacagagctctcatcgccgaattcatcgctactctcctcttcctatacgtcaccatagccaccgtcatcggccacaagaaacaacacgatgcatgcgatggtgttggtcttttgggcattgcttgggcttttggtggcatgattttcattcttgtttactgcaccgccggtatctcaggtggtcacattaacccggcggtgacatttgggttgtttttggctaggaaggtgtcgttaataagggcggtggcttacatggtagctcaatgtttgggtgctatttgtggtgttgggttagttaaggcattcatgaagagtgaatacaactccctcggcggcggtgttaacacggtggcgactggttataacaaagggactgctctgggagctgagattatngggacattcgtgcttgttacactgttttttcagctactgaccctaaaagaagt

SEQ ID NO: 3051 - DNA, 490 bp, Gossypium hirsutum
  Clone ID: uC-gsronu33B110f06b1
ccttctcgtccgaaggttcataaggtgccagcgactgacatggaggcactcaagtctccacttatgggaatatttgagaagcgtcgtgcacggaagttcttcatatatgttcaagattatgatgcaaaggattctaaaactcacgagggaatggacttgacaagggtgtcaactagggcactaattgcgaaatatgggcttgatgataacactgtggacttcattggtcatgcattggcacttcacagagatgaccgctacctggatgaacctgcattggatactgtaaaaaggatgaagctttatgcggagtctcttgcccgttttcaaggtggatctccatacatatatccactgtatggattaggcgagctgcctcaggcttttgcacggcttagtgctgtttatggtggaacatatatgttgaataaacccgagtgcaaggtggagtatgacgatgaaggcaaagcttgtggtgtcacatctgaag

SEQ ID NO: 3052 - DNA, 450 bp, Gossypium hirsutum
  unsure (1)..(450): unsure at all n locations
  Clone ID: uC-gsronu33B110f07b1
tccttcgcgtccgctgattggaatggaagctgctggaatccatgaaactacttacaactccatcatgaagtgtgatgttgatattaggaaggatctttacggaaacattgtgcttagtggtggatcgaccatgttccctggcattgctgataggatgagcaaggaaatcactgcacttgcccctagcagcatgaagatcaaggtggttgcacctcccgagagaaaatacagtgtctggattggaggatccattttagcatctcttagcaccttccagcagatgtggatttccaagggcgagtatgatgaatcaggcccagctatcgttcaccggaagtgcttctaatttgaatgtatcggaagcctacatttttcagtcatctgtctgtgtgagttcagtttgttggacatctgaagctttggtttntatgaatggaggaaagtttatgg

SEQ ID NO: 3053 - DNA, 411 bp, Gossypium hirsutum
  unsure (1)..(411): unsure at all n locations
  Clone ID: uC-gsronu33B110f09b1
tgctaattctcagactcactgagtcaatctcttctttctcctgttgtttcaaggttagagattccctcttcttcttccttttgtttatttcatctgattataaatcttactttaatttgttgaacacactattttgattcgtaaatatattgtgattcttctttctttcttttttttttcaagtaaatgacggatcgatgatgaaaaacgtgagcaaattgctgtttcatttaccttttttttggagtttttttttcagtgatgctaataaatttaagctaatccgtcatgatcttagattagaattagttctatgttcttctttgagtctgttatattttatttatcctttcatgcatttcttcaagataatgcctagttaagctctccaaattctgctctgngattctt

SEQ ID NO: 3054 - DNA, 261 bp, Gossypium hirsutum
  Clone ID: uC-gsronu33B110f10b1
ttcacgcgtccgcccacgcgtccgggcgatcgtggctgcggcgcaaagaaggcttctagtgcttagggtttgctgaaaaatgttttaggtttggggtattttggggctgtttgggttaattgtttttgtaattttggattttcttatgtggaattatttgggtcttatttattgggctggaattaagtagcccgagctaaaattgggtattacaaatataatggtgcataaatttacacaccaatgtttttagttttcttt

SEQ ID NO: 3055 - DNA, 200 bp, Gossypium hirsutum
  Clone ID: uC-gsronu33B110g02b1
ccttcgtttccgaggaggccatgtgaagaaccactcgtgggagccctagctctctggcctattctggcacgttccagaagcttccagtgctgctgagaattttttgggtgtttgggcctttgggttagggatcttgctttgggcttttatttttgtaaaaaacttggactttttaattaattgattttgcttttgttttt

SEQ ID NO: 3056 - DNA, 462 bp, Gossypium hirsutum
  Clone ID: uC-gsronu33B110g03b1
attttctgcaaattgggtgttgaaaagtttgtttagcagagatgggttttagcttgaaagcttacttccttgttgcactggttgtgtttgatataagttgcatggtgttcattaaggatgttgaagcagctggggagtgtggaaagactccatttaggtctgctgcggtaagtttaagcccatgcttaggagctgctgggaacgcaaaggcaaaagttccgcctgcttgctgctccaaggttggtgccttacttaaggcttctccgaggtgcctttgtgctattttattatcaccattggcaaagcaggctggaatcaaacctgggattgccattggcattcccaaaagatgtcacattaggaacaggcaagctggaaaaaaatgtggaagctacacagtcccatgagacatactaataccttattcaagatgagaagagagagcttactaataacaagtgc

SEQ ID NO: 3057 - DNA, 370 bp, Gossypium hirsutum
  Clone ID: uC-gsronu33B110g08b1
ttttgtccgcctttcaatcgtcactttctatgctccaagctatgacacagaacttggtccaatggcagaactggtggatgagaagaatccatgcagatacagaagatacaatcatggagaggtcagttaacattacgttaccaacaagttggaagggaaaagaaccctggatttcggaaagatccaatccaagaccttggaattaacaaggattcactttggtgttccccccccttaataacaatatttggacctattaaactgtaagaaaggagctcctatcatggtggactgcgctgtttcttctgtaacaaagttttcccaaatgcatatcagcttatggaagcttggtgggacctttgtttagtgg

SEQ ID NO: 3058 - DNA, 387 bp, Gossypium hirsutum
  Clone ID: uC-gsronu33B110g09b1
tcctcgcgtccgagcaaattgaagaatacgctgaaatcttcaatccaaaatgcctaagcagattcatgagatcaaggacttccttctgactgccagaaggaaagatgcacgctctgtaaagatcaagaagagcaaagatgttgtcaagttcaaggtccgctgctccaagtacttgtacacactttgcgtgtcggatgctgagaaggccgacaagttgaagcagtcccttcctccaggtttgagtgttcaagacctgtgaaaatatggcagccccgggtttgtcacctgatttataggtgatgaaagctaggtttttagttttgggtttattgtatttctggtcattctgcaacagtgagctcatttttctgtaatggatctatgttt

SEQ ID NO: 3059 - DNA, 470 bp, Gossypium hirsutum
  unsure (1)..(470): unsure at all n locations
  Clone ID: uC-gsronu33B110g11b1
tcctcacgcgtccggattgacagttcaattatgaaacgggttaatgacatattacagcgggctaagttacctactgctcctcctgaaaccatgactgtggaaatgttcaaatctgtcatggcggttgataagaaggtggctgatgggctactaaggcttatccttctgaaaggtcctctgggaaattgtgttttcactggcgagtatgatagaaaggccctggatgatacactttctgcattttgcaagtcttaaatccagattttatttgttgatctgttttaagctttacttgcacaattgttcttccatatccttggatggtttatctcaatggtcatgctaatactttttggtgtactctttctctaggattctttcttttcttgaactccattgtcaaaaggctcgtaccaagtngtaatgccagtattaatgtagtcaataaaactatatgtatggtaaagtat

SEQ ID NO: 3060 - DNA, 310 bp, Gossypium hirsutum
  Clone ID: uC-gsronu33B110h01b1
aagagagaaaatccctgcagctttatcggaatgcatcgatccggcgaggtttgttatggaggccatatcggaggtatttccggtggacaaaagagggaatgagggaggaagtgatttagcttgggcttgtgttttgattctggaaagcttaatcccggtggtggttgatccggtaatcggaaaatcaagggtccttggtacgcctagtatgaaagagcaggccaaaagacatcgcggagacatggaaaaagagccttgaagagagaagagggattgaaaatgtgaaaacccctgatgttcatactttttt

SEQ ID NO: 3061 - DNA, 333 bp, Gossypium hirsutum
  Clone ID: uC-gsronu33B110h02b1
ccttctcgtccgcccacgcgtccgagctgattcactggaacattggctgcgcatgaatggttttcctgcaactaccattcatggtgatagaagccagcaggaaagggaacaagcattacggtcatttaaaaccggtgctaccccaattctagtagcaactgatgaggcagctcgtggtcttgatattcctcacgttgcacacgtggtgaacttcgaccttgctaatgatatcgatgactatgttcatcgaattggacgtacaggccgtgcacgcacaactaggctagccacagccttattcaatgagaacaatactaatatggcaaaggcatt

SEQ ID NO: 3062 - DNA, 361 bp, Gossypium hirsutum
  Clone ID: uC-gsronu33B110h03b1
ccttttcgtccgatcaacaatggctcaactcaaaatcatcaacaatttccaaaattcatacatgggcatgatagtatatagagcaacgatcacaaaaacgtagaaattatcaaaaatcaagtcaaaaccataccttaattaagcttggaagtagccgaatatcaaaacacaagaaccctagcctttctttctttaattttggcaaaatgagatgaaaataatatgaactgatggcttttgttttattaatataaccttataatcaatttccaattttaaccatgctaaaccatttaaaaatcaacttaatggatggtcattaatggccattaaccttatcaatggtctaataacataataa

SEQ ID NO: 3063 - DNA, 414 bp, Gossypium hirsutum
  Clone ID: uC-gsronu33B110h04b1
ttcacgcgtccgaaaaaaaaaaaaaaaaaggaaaaaaatggctatgcaattcaatcccatcgcttctcaaactaagaaactcccttcatatgctcttccacccatggcaagtcttagatctcccaaggtttctatggtctccactcttccacctcgctccaaaggggttgaagatctgaaacggcctttcatggctccaaagctggtacaccaggcttcccacaccatgccacctgagaagattgaaatctttaaatctttggatgattgggctagggataacattctgattcatcttaaacaagttgataaatgttggcaacccaaggattttcttcccgatccttcgtccgatggatttgaagatcaagttagagaacttaagagacgggcaaaggagattccggatgagta

SEQ ID NO: 3064 - DNA, 338 bp, Gossypium hirsutum
  Clone ID: uC-gsronu33B110h05b1
aaacaagttttatatattttacatctttattttatggttgatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaaccaaattttacgtccccttgcatgaaaggcaaaattttttttataggggcaccaaaataaaattaactggccaaggtttaaaaacgtggtaactggaaaaaccctggcttaccccaattaaatggccttaaataaaatccccttttcgcaagttgggttaatac

SEQ ID NO: 3065 - DNA, 380 bp, Gossypium hirsutum
  unsure (1)..(380): unsure at all n locations
  Clone ID: uC-gsronu33B110h07b1
ttttcgcgtccgcccacgcgtccgcccacgcgtgcggtaacattttctggcacaccaggttatggaattgaggaaagtgtggaaccagcaagtgtatctattggattctcaacagtagagagtgtgacggatgtgattgagatgcaggctgtgggtgcgggagctgttgaaagaagagttagatttgcgattgatgatgatgactctgaatctgatgggcaaaccaaaatgtatgttcagttggaagaagagctgagggacctgatgacagcccaagaagcagggactgcattcatactaggacacacacatgtagaaaccaaagcaggatcttctattttaaagagattggccattaattntgggtacaatttcttgag

SEQ ID NO: 3066 - DNA, 399 bp, Gossypium hirsutum
  unsure (1)..(399): unsure at all n locations
  Clone ID: uC-gsronu33B110h08b1
tgttataatccagcggtggcgaaggcttcgatgatggcggtgacggtcccggccttgactgcattgatggcctcgattcggggaactagacagacactccccaaagcttccagaatcctttacggcgcgaggaaaaaaaagagaattaggaagaaaccctaaggtttgatgtgtgtttggggctcattgggcctgttaagaatttgggccatgactgtattggtgtattgggtcactgtaacgtgctatggggttattgggtttgatttaggctaacgggatgttgggttattttttttggggtgatttgggttgttgngtagtcacagtgggcctgctgggtagggtcttgtaattggacttttaactggacattctaaataaatagaatctttttat

SEQ ID NO: 3067 - DNA, 429 bp, Gossypium hirsutum
  unsure (1)..(429): unsure at all n locations
  Clone ID: uC-gsronu33B110h09b1
ttcttcgcgtccgcttttggcaagttcctcaatacgcatttataggagcctctgaagttttcatgtatgttggtcagctggagttcttcaatgcacagactccggacggattgaaaagcttcggcagtgccctttgcatgacatcgatctcgctagggaactatgttagcagcttactagtgacaatggttatgaagatctcgacagaagatcacatgccaggatggataccgggcaacctgaacaagggtcacctagactggttttacttcctcttagctggactaacgacaattgactngattgtctacatagcatgcgcccgatggtacangagtatcaagctggaaggaaaaactgcagaaaatattgatgaccaagttagctttaagctataatatatcatatcggtgctaaacatataattac

SEQ ID NO: 3068 - DNA, 473 bp, Gossypium hirsutum
  Clone ID: uC-gsronu33B110h10b1
tctcttcgtccgccacgcgtccgcggacgcgggggtcgataacaaggcttatatattctacatctttatattatgggtgacattcttcatatgctcttccacccatggcaagtcttagatcacccaaggtttctatggtctccactcttccacctagctccaaaggggttgaagatctgaaacggcctttcatggctccaaagctggtacaccaggcttcccacaccatgccacctgagaagattgaaatctttaaatctttggatgattgggctagggataacattctgattcatcttaaacaagttgataaatgttggcaacccaaggattttcttcccgatccttcgtccgatggatttgaagatcaagttagagaacttagagaacgggcaaaggagattccggatgagtactttgtcgtgctggttggtgatatgatcacggaggaagcccttccactttaccaacta

SEQ ID NO: 3069 - DNA, 494 bp, Gossypium hirsutum
  Clone ID: uC-gsronu33B110h12b1
tttatatttcaatcagccatctcctcctctaaatatgcttagacggtgtcggtgatctcctcctccgctcagattttttagccttcgatttttttttatttccttttgttctttaaagatccgtttcactggttttcggatatatttttttgcaccgaatccgattcagatcggataaaaaatggcagcatcgagacgattacgtgatctccaatcgcagccgggtaacaagacttgcgtcgattgcaatcaaaagaatcctcaatgggcatcggtttcgtacgggatcttcatgtgtttggagtgttccggtaaacaccgtggtttaggtgttcacatctcgttcgtccgatctgttactatggattcgtggtctgagatccagatcaagaaaatggaatcgggtggcaacgaacggctttaacgccttttggctcagtatggaatccctaaagaaacggatattgctgctaagtataatactaatgccgcga

SEQ ID NO: 3070 - DNA, 486 bp, Gossypium hirsutum
  Clone ID: uC-gsronu33B111a04b1
gtcttcgttcatctttttgctgtttttcaaggggggctcggagttcttgacggcgttggcgctaacttcaccgttacctcgaaagcatcagatgaagacggagattttgcggaactttacatgttcaaatggacaacccttctcatcccaccgactactctccttattataaacttggtgggggttgttgcaggaatctcttatgccatcaacagtggttatcaatcatggggtcctctctttggcaagttgttctttgcgttctgggtgatcatccatctctaccccttcctgaagggtctgatgggacggcaaaaccggacaccgaccatcgttgttgtatggtcaattctgcttgcctccattttctctttgttgtgggtgcggattgatcccttcaccactagagttactggaccagatgtagagctgtgtggaatcaactgcttagttcatagaaaaggtgggaatgaacgaaatatgatg

SEQ ID NO: 3071 - DNA, 477 bp, Gossypium hirsutum
  Clone ID: uC-gsronu33B111a05b1
ccctcgctttcgcccacgcgtccggaaaatcctagcatagatcgaacatggcaaaggagagggagctactttactaacaggaggcaaacacattggccaaaagggatattacatacagcctaccatatttgctgatgttaaggatgatatgatcgtagcaaaaaatgaaatttttgggccagtaatgtcattgatgaagttcaaaactatggaagaggggattaagagggcaaacaacacgacttatggtctggcagctggggttataacgaaggacttgaatgtggcaaacactgtttcgagatcggtccgtgctggtatcgtgtggatcaactgttacgctgtgttcgatatggattgcccttatggcgggtacaagatgagcgggtttggaagagattatggtttggatgcacttaaccagtatctacaaatcaagtcttgttgaactcccattcatgattcttcatggcattg

SEQ ID NO: 3072 - DNA, 340 bp, Gossypium hirsutum
  Clone ID: uC-gsronu33B111a07b1
tggatgcactagttgggacactaagagcagcggagagactaaaagttgttgcatatgatggtgaactactactgcaaggagttcatgacaatgtggaaatcattctcaaagctacaacaccagcagcagcagctcagagtagcaactaatgcagttctaaataaataattgcaattatagttttgcagcaaaagtttgatgatattctatgtaatttttcaatgtttatcatgtttgaaagcttgcttcagcataagtgcataacagtatttttgaatactctattatgaaattttccagagtgtactacacccagatttgtatatgttttcttttggtt

SEQ ID NO: 3073 - DNA, 493 bp, Gossypium hirsutum
  Clone ID: uC-gsronu33B111a11b1
tttattttacaagtccaggtccatgaagatgcgggggtcataattattcaagctcggaggactgcaacaaaagttctttttcttatccaccacccgcacaagctgatataaatcaagcaccacctgaaaacccaagagcagcttggttacaaaagcagtggattgagtctcgctcacttcagctagaagaacagaaactacaaattcaagttgagatgctagaattggagaaacagcgtttcaagtggcagagatttagtaagaagagggatcgtgagcttgaaaagatgagaatggaaaacgagaggatgaagcttgagaatgagccaatggcattagagttgaagcgaaaggaactggatgctgattaaaaccatgtgatttttacctcaatcttcttatattcttttacagtggcaagcctggatgcaaatttaatttctgctatattggtatcctgaagtattgaatatagaattggcagactaagttg

SEQ ID NO: 3074 - DNA, 401 bp, Gossypium hirsutum
  Clone ID: uC-gsronu33B111a12b1
tttattttttccctcactttctcgaaaaaaaaagtgtgggcaggttgaaattgcggatgggactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaataaaagcttt

SEQ ID NO: 3075 - DNA, 66 bp, Gossypium hirsutum
  Clone ID: uC-gsronu33B111b02b1
ctttgatttcgttcaatctactgatgttgtaaccttcaccaagttataaagcataaaataagtcat

SEQ ID NO: 3076 - DNA, 453 bp, Gossypium hirsutum
  Clone ID: uC-gsronu33B111b03b1
ggttcattaaggatcggttatggcatattttggatagagcatccattgagaagaaatcagtggacttgcaggacttgttgcttcggttaacgtttgacaatatttgtggccttacctttggtaaggaccccaaaacactctctcctgagttacctgagaactcatttgctgttgctttcgatacagccacagaagcaactctctataggtttttataccctggtcttctatggagattggagaagattttggggattggagtggagaaaagattgaagcgtagcctccaaattgtcgagaactacatgaacgatgccgttgaagcaagaaaggaagctccatcagatgatctactgtcccgttttatgaagaagagagatgctgagggcaacctctgtacaagtgatgttctccaacacattgctctaaacttcgtcctggccggtagggaca

SEQ ID NO: 3077 - DNA, 396 bp, Gossypium hirsutum
  Clone ID: uC-gsronu33B111b04b1
cccacaattgtgatgttccgcatgtcaagcgtactgactaccagttgagtgacatttctgaggatggatttgtgagtttgctgactgagagtggagacactaaggatgatctgaggctcccaactgatgagaacttattgaaacagatcaaggatggttttgctgagggaaaagacctggttgtgtctgtgatgtctgcaatgggggaggagcagatctgtgctctgaaggacattggtcctaagtaatttgagattttattttcagacttttattgcaattttagattataacttttttttttttttaagaactttaatagctttgtgtcttggaatttgggtttttttttattttttttattttaatatatctggatacgagaaaaacaccatt

SEQ ID NO: 3078 - DNA, 497 bp, Gossypium hirsutum
  Clone ID: uC-gsronu33B111b05b1
cttttcttttaatatttgttcaaagctttcgattacaaagccctcgcgaaagatgcagatctttgtgaaaactcttactggtaagaccatcaccctcgaggtggaaagctccgacacaattgataatgtcaaggccaagatccaagacaaggaagggatcccccctgaccaacagaggcttatcttcgccgggaaacagcttgaggatggccgtacccttgctgactacaacatccaaaaggagtccaccctccaccttgtccttcgtctcaggggtggcatgcagatcttcgtaaaaacccttactggcaagacaatcacccttgaggttgaaagctctgacacaattgataatgtcaaggctaagatccaggataaagaagggatccctcctgaccaacagaggcttatctttgccggtaagcaactggaagatggtcgcacccttgctgactacaacattcaaaaagagtctaccctccaccttgtgcttcgtc

SEQ ID NO: 3079 - DNA, 466 bp, Gossypium hirsutum
  Clone ID: uC-gsronu33B111b08b1
tttgatatgtaaaatcaagtaacatattgttagatgaatatttgaagccaaagatttcggatttcggacttgccaagattgttcaagccaatagtagcattggtaatgactccacccatgtcattgcaggaacccatggttacatagcgcccgaatacggctacacctgcaaagtcgacgagaagagcgatgtatatagtttcggggtggtattactggagttagtgaccggaaaaaagccaatagagccggaatatggagaaaataaggacattgtgagttgggttggcagcaacttaaagggcaaagagagtgatttaagcatagtggacccaaagataccacatgcattcaaagaggatgcaatgaaggtgttgaagattgccatattgtgcaccactacactgcctgccctaagacccaccatgagaagagtggttcaaatgcttaaagaagctgaacccta

SEQ ID NO: 3080 - DNA, 484 bp, Gossypium hirsutum
  Clone ID: uC-gsronu33B111b09b1
tgcatgttcgagtgcgtcccaaaggctgacgctgctgtctttatgtgggtgttgcatgactggggtgatgaggaatgcatacaaatcctaaagaaatgtagagaagccatcccacaagacaaagggaaggtcataattgttgaatctgtgcttgaagaagatgaaaatgacaagctagaatttgtggggttgatgttggacatggtgatgatgacacatacgaacaaaggcaaagaaaggaccttaaaggaatggacgtatgttcttggacaggctggattcaccagaatcgatgtaaaacccattcatgctgttcaatctgtcattgaagcttatatttagaaattccaccttgcctgctttctttcaactttgtgttaataaatggcttcttttactattaaaccttaaatcctgtcgggtcttttattggccaaaccatatgagatctgttgtgggaaagatgtaattttctttttccatc

SEQ ID NO: 3081 - DNA, 483 bp, Gossypium hirsutum
  Clone ID: uC-gsronu33B111b10b1
tttatttacataccttgtagaccggaccaaagccacgatgaccgaggcgattaagttgggagaaataattagtagcaatctggagagcacggagttcgaagaaaaggccctgagtgtcggatccggcgtcggaatcgtcttctccggcggatccacctcgagcggctttgaagcgtttggcgatgcaagcagaaagtttagccaagaatcccatgaagaaatgggtgggcccaatggaatagccaaggtcgtagtccaggtagaggtgtacggcagagaaaagtgagcatgaagaagaagaagaagaagacagacgaaaagggaagtttgccccgtgcgaggtttgattatgaggactgacaggtaatttaaggaaagggtattcaagagggtattaagtacgacttttcattcattgaacaacgattttattatgaggcgtctgaattttctgttaataaaataaagttacttttgatgttt

SEQ ID NO: 3082 - DNA, 490 bp, Gossypium hirsutum
  Clone ID: uC-gsronu33B111b12b1
tatgtaatcctacattctaatccttcatccagacgcaatccttttgttttttttttgagttagaaaaagcaaaaacggaatgaccttttctgtcttgttttggagctttaatatgtgataggatttaatatttgattatttcaaaaggtaaaaatattttttatataaaatttcatagttacattattaattgatatatatatataatcgattttgatatacgagactcaagaaattgtattgtatttcatttaattcctttttacgtgttatgatgattttaattaattacacaaagatggggtttaacggggatgatgaattcagggtctagatccaaagacaacagccagtttatttgctaaagcccaatgcttaggcgagaaacgaataggcgacgaggattgcttcgtcctaaaagtatgcgccgaccgtgcaacggtgatggaaacgaacgaaggaccagcagaagtatgaggcatgtattata

SEQ ID NO: 3083 - DNA, 481 bp, Gossypium hirsutum
  Clone ID: uC-gsronu33B111c02b1
cggtcgtttgggcaagactagataaaagtccgggggagaaaaaaatcactgcccgtgtagtgtgaactttgatcccatatttatgctctccggaaaaagaagggaacaaaagggatcgaggtgagcccgagtctgagcctttactcgctcttgttttagttttcattaatttttgaaaatttaactctgaattagatatataatatatacagtttgtactgaaggcaccgaggtagtttcatagcctcgtgatcggcggcccttctctatttagatcttaattttcccaaaaggaaagaaccgttatacttgtatgattgttcttggtttttatttaggtttgccattagaagaaatgcctgaatgactgtttctcaatggcggaatcatttgtgagaattaggataggttaaagttttaccattttctcgttgtacatcgcacacattttaaccttgtcattttgtcacgcttttgaata

SEQ ID NO: 3084 - DNA, 477 bp, Gossypium hirsutum
  Clone ID: uC-gsronu33B111c04b1
ggcggtggccagagacgcgttttgcttggtggacttagcaaaggaggcgtgggtgcactatgtgctatatatgtgtattggacggacgagggagatatagtggctggtgtgtcgatggttcctagtccgtatggtggaagccctatagcttcagatatcttgagagaaggtcaactcggtgattatgttaatatacggaaacttatggagattttgatttgtaaagtgattaaggtttggagttatgtgttatgcattttcttttctctttagtttctacaaataattgacagtatgatattatgcaattatgttcgctgcaatttctgagtttccatgggaggaactcagcacctgctttggtattttagtgattctcacctctttcctagggaagaagggtttatgagtctactttctagccaagtgcagtatccggatatgtaatcgggtataagactatgattctttagggat

SEQ ID NO: 3085 - DNA, 477 bp, Gossypium hirsutum
  unsure (1)..(477): unsure at all n locations
  Clone ID: uC-gsronu33B111c05b1
gtctgcctttcctcatgccattctccgtctagacctgggtggtcgtgaactcactggttctctgatgaagaggcttactgagagaggttatatgttcaccaccactgctgaacgggaaattgtccgtgacatgaaggagaagctcgactatgctgccctggactatgagcaggaactggagactgccaagagcagctcttctgttgagaagaactatgagttgcctgatggacaagtaattactattggagctgagagattccgttgtccagaagtcctcttccagccatctctcattggaatggaagctgctggaatccatgaaactacctacaactctatcatgaagtgtgatgtggatatcaggaaggatctctatggtaacattgtgctcagtggtggttcaactatgttccctggtattgcagaccgtatgagcaaggagatcactgctcttgctncaagcagcattaagat

SEQ ID NO: 3086 - DNA, 443 bp, Gossypium hirsutum
  Clone ID: uC-gsronu33B111c07b1
ttgcttttccctattgctttggatctttgctcgggtacccttaattatgtgctgctgcatcataacatgtgttctttatttcttggacacaacaactagtttcacacgccaacttcatcgccgctcattcaaagaggaaacgctgaaaactggttatctggaataattggtcaattatcgcaagtgattttgaagcttttaatattttttctagaaacttttttgtgtgcatgtgattatgaccttggtgacttatcctagagaattcctatattaagatcaatttccttgttaatctagaatttcgcttggtgggttcttattcttaccaccatttgtacttacagttgttagtttatggatatgggagcttcatgttgttttgaagagaacaagtttaatgtgtattcacatgtttataaataattaccaggcattgcatt

SEQ ID NO: 3087 - DNA, 479 bp, Gossypium hirsutum
  Clone ID: uC-gsronu33B111c08b1
tttttctagacatgttggctgccatggagatgggcattgatgataacgttaatggactatccatgtccctcggcggtggcatgtgtgatcattacagggatagtgttgcaatcggatcttttgctgccatggagaaggggattttagtttcttgttcggccggaaatgctggtccagctccgtacaggttatcaaacctggctccgtggattacaactgtcggtgcaggcacactggatcgtgatttccctgctttcgttagccttggaaacggcaaaaatttctccggcgtgtcgctttaccgaggcagccccttgcctggaaagatgttaccatttgtttatgctggcaatgctagcaatgctaccaacgggaatttgtgtatgatggatactttgataccggaaaaagttgccggcaagattgttctttgtgatcgtgggatgaacgccagggttcaaaaaggagctgtcgttaaa

SEQ ID NO: 3088 - DNA, 474 bp, Gossypium hirsutum
  Clone ID: uC-gsronu33B111c09b1
ttcattggtcttcatttaatcatttttagaaagaaaacccatttccctcccattatcatttgagtaattgaagaaaagtgtcgcgatggccaaaaccaagagaatcatcatcaccattctcctaaggcttctagcttttggtgctactctttctgcaaccgtagtcatggttacgagccatgagtctgccgaggttatgaacataaaattctcagcaaaatacagcaactcaccaacatttaagttttatgtgacagcggaggcaattgcaaccggatacggccttatagctctcttcctgtcttcgagaaggtcgtttgatcgcctgattgtgattctagatgtggtcatagcgttgacactaacttcgagcatctcagctgctttggcagtagctcagataggcaagaaaggggacactcatgcaggttggctgcccgtttgcaaccaaagttcaaaattctgcgaccatgt

SEQ ID NO: 3089 - DNA, 499 bp, Gossypium hirsutum
  unsure (1)..(499): unsure at all n locations
  Clone ID: uC-gsronu33B111c10b1
gtctgattttcctcatgtctttcttctcttagacttgggagttggtgaatagtgttgtaattagtgccaatggctcggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctcttccatgttggtctctttaattgctctcttggtgcattgaattcaaagcttttcaagactttatgacattggctacccttaatttcactctcactggtgatgaggggagtagcctctaatcttctccgagataatatttgggtgttatcaattttcaatttctctaaagttttaaatatctctatatatatcatgttacattagtgacataaatttgattntgtaatgtaattggtgtgattttcttatatatcatagatatataaggg

SEQ ID NO: 3090 - DNA, 417 bp, Gossypium hirsutum
  Clone ID: uC-gsronu33B111c11b1
tcctgatgatgatggccggtgcggttcaaaacttcagagtgcaggtcttccgtgctaaaattggagcatcaaatgggtcatctcttagtttgtttcggaaattgggcttcaaggagacttcttatagcgaaatcttcaaggaggtaacattggaattggcggtgacggagcaaaagcaagaggagcttctgcagttgttgggcagtgtggttacacatgcatagcctccgggaggccgtaatttattttcccctaaaacttattaactgtcatcatacatgtatctgtgagttgtagaaactagaattgtagatgattccctgttttgggaaaagggttttgatgtttatgatgatgatcaatgctggaaacttacatttgcaataatgataaacaatgatgaatggctttagcatt

SEQ ID NO: 3091 - DNA, 415 bp, Gossypium hirsutum
  Clone ID: uC-gsronu33B111c12b1
ttgtgctatgtctcgtcctcatgtttattgtccatcgagacgcatgtggcgggccaccaccaccaggcggaggctggtgtagctgccgatgcgcctcagttgaatctacaacaccttcccaaacgggaactacttgagattgatcactggcattgtagttgcttcagaaagcgatccatttaggagcgctgtataataaatgaaaaggatagcctctttttcctttcattttgagagtgtttgcttggttttttctgttcttttcgggtttatcaaatctggaataatttcattcaatccatgatgtttgattcgattttcaaaaaacaaagtcatgaaaaaaagcataaaatttataaaaccaatatccttggtggaaatctttataaagaaaaaaaaaaaaaaaagggggggc

SEQ ID NO: 3092 - DNA, 324 bp, Gossypium hirsutum
  Clone ID: uC-gsronu33B111d02b1
cccgcttctttctcgcccgggcacttccaacatacacgcgacgatttaaaagatgatgcggccagaaatctcacctaacaaaatctcaacgcccttgtaaaagtatctcccaggtcttgttggtggaagtgcaataatttgcttcttccaacatgacctttctaaacatgtttggggatttccagaagggcaccaacccaggaacgcaatgttcggttgggagttatgcttcacggaatgggagctatgtgcatactgattgctgagtcacagccctggcctgaatccatacagaaacgcctaccataccaatcactgactaca

SEQ ID NO: 3093 - DNA, 375 bp, Gossypium hirsutum
  Clone ID: uC-gsronu33B111d03b1
gccgagtcgaagaggattcaaacccctttccccagagcaaaaatgaagtacaagcgacgagtctcctcctctcgtcgcaagagccgcaaggcccatttcacggcaccctcgtcggtccgccgtgtgttgatgagcgccccactctcatccgatttgaggtccaagtacaacgtccggtccatgccagtgcgcaaggacgacgaggtccaagtggttcgtgggacttacaaaggccgggaagggaaagttgttcaagtctaccgtcgcaaatgggtgatccacatcgagcgcatcacccgggagaaagttaacgggtcgaccgtcaacgttgggattaacccatccaggttgtcattaccaagctgaggctggaca

SEQ ID NO: 3094 - DNA, 492 bp, Gossypium hirsutum
  Clone ID: uC-gsronu33B111d04b1
tttttccttcttcaaatacccaatggccgtcactttctcaaatctccacaccgagtctggtcttaaagctcttaatgacttcctctctggaaaatcttacatctctgggaataagctgaccaaggatgacataaaagtttatgccgctgttctgaagaaccctggtgattctttccccaatgttagccagtggtataattctgtttcttctcaacttgccgccagcttccctggtaaagctgttggcgttgggtttggtggcaaagctgctccagctgagtctgctaaagctgaggctgctgatgatgaggacgacttggatctatttggtgatgagacggaggaggataagaaggctgcagaggagagggaagctgcaaagaagtcagctaagaagaaagaaagtggaaagtcctctgttctatggatgttaaaccatgggatgatgagactgatatgaagaagttggaagaagctgttcgatccgttgag

SEQ ID NO: 3095 - DNA, 494 bp, Gossypium hirsutum
  Clone ID: uC-gsronu33B111d06b1
gtctgatccgtgatgggggatattagggtccttgggaacatggatgatgatgagggtttcagcttcgctaagaaaatccagtctccctacgatttggttatgcaaacgaagcagctggggaggttgccagtggttcagttcgccgccggaggcgtggccacaccggcggatgcggcgttgatgatgcagttgggttgtgacggagtgtttgtcggatctggggttttcaagagtggtgacccggctaagcgtgcccgagctattgttcaggccgtcactcactacagtgaccccaacatgcttgcggaagttagctgtgggctcggtgaggccatggttggccttaatttgaacgataagaaggttgagcggttcgcagctcggtctgattagtaagtgaaggagggatcaagcctttggttgttgaaccaccgtcaccagtgcactgttgttccaagttatcatagttaaagtggagtctctcatacagggga

SEQ ID NO: 3096 - DNA, 434 bp, Gossypium hirsutum
  Clone ID: uC-gsronu33B111d07b1
tttgtttcagctgagcaaagaagaagcactgccgagattgtccaagacagtgaagttaattataactattgtgtctatgactcagacatatcaacaggctatggtgttggtgcatttttgttccttatggttagccaagcccttataatggctgcaagcaaatgcttctgctgtggaaagggtttaaaccccagtggttcaagggcctgggcagtcatccttttcatagtctgctggttgtttttcctgattgctgagatatgcttgctggctggatcggtgagaaacgcctaccataccaaataccgaaccattttcagcgagcagcctccctcttgtgaaactgtgaagaaaggtgtgtttggtgcaggggcagctttcattttcttaaatgccattgtcaacaagttctattatatttgctattcaagtgc

SEQ ID NO: 3097 - DNA, 488 bp, Gossypium hirsutum
  Clone ID: uC-gsronu33B111d08b1
tcctacgcgagcgggcacttccaacatacacgacagagagcccagctgatgctaccagaaatctctcttaacaaaatgtaaacgcccttgcaaaagtactcccaggtcttcttggtggcagtgcagatcttgcttcttccaacatgaccttgctcaaaatgtttggggatttccagacagacacccctgaggaacgcaatgttcggtttggtgttagggaacacagaatgggagctatctgcaatggcattgcccttcacagccctggcctgattccatactgtgctactttctttgtcttcactgactacatgagggccgccattaggatttctgccttgagtcaggctagagttatctacgttatgacccatgattccattggtcttggggaagatggaccaactcaccagccaattgagcacttggcaagcttgcgcgcaatgcctaatgttttgatgctccgtccagctgatggaaatgaaacg

SEQ ID NO: 3098 - DNA, 481 bp, Gossypium hirsutum
  unsure (1)..(481): unsure at all n locations
  Clone ID: uC-gsronu33B111d09b1
tggtctgtgaggacggcagttccgttctaaagggaaaactctttaatccaaacgcagacgttcccttctttttcttattttcaacaaatatggtttttattcttgctaatgttaatactccaattatgtgtttcttctctttgtgagttctccccagatttctgaaaaccccgaaatcaaaaaggtgttttctttttgtttgtttgttcacatcttcatccaaagcaaccatggcggcgtctgatcctcacgcgcctctccttcgtccgcgtcaacctgatggctcggctgctcgccctgtatcgttggcgcatttattggggcgagccacgggacggcgtggcgcttccatgctggttagggagacagcggcacgtgagttggaggagcggagggccgactgggggtactcgaagcccgttgtggcactggacatgctgtgnaatacagcgttcgtggtggtgtcngtagtgatgttgat

SEQ ID NO: 3099 - DNA, 490 bp, Gossypium hirsutum
  Clone ID: uC-gsronu33B111d10b1
tgttagccaattatgcttcctccgacgacgatgagccccaacaaatcactcaccgtgctcctcctcctcctcctaaagtttcctctctccctcaacccaaatcttcttcccttttcactaatcttccgcagcctaaacaatccctcaaatccttcacaaaacaccacgacgaagacggaaacggcggtggaggaggtgaagtagctgttcgtgttcccaaacctgctgttcctcatcccaaaaacccatccaatcttttctctcatcttccccaacccaaaccacaacagccacccaatcctcctgtcgccaaaagaatcgttcaattcaagcctcctataaaccccaatacccacgtggattccgacgatgacgacgaggaggagaacgaaaggccaaagcggggagaatccgaaaccctagctcaaggtccttccgtgaaatcctttctatcaagcatacctgctcccaggaactccactacattagg

SEQ ID NO: 3100 - DNA, 489 bp, Gossypium hirsutum
  Clone ID: uC-gsronu33B111d11b1
tccctacgcgtccgcccacgcgtccgatttctgggcacatccttcaccatctctaacgctctttacgggccgtcgtcgccagtggttcagctcactccatctaatttcaagtccaaggttttaaattctaacggagttgttttggttgagttcttcgcgccttggtgtggccattgccaaactttaacacctacatgggagaaagcctccaatgtcttgaaaggtgtcgctacagtggcagccctcgatgctgatgctcataagtctctttcccaggaatacgggattagaggatttcctacaataaaagtgttcgtccctggaaagccacctgtagattatatgggagctagagatgtcaaacctattgccgaatttgctctccagcaggtaaaggcacttttgaaagaccgtctcgctgggaaagcatctggaggatcaagtgagaaatctgagtctagtgcatctgtagaattgaattcccacaac

SEQ ID NO: 3101 - DNA, 249 bp, Gossypium hirsutum
  unsure (1)..(249): unsure at all n locations
  Clone ID: uC-gsronu33B111e03b1
acgctcgcccacgcagtacgaaccatggggcangctttaagaaactttaatgggtatccacatattaaatggctatgggtcctattaaaacaaagccccaaggatggtttaattaacatttgcaaatggtgacaattctcatctaccagctgttcgtagcgggatgctctccaaattttcctagataacacattgcaccctaaggacagtgggattaggaaggacaggggttagcactggtgggacaag

SEQ ID NO: 3102 - DNA, 426 bp, Gossypium hirsutum
  unsure (1)..(426): unsure at all n locations
  Clone ID: uC-gsronu33B111e04b1
ccctctcgtccgcccacgcgtccggttctgaaggggggccctgttgtaatcatgtgggtctgaaaatattccaactcgaattaaccagtgcttagaagaaggtgctcaaatgttcatgctgaagcccttgaaacagtcggatgttaagcaattgaaacgccatttgatgaaatacagaagctgaaatttacccttttttgaggacaaactttagccattaccaaaaaatgtatgagaaacatttattctaataaaaaatattttttcagatgcaatttcttgttctgtttttaatccagagttcagctatcttcggaaagagaatattcattgtaccgagtaaagacttcgtttgtactaagttttatttaaatgtttatatatgatatagtttgtgtgnaanaaaaaaaaatttttaataaattt

SEQ ID NO: 3103 - DNA, 493 bp, Gossypium hirsutum
  unsure (1)..(493): unsure at all n locations
  Clone ID: uC-gsronu33B111e05b1
ccttctcgtccgcccacgcgtccggtatatttagggcggaaaacagaaagaggccggcgttgtcgtccctgcagcagaacagcaaaagaagcaaagcaatggcaaggatcaaggttcatgagttgcgacagaaatcaaaaaccgatcttttggctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaagaagaaattcttgcctctcgatctccgtcccaagaagacccgagctatccgcagaaggcttaccaagcaccaggcatctttgaagaccgaaagggagaagaagaaggaaatgtacttcccaatgaggaagtatgccattaaggtgtanggtaggatctctcacattctatt

SEQ ID NO: 3104 - DNA, 270 bp, Gossypium hirsutum
  Clone ID: uC-gsronu33B111e08b1
atttatattaggcttctctgtttttatgggcttgggtgtgccacataacttcaatgagtataccgtagttaatgggtatggtcctgttcacacaagctcatgatggttcaatgacattgtagaatgtaccattcttatcctaagctaccttagcgtgatgcttgacatattgactcgataacacattggaccgcatggacagtcggattaggaaggacaagggtcagcactggtggtacaagttccaatccttcaagggagattctagga

SEQ ID NO: 3105 - DNA, 493 bp, Gossypium hirsutum
  Clone ID: uC-gsronu33B111e09b1
ttcctcgcgtccgcccacgcgtccgatcgtgaccagcctgttgaaggtcacatgcagccaaacatgaagagttcccgtttcgaagaaatgagcgaggctatcaagttcttagtgagccaaaagcttattaataggaaccaacttactgaaggtggggaactccaagcctcaaaagaagctatgcatgcacttcaaattttgagtttaaatgaggaactgtttttgaaacttctacgagatccaaactcatcattggtcaaaaattctaagaactcgccaaatgctcgagatgaggagtctaagcccttttccagatccaacttttcagagcaagagcctgttggtttaagacaactgaatgagactgttaatagaaaacagcgtaatttctttagaagaaagtccaagtctctggaaagagacttatcagatgaacagaaggtttccgaagcttcaactaaaattgtagttttgaagcctggaccgacatgct

SEQ ID NO: 3106 - DNA, 466 bp, Gossypium hirsutum
  Clone ID: uC-gsronu33B111e10b1
tgataaaccatcattttgatctgcagttcacggccggcattccatattctcacgtgcaacagcaggtgtcaatggctcaagtagcagcagctctctctctctctttcctcatcttttccttcattccaggtggaactttgatgatggtaaatggacagaaaagttggtgtgtggctaagccatcatcggatcaggcaactctactggcaaacattaatttcgcttgttctcaagtggattgccgtgtaatgcaaaagggttgtccttgtttcagccctgataatctgatgaaccatgcttccattgctatgaatctttactaccaagccaagggtagaaacaagtggaactgtgatttcagaggctcaggtcttattgtcatcactaatccaagttatgctgactgcatttatgactagcctaagcttatgactggacattggtgtggtttaagccgctttacata

SEQ ID NO: 3107 - DNA, 496 bp, Gossypium hirsutum
  Clone ID: uC-gsronu33B111e11b1
ctcttctatcccttctcttttaaaaaccctaaccccgcggccttttaccctcgctctgggttccttgccaccaaaaaacatctttctgttcaattcaatcctcctttttctattcaaccataatgccttgcttcattagcaaatacgccgatgagttggctaaaaacgctgcttacattggcacccctggaaagggtatccttgctgctgatgaatccaccggcaccatcggcaagcgtctttcaagcattaatgtagtaaatattgaagaaaacaggcgtgctctccgtgagctcctcttcactgctccaggagctcttcagtacctcagtggtgttattctcttcgaggaaaccctttatcaaaaaaccgcttcgggcaagcccttcgttgatgttttgaaggaaggtggtgtcctccctggcatcaaggtccacaagggtaccgttgagcttaacggaaccaaccgcgagactttcacccagggtctggatgg

SEQ ID NO: 3108 - DNA, 496 bp, Gossypium hirsutum
  Clone ID: uC-gsronu33B111f03b1
tctttctctcatattagtgctttcgccaagcgtgtaagacatatgcaagctgcgttgcaccagggtcatgcacttgaatctgataaaagggctgaaaattcaaacgcctcccagatggcagaggatgtttctgcttttaatgagcaggagaaaatagtgaagctgggtcagccccatgcacgggagtttcaaagcaaactgtctactgcttcaactaggagttgtactaaggttctcatgcaggggactgctcttggaaggtctgtggaccttaccaagttcaacaactatgatgagttgatcgctgaattggatcaattatttgagtttggagggaaataaatggcccctcaaaagaactggcttgttgattatactgatgatgagggtgatatgatgctagatgtcgaagatcctctgtaagacactcatgttacttatcctttgttacccagatctataattgattctggttgtaaacttatttacatttgca

SEQ ID NO: 3109 - DNA, 489 bp, Gossypium hirsutum
  Clone ID: uC-gsronu33B111f05b1
gtcttcttcaagatctcggaacaggtcccatgcgcaggagaagaagagcacagggggggatcaagggatgtggactatgggaagaagagacgcctaccatcagagtgacaaactatgctgtgcatgcttctttacactttcttatgagacctttaattaagttttcactctcagtatctcttcccttggttgttatatcatttcagcattctctgtgatgattgttggtccaggtgccaaacgtcgcttcttaaagggagaagtaagtgctacttgcgtgggtggtggggaagaatagacttccctttttgtttcttactgcactctaaagagccactattagatgaaaaacttggtattcctatgttggaacttggaaaaacatagtattttattcaatgtggatattctttgtggggttggaatcctaacatcctacatctgaatatcaacattgggtttataattatctgcaaaacactatattcg

SEQ ID NO: 3110 - DNA, 486 bp, Gossypium hirsutum
  Clone ID: uC-gsronu33B111f06b1
gtgtgttttgtatttcatactcatttagcccctgtcagtagcatcgaaatcactccaggtttctttatcactgaaaaatgtcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagtagccatggcttgtcgtaggttttgcctgttgccgccacggttacttggtgcttgccaatagatagagtgaagtactaat

SEQ ID NO: 3111 - DNA, 573 bp, Gossypium hirsutum
  Clone ID: uC-gsronu33B111f07b1
actataggtaaagctgcgtcctcctgcacgcgccgcggcatgaatcggggggatccgcacgcggccgcttgacttcatgcggcgttcttccgtttcgcatgggtcctggaatgacggcattcagtgagcttttcttcggaactatacacaacacatagttgaccggggatgacgttgcccctaaagcatacatatgttgcgaactcttacatacagcacaccgttcggaagctcggatggataatgcttaagtagaatccaacttgaccgcaccttgcgagacctccatactttatccagctgatggaggcaacatgcattgcttcactgctgtcacagtatgcacggtgttggatgttctaggccctccttactcggatctcgaaggacggcactgtacgtactacttggcctacccattcacaaaattctcaggcgatgaacaagtatcaattccggatgaagagaaagactagggtgctttgctccaagagagggacaaacctgaagatttggttgtggagggggctttgaacactagacccgttatcagggaaaactgatctgaaagtc

SEQ ID NO: 3112 - DNA, 392 bp, Gossypium hirsutum
  Clone ID: uC-gsronu33B111f08b1
gctggttcgcccatgcgccatcggctagagttcgggtcttcaccaacttgtattggggcttcacctccaatatccccaccttgtgcggcacctgctctgtgaccccctgggtcattgaactggcagagtgaacttgctgcttctatgcgacagctgcagctggggcagtgtaaaacgaatggtgcttgctcctggggcctgcaaatgggatcgggtttcagttctccacgtggttccacactccggcccggtttttgcacatgtcctgtaactacaactggtgcgccgactcagcctaccctgagtcactttgacctctgggaatatacacctgggccgaggcacctgcgatggagagagagggtgctcgaagcgacctcagggcaacggtg

SEQ ID NO: 3113 - DNA, 491 bp, Gossypium hirsutum
  Clone ID: uC-gsronu33B111f09b1
ccgccgtttgttctaaataacctgtgggtggctttatacaaatttgcgaaacaaaataccgatagtgtacctaaatctttcaaagagatgatttctactctccctaaaaagagttggtggggtcttcctgaagatcaatatcaatatcaaaggttttggttcagcccgccttttctacaaggagcattgtcggctcaacaacaattacaagctcaaccaactgatatcatcctttgtagctttccaagaacaggcacagcctggttaaaatccctcactttcgccactattacaagaacttcatacaatgatttcacccacccctttactttccaagatgcctcatgatggtgggccttacatggagtttgatcatgcccagatttccattaatcgacatcttggaattcctcttttagccactcatctcccttattctttcttacccagaactataattgattctggttgtaacttatttacatttgcag

SEQ ID NO: 3114 - DNA, 467 bp, Gossypium hirsutum
  Clone ID: uC-gsronu33B111f10b1
tgcctccaccaccaccaccaccaccaccaccagcaacccattttctctttcatctccaccgctcaaaatgtctcttcaccatttgctctttcccattctaatactcgcattctccactgcttcttcattagctgccactgcaaaagaccaaactttaaacactcatcaagctgagttctttaaccccaagcttccacccagaatcctttcctcttccaaaaagttcgaaggctcatcggacattgtcgacctccgttaccacatgggtcccgtcctttcctcgtcgccaatcaatatctacctcatttggtacggtcgttggtctgtttcccaaaaactcctcatcaaagacttcataaactcaatttccccttccgcgacgccgtcgtttccgccgtctccttccgtttccgactggtggaaaaccgtctctctttacactgaccagactggagccaacgtttcgc

SEQ ID NO: 3115 - DNA, 166 bp, Gossypium hirsutum
  Clone ID: uC-gsronu33B111f11b1
ttttcgcgtccgcttatttttgatagtttttgtgggtataattatatgttccatgggtgaaccattatagttgtttcaaccttaattggtactcaacttattaagctttatgtgaacttgtttatgaaggtatttgaagtgggtaattttcagtttttcccctctg

SEQ ID NO: 3116 - DNA, 66 bp, Gossypium hirsutum
  Clone ID: uC-gsronu33B111f12b1
taatgtacatcaaataatgggaaaactcccaggtggacatacaaacatataatggtggtgaagagt

SEQ ID NO: 3117 - DNA, 243 bp, Gossypium hirsutum
  Clone ID: uC-gsronu33B111g02b1
gcgtttttgagtctgcccattctggccagtagatttacactagggccatccacacctagggcctttgttatacttgtgcttaaattagatctatgtagtatttgcctttcttgactttctataaatgatttttccttttgctaaagacctccatctaaattgtgtgagctacagtttcttgttgtactggtttaatggataagtttttgttcctcacaataaaataaaatctggactaaatag

SEQ ID NO: 3118 - DNA, 510 bp, Gossypium hirsutum
  Clone ID: uC-gsronu33B111g03b1
ttttcgcgtccgcccacgcgtccggcaatttggatcggtgtagtacggaaaatgttcaggaaccagtacgataccgacgtcactacatggagcccagctgggcgattgtttcaagtggagtacgcgatggaggccgtgaagcagggttcggcggcgatcggtctccgatccaagacccatgtggtgttgggttgcgtcaacaaggctaattccgaattgtcttctcatcagaagaagatcttcaaagtcgacgaccacattggggtcgccatcgccggtctcaccgacgacggtcgcgtgctctctcggtatatgcgaaacgagtgtatcaactacagcttcacttacgaatcgccgcttgctgttgggagactcgtcgtacagctcgccgatagagcacaggtttgcacccaacgctcttggaaacgaccttatggtgttggcctgttggtggctggcttggatgaatctggggctcatatttactatcactgtcccagtgggaattac

SEQ ID NO: 3119 - DNA, 330 bp, Gossypium hirsutum
  Clone ID: uC-gsronu33B111g04b1
cgtatcgacccctccggtatctcctttttccgggggcagagaatcatatcggttggggagaaggtccacatcggatgcatacgagaaggctaacgaggttggaccaaggagccctcgtcctccttacgacgtgtgagatatgagtcctctcccatatttggcgacaaatcaaatgggttttggtactgtttgcatgcttaggtctttcaaatgtgaaacttatagtgtagtatggggtaatgtatgcaagaatgtattctggcgtatatagagcttgccatactacggtcctgccgttgtttgtccgaataagatttcggtgttggtttc

SEQ ID NO: 3120 - DNA, 476 bp, Gossypium hirsutum
  Clone ID: uC-gsronu33B111g05b1
ccctcgcgtccgcggacgcgtgggcacgaggtgtgcggaggggagattcccgatgaggaaggagaggtggacgctgacatgtctggtggagctgaagactacgaaggcaacgaacatgatcttgagcacgatcctaattccaactccaaggatttggaggacatgaaaaagagacttaaagagatcgaggatgaggccggagctttacgtgaaatgcaagctaaagtcgagaaggaaatgggcgctgtccaagattcctcaggtgcttctgcaactcaagctgaaaaggaggaagtcgattcgcgctcgatttatgttggtaatgtagactactcatgtacacctgaggaagttcagcagcatttccaatcctgtggaacagttaacagagtgacaattttgaccgacaagtttggtcaacctaaaggattcgcctacgttgaattttgtgaaatcgacgctgttcaaaatgctct

SEQ ID NO: 3121 - DNA, 421 bp, Gossypium hirsutum
  Clone ID: uC-gsronu33B111g07b1
cccttgtttacgagtgcataaactagagcttgctggagagcttgatttgcatgatgtcgtgtcttttgacgccgtatttggcaaaatgctgcaagaagtgcatttactggttcgtctaaagcaatagctagattcattgggtggtgacaatagtgatgcactttctgacttacagtcacttggagcctcaatataagatatctgtctggatttcacgctggaaggatatccggactacatactggagcttggggatgacactgtggatatcaacaacttagaggaatacgtatcttcggttgctgatgcagctgtgaagactggaatggtgcatcaaatggacgcatttagagacggttataatcaggtattagagatattatcactgcagaaagatacgccccaagagctggactatctt

SEQ ID NO: 3122 - DNA, 476 bp, Gossypium hirsutum
  unsure (1)..(476): unsure at all n locations
  Clone ID: uC-gsronu33B111g08b1
ggcattttgcaattgcaacacctgatgtctacaaaatggttgaggacatccgtgcaaagggtggcaatattacaagagagcctggtccagttaaaggtggatcctctgttattgctttcgtgaaggatcctgatggttatatttttgagctcatccaaagagcttctactcctgagccactctgtcaagtaatgcttcgtgttggggatttagaccgctctgttaagttctatgaaaaggcgttgggaatgaagctagtaaagaaggtggataggcctgaatataagtactccatagctatgatggggtatgcagaagaacatgagactactgttcttgagttgacttacaattacggagtgactgaatataccaagggaaatgcatatgcacaggttgctattagcactgatgatgtatacaaaagncgtgaggttgtggaacatgttatacaagagcttgngggaaaggttact

SEQ ID NO: 3123 - DNA, 346 bp, Gossypium hirsutum
  Clone ID: uC-gsronu33B111g09b1
ccctcttgtccgccaccttctttaaaaaaaaatggggcatgtataaaaaaaaaaagtggggtgcatagcactctataggatccatatcttccttaggcgctgcctgcagacaatagacctattgtataagcgccacctaaatatcggttaactggccgacgttgaacaccgtcttgactccaaaaaccctgggggtacgccaagttataacaatggttgcacatcactcgttttgccatctgacgaaatatctaaaaggccccgaccacattgccttcgccataaccgggctgactgactgcggacgggtgctctctcggtatatgcgaaacaagtgcatcaacta

SEQ ID NO: 3124 - DNA, 481 bp, Gossypium hirsutum
  Clone ID: uC-gsronu33B111g10b1
gttttgttttgcatgtattgacaactggggggcaatcacaaacctttgcccagtttgccagagtgaatttcagttaatcacctgtgtcccagtatatgacaccataggaagcaacaaagttgaggatgagacattttccagagaggatgattggtccattgaagggaagagcaacactctttctttcccgtcatactatattgatgaaaatttatctgcttggatggagatggctgcaaagttcgaagtttatccacaaccattgagggagatcccgatctcgatacatcaattgcttgtgactcttgtgatatatggtaccatgcattttgtgtgggatttgatactgagggcacatcagaagacacttggttatgcccaagatgtgtagcaaatcaagcttcacaagaatctggtgtggttcttgagaaaaaaaacaccccgcttggtccagagattgctaatggtgaatatgtgacag

SEQ ID NO: 3125 - DNA, 471 bp, Gossypium hirsutum
  Clone ID: uC-gsronu33B111g11b1
tttttatggaagactaagcagcttgaaaacggggggacactttacaagctggcggtgataccctcaaagatgattatggtaatctcctcatagagaaagataaacttaaacaggaggttcttcagcttactgatatgccggttatgaaagaaaagaacaactcagagttatctgatgtgaacacagtgtgtcaagaaccaccacaaaagcctgttgattcaaacagccctcattcatcttatccattcgaaccagatcagtctgatacatcacaagatgaggaagataacttgagtaaggctttgtttcaaccatcttcttacatcttcccaaaattggaagacaatgattactccgacccgactgcaagttcttgtagttatggatttcatgttgaagatcatgctttctggtcttcggctattaagttacacatctatatgttacatacatacataaataaattatgat

SEQ ID NO: 3126 - DNA, 178 bp, Gossypium hirsutum
  Clone ID: uC-gsronu33B111g12b1
tccttcgcgtccgattatgtttagtgttccaggagggtttatataaataaccttggtggaaggactgattggttcagttggtgaaagacgctatcttgtgaatggcatgaattgattgagactcacttatttctcatcaaatgaatcaaagatttgtatatgcaaaaaaaataactac

SEQ ID NO: 3127 - DNA, 238 bp, Gossypium hirsutum
  Clone ID: uC-gsronu33B111h01b1
tcccattcgtccgaccactcgttcgacaaaagaggggtttaataaaattccttggaggtatatcacattctatacaacgattagtccatttatgacccacagaactatgagcaagtctgtcattgcactggcatctaaatctgctgaaacacttttcaaatacataccacctgagcaagtgccaattcaatatggtggaacgagtgcggattatactgattacaatccataatacact

SEQ ID NO: 3128 - DNA, 186 bp, Gossypium hirsutum
  Clone ID: uC-gsronu33B111h02b1
ccctcactataataaagctcgtccgcctggacctacccatccttacttccccgatccacccacgcgtcctttctcacatactaccacacgcacgtcaaagcaggggcatattaaaactccttggcgtgctaatgacatcctatactcagatataatccatttataacccatttacctctcagctaa

SEQ ID NO: 3129 - DNA, 283 bp, Gossypium hirsutum
  Clone ID: uC-gsronu33B111h03b1
ggataccttttatcaaaaaaccgcttcgggcaagggctgcgttgatgttttgaaggaaggtggtgtcctccctggcatcaaggtcgacaagggtaccgttgagcttaacggaaccaaccgcgagactttcacccagggtctggatggccttgcacagcgatgccagaagtactatgaagctggtgctcgctttgctaaatggcgtgctgtccttaagatcagtgctaatgagccaaccgagcttgcaatccaagaaaatgccaacgggctagctatgtatgct

SEQ ID NO: 3130 - DNA, 466 bp, Gossypium hirsutum
  Clone ID: uC-gsronu33B111h04b1
ccctcgcttccggtgaaagggcactggagtcgccgtgtgcctcaaggggctgctctggaggctgaatggaatgcaaagttttctgcatatgagaagaagtacaaagaggaagctgcagagctcaaatcaataatcactggtgaactacctgctggctgggagaaggcacttccaacatacactccagagagcccagctgatgctaccagaaatctctctcaacaaaatcttaatgcccttgtaaaagtactcccaggacttcttggtggaagtgcagatcttgcttcttccaacatgaccttgctcaaaatgtttggggatttccagaaggacacccctgaggaacgcaatgttcggtttggtgttagggaacatggaatgggagccatctgcaatggcattgcccttcacagccctggcctgattccatactgcgctactttctttgtcttcactgactacatga

SEQ ID NO: 3131 - DNA, 482 bp, Gossypium hirsutum
  Clone ID: uC-gsronu33B111h05b1
ctttgatggtcagaaaatggggcctttctgtttggtccggtgtgccgatcgtacggggaggttgattatagatgatgcattaagaacaacgaaacccgttattgccaaggtccgggaatttgtacaagagttaaatgcatccttagatatctcagaggatttcattcaattagcaacagcttataaagaaggtagttggcaatttccgcttgatgcttcagcacggtggagtggcagttaccaaatgcttgatattgttcagaaggccgggaagtcgatggatgccgttgtaaggaagaacgaagagatgttgggtaatcggatgttgctgaatactgcagagaagaatgttgtcaatattgttcacaattacttggagcctttctacaaagtcattagtgagatatgtgtaaacaccccacctacgatcgggatggttattgtctacatggatcacatttcggatacaatcacaacacgac

SEQ ID NO: 3132 - DNA, 484 bp, Gossypium hirsutum
  Clone ID: uC-gsronu33B111h06b1
attcaatggcttcagcaacatgcagtatcttctggtcgggctctctttattttgcggagggctcctctcactcttccgattacaaactcatcacttcccttccatttttctgttctttcagcccaatttccagcctgaaactttcacatcactcgcttccggtgctacccaagcgagcatttcgggttttggcttctgattctacaacggacccacatgaaattacggatagttccggcgctgaatcaactattgacacaaaattaccaagaagaagtttactagtccagttcacttgcggggaatgtggtgaaagaacagagagactcataaaccgcttggcctatgaacggggacttgtgtatgtacagtgtgcagggtgtcttcaatatcacaaattagctgacaatctcggccttggtgttgagtatgacttaagggatgaaatgtgaagacagatcaagttaaaccagcgacatatata

SEQ ID NO: 3133 - DNA, 192 bp, Gossypium hirsutum
  unsure (1)..(192): unsure at all n locations
  Clone ID: uC-gsronu33B111h07b1
ttcctcgcgtccgaccacgcgttcggcaaaacagggggttattaatgatccttggtgggatattgcattctatacaacgattagtccatttatgacccaaagaactaatagcaagtctgtcattgcactgccatctanatctgctgaaacacttttcaaatacataccacctgagcaagtacccattcaata

SEQ ID NO: 3134 - DNA, 496 bp, Gossypium hirsutum
  unsure (1)..(496): unsure at all n locations
  Clone ID: uC-gsronu33B111h08b1
ttcctctcgtccgaagtaagccactaaggttgggggggaatatcaaaatggctggtggaagatcagcttccatggtcctccttttggcactcaacattctctttttttccctagtcagtgcttgtggctcttgctcttcacccacccctaaaccaaggccaaacccaaaccccaacacccccactcctactccatctgcacgaggcaggtgccctagggatgccctcaaattaggtgtatgtgccaatgtgcttaacctagtcaatgtcaccattggttcacccccagtgatgccatgctgttcccttctcaatggccttgtcgacctcgaagccgctgcatgcctttgcaccgctatcagagctaacattttaggcatcaaccttaacatcccagtttcccttagcttgctcctcaacgtttgttcaaggaacgttcctactggcttcaatgctaaaccatcactgttccctacacttnttatcgnctttcttat

SEQ ID NO: 3135 - DNA, 479 bp, Gossypium hirsutum
  unsure (1)..(479): unsure at all n locations
  Clone ID: uC-gsronu33B111h10b1
ccctcgcgtccgcccacgcgtccggtcagttggagttctttaatgtcgatgagctggaaacaatggcaactgctgaacattttatggccacagatattgaatgggatcccactggaagatatgttgcaaccgcagtaacatctgttcatgaaatggaaaatggtttcaatatatggtcctttcatggtaagctactctaccggatactgaaggatcatttcttccagttcttgtggcgcccaaggcccccacccttcttgagcgctgagaaggaggaagagatattaaaatacttgaagaagtacagtaagaagtatgatgcagaggaccaggatgtttcgatgctattgagcgaacaggatagggagaagagaangatgttgaaggaagaatggaagaagtggataagcgaatggaggcggtcaagtgaggaagagaagtttgagaggcagaagttgagggatggagaagcaagtgat

SEQ ID NO: 3136 - DNA, 323 bp, Gossypium hirsutum
  Clone ID: uC-gsronu33B111h11b1
tatttctcatacaataacacataacaaacaggggggggtttatataaaaaatgggggggaaacaaaaacaacttataaacaattttatacccacacatattgaatgggcccccccttctagatattccacaactccttccccatgctttcatcaaattaactattctttaaatttccctaaacttacttgattggccactttttcccatactgaatgctgattaatccctgctcttcccaaactaaatgcccttaccctacttccccttttagacagatgactaaatattaaaataccccaagcctttcacccttacaaataa

SEQ ID NO: 3137 - DNA, 114 bp, Gossypium hirsutum
  Clone ID: uC-gsronu33B113a02b1
cccacgcgtccgggaaaattcacctcagtgtaaacgataatgtttcagttccaaaaaaaataaaaaaaaaagccgaaccagaaacaaagctctagcagagactaaagctatagg

SEQ ID NO: 3138 - DNA, 437 bp, Gossypium hirsutum
  Clone ID: uC-gsronu33B113a03b1
cggacgcgtgggcggacgcgtgggcggcggttaaggggaggaggttcttggatcttaacgatgacgacgacaccgaggatgaaaacaaaggcgatgatgatgaagtaacggtggcgaagagaaaaaagaagagggtattgaggaacggtgcggtgcggaaactgggcgatgattttgagcgagtggcgaagaatagcggcttggtgagcaaaagagaggaactttagcgatgggataggtagcgatgtgaagaagatggtggaggaggttaacaatgaaccggaaagtgaaggagataaggagaaaacagaggcgcagagtgggagtagtaggacttcaccaagataggcaaggcgtagccgctattaaggttaatgtatgtttgttttaatttggtgatggtgtcatttagaagcatttgtaatcgtaaatacaaa

SEQ ID NO: 3139 - DNA, 453 bp, Gossypium hirsutum
  Clone ID: uC-gsronu33B113a04b1
gctttttcttatgttttcctttttgtcccttgcttaggggatgtttccctttaatggccgtcgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttacttttcgtggcgagaaagctatgagggacgcgatcgaaggaatgaacggtcaaaatcttgatggaaggaacatcaccgtcaacgaagcccaatcgcgcaaaaatggaagctgttgccgaggatttggaggaggaaacggtggttacagccgcggtggaggcggcggcggatattgtggtcgccaaggaggatatggtgggggacgccctgaaagtggatacggaaatggtggagggg

SEQ ID NO: 3140 - DNA, 192 bp, Gossypium hirsutum
  Clone ID: uC-gsronu33B113a06b1
ttttggcattggttgcaggtgaagaactggggggctacgtgtagagtttaatgggtttatccacacaatcccattggtcacctgatgattgatgatcagacagagaatgcatataggatctagttctagacaaatagctggcttgtatgcagtaactctattatcaatgggtaaatgagagctaccgatatg

SEQ ID NO: 3141 - DNA, 299 bp, Gossypium hirsutum
  Clone ID: uC-gsronu33B113a07b1
gtcatgcaacgcgagcgagcacgctagcggacgcgcgagaatttacacgcgcatgcgcacacacaccccacctatagggtcacctaaagtgacaccaatgggcagatgactgaaccaacgtgaccggcgaagccaccgggtaacccaactcgatccccaaccaagacatctcgcagtagacagccggcgcgacagccaacatgtccgcagcgaggcccgttacgaacacccttgcaggcagaagggcgaacggtacgcgcaactggacgggacatcaagcgcggcaaaactgcggttgc

SEQ ID NO: 3142 - DNA, 435 bp, Gossypium hirsutum
  Clone ID: uC-gsronu33B113a08b1
cccacgcgtccgcccacgcgtccgcccacgcgtgcgtccacgcgtacgcccacgcgtccggctttttgttacctcgatttcaagtgaatcagaatgggtaaggaaaagactcacattaacattgtggttatcggccacgtcgattctgggaaatcaaccaccactggccacctgatttacaagcttggtggtattgacaagcgtgtgattgaaaggttcgagaaagaagctgctgagatgaacaagaggtcattcaagtatgcttgggtgcttgacaagctcaaggctgagcgtgagcgtggtatcaccattgatattgccttgtggaaatttgagaccacgaaatactactgcactgtgattgatgcacctggacaccgtgactttatcaagaatatgattactggtacgtcacaggctgactgtgctgttttg

SEQ ID NO: 3143 - DNA, 449 bp, Gossypium hirsutum
  Clone ID: uC-gsronu33B113a11b1
gcgttctggcgcgcgaacggagggaagcaccggggggaggggtaaatggagtattgttgccactccaaaccccaagttgcagcggaaaaaagcgactcaggggtggcgaaatgagccatgggggattccaacaatctcaggaaagagttggttttcgtgcgggggtgtgcagactgtctgtccatgggaaccacaggtcataacttcgtagagatgatttaggagtttttctgtattcagtaagctttttgtttgcattcaatgggagctttctctattgccctggatgtatttttcattaagctcgttgtttctgattatttgcttcacctttagcccttcttatgccaaaactaaagctctctggactttctgttcttacaaaattacaagaaaaaggactggacaaaatggtttagaccgctctccatgattgtttggagactatt

SEQ ID NO: 3144 - DNA, 431 bp, Gossypium hirsutum
  Clone ID: uC-gsronu33B113b01b1
cccacgcgtccggttttcactttcaaaaaacttcggacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgtgtggtgacttatatctgtcagttaacctttctctcctttactatgatgtaatggctatgcttatggccttatctggttaatgaagtatccttactat

SEQ ID NO: 3145 - DNA, 439 bp, Gossypium hirsutum
  unsure (1)..(439): unsure at all n locations
  Clone ID: uC-gsronu33B113b02b1
ctttctttcaatccaaatcctatctgttcaccggggggtaacttctatggctcgtaccaagcaaacagcaaggaaatcaaccggtggtaaagctccacgtaagcaactggctacgaaggcggctcggaagtcggctccggcaaccggaggagtgaagaagcctcatcgttttaggcccggaactgttgctctgagagaaatcaggaagtaccagaagagcaccgagcttttgatcaggaaacttccattccaaaggttggtgagagaaatcgctcaagatttcaagactgatttgaggttccagagtagcgctgttgccgctcttcaagaagctgncgaggcttaccttgttggactgttcgaggataccaatctctgtgccattcacgctaagagggttacgatcatgcccaaagatattcaacttgctaggaggatt

SEQ ID NO: 3146 - DNA, 424 bp, Gossypium hirsutum
  Clone ID: uC-gsronu33B113b04b1
gcgttccaccatagctgaaaaagaaaaagaagggaggggagttttaggcaaagtggtggatgggattctattgctaacattcgtgtccatgtcggtggtgccagcgtgcttggacgcccaggtacttttgcctaaagcgcttttccccgatgtgctgggtcgtgtatattcatggtatacgaccacataccaagattatttgctgttggatgagcctcattttttcatggcacttatgaaattggagcttgttttagtattgccgcttgctatacttaacacttatggcttgttgacctccaagccctggttcaacaccacctgcctcatcttcggttctgctcttgttacctccacgacagctatggtgggagacatgctgggatccgacaaaccatcagcaggtaaactggcgtcgatgtac

SEQ ID NO: 3147 - DNA, 359 bp, Gossypium hirsutum
  unsure (1)..(359): unsure at all n locations
  Clone ID: uC-gsronu33B113b05b1
cccacgcgttcggggaagttgctggttttgcaccgggtgagatgaggatcaccgtgcttttgaaggtcggtaaggacaagcgagctctcaaggtagctaaaagaaagttgggaactcacaaaagggcaaagaagaagcgtgaagagatgtccagcgttctccgcaagatgagagcccacggtggaggtgcagaaaagaagaaataaagctttattttcttggnttcttactggtgtcgtgctcgagtttcttgtttaggagcagctagaggtttgtttagcatatgtttcatttttgttggattgagactgaaatcagagctttggaacttttgattatttgaagttgagatgagaaat

SEQ ID NO: 3148 - DNA, 425 bp, Gossypium hirsutum
  Clone ID: uC-gsronu33B113b07b1
cccacgcgtccgcccacgcgtccgcccaggcgtccggcagcaacaacctccagtagcacagatgtatcctcaagttcatgtgccccattatgctaaccttatgccatatcgtcagtttgtctccccgatttatctgccacaaatggctatgccaggttattccagtaaccctgcttttccacatccatcaaatggtagcagctacttgctcatgccaggaggtagcactcatcttggtgcaaatggtgttaagtatgggattcagcagttcaaaccagtccctgcaggcaatcctactgggtttggcaattttaccagtccgtctgggtatgcaatcaatgctcctggtgtagatgggagtgcaacaggtcttgaagattcatctcggaccaaatataaagatggcaacatatatgttcaaaatc

SEQ ID NO: 3149 - DNA, 436 bp, Gossypium hirsutum
  Clone ID: uC-gsronu33B113b09b1
gacaaatctaacagatgtagaaactgctgaacccctatccaaactttgtcttgaatttccagacctttacattggctgtttccgcagatctagacaaggacctctcgtaattagctttgagggcaaggatccatctagagttcaggcaggtgttgaagcattgtgcaagaagttcaatgcaggggcattctctgaagtcaactagacaaatacctgctgttctttcttttgcttgataagcttcgaaagctgataagcttctttgactgctgcgactgtcacaccgagtttcagagtataagtggtagattagcgccttcggatagctgagaagggagaaggaaaggtgaagatgacataaggatttattatgtattggggtatatgatcatatgaacattaatactaccagctgtcacaatgaaagtgaacttac

SEQ ID NO: 3150 - DNA, 430 bp, Gossypium hirsutum
  Clone ID: uC-gsronu33B113b11b1
tcgtggatggatcagaagctgaaaatgactgtgtcttacgagatttagcagatgcatacggtcttgttaatgagatgcaatcttgttccagtggaaacgctgtagtaattggtggtgggtacattggaatggaatgcgcggcatttttggcaatcaataaaataaatgtaaccttggtttttcccgcagtacattgtatggctcgtttgtttacaccgaagattgcaagctactatgaggaatattatcaatctaaaggagttaagttcgtcaaaggaactgtcttgacgttcgttgaatttgaatttagtggaaaggttatggctgttaatcttatagatggaaggaagctacctggagacttggtcgtggttggaatcggaatacgcccaaacacgagccttttttgaggccaactaacacttgaaaa

SEQ ID NO: 3151 - DNA, 457 bp, Gossypium hirsutum
  Clone ID: uC-gsronu33B113b12b1
cgctggcacgcccgggtgtcgcggttccggaattcgacggatcgggtcaggcgttcggtcaggcgtcgcgtcacgcgtctgggcacgcgtccgtgcacgcgtacgaccgcgcgtgcggacacacgtacgagatcatccgtcagagaaaccattggaagagttgcctctggagctattgctaagaaaattctcaagctgttttcaggaactgaggttcttgcctatgtctctcaagttcaccaggttgttcttgcagatggctcagttgaccatgacactgtaactcttgatcagatagagagcaatattgtgaggtgcccaaatcctgattatgctgagaaaatgatcgctgctattgatgctgtgcggacaagaggaaattctattggcggagttgtcacatgcatagtgaggaatgctccacgcgggcttggttcaccagtttttgataagcttg

SEQ ID NO: 3152 - DNA, 439 bp, Gossypium hirsutum
  Clone ID: uC-gsronu33B113c01b1
cccacgcgttcgcccacgcgtccgcccacgcgtccgcgacgcctctgcttatcgcatcgtcagccatgtcaaggagaaaggttagggagccaaaggaagagactacgacccttgggcctgctgtacgagacggagagcatgttttcggtgttgcccacatttttgcatcttttaatgacactttcattcatgtgactgatttgtctggaagagagactatggttcgtattacaggtggtatgaaggtgaaagccgacagggatgaatcttcaccttatgctgcgatgcttgcagcacaagatgtttcccagagatgcaaggaacttggaatcacggccctccacatcaaattacgtgctacaggaggtaacaaaaccaagacccctggtccgggtgctcagtcagctctcagggctcttgctcgctccgggatgaaaat

SEQ ID NO: 3153 - DNA, 330 bp, Gossypium hirsutum
  Clone ID: uC-gsronu33B113c02b1
cccacgcgtccgccgacattaaatttatttaacaagttgaaatttggtgccccacttgtatgaaaggacacggtttgttctgctgcactgttagacatagacattccaagaagctgagccttgttttcatttcctaacgggggtaacaagtttgtttagttaaaatgattaaaacgatagtatctcgggtgaacatgctattcttttgtgttcattacttggcccttgtagttaaaggtagatagataatgattatgtaaagaagctgttgttctcagttgttgatggataaaggaattggaagaacttgactgccttgtggttttgaac

SEQ ID NO: 3154 - DNA, 439 bp, Gossypium hirsutum
  Clone ID: uC-gsronu33B113c03b1
gtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcatttccatactgagatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggccgaaatgaa

SEQ ID NO: 3155 - DNA, 68 bp, Gossypium hirsutum
  Clone ID: uC-gsronu33B113c04b1
aaattaaaaatttaaaaaaaaaaaaaaaaaaaaagggggaattttaaaaataatttaaatatattccg

SEQ ID NO: 3156 - DNA, 397 bp, Gossypium hirsutum
  Clone ID: uC-gsronu33B113c05b1
cccacgcgttcgcaaacactcggcttctcccagatcttcaccaacctcccaaaatgacaacccgcttcaagaagaaccgcaagaagcgcggtcatgtgagcgccggtcacggtcgtatcgggaagcacaggaagcaccccgggggtcgcggtaacgctggaggcatgcaccaccacaggatcctcttcgacaagtaccatcctggttatttcggtaaggttggtatgaggtacttacacaggctgcgtaacaagttccattggcccatcgtcaacatcgacaagctctggtctcttatcccggaggacgtgaaagccaaggccaccaaggatgccggtccgatgatcgacgtgacacagttcgggtactttaaagtcctcggcaaaggtgttttgcc

SEQ ID NO: 3157 - DNA, 401 bp, Gossypium hirsutum
  Clone ID: uC-gsronu33B113c06b1
aaatggattgttatattatgttttacttcctgagtaaagcttgttgagctatgtggttgccattgtatatgagaatgcctcgatgtcaatacaggaacatagctcaaatagcaaaggttaaggttatgaggaaacaaggccaatgggaagacctcaaaatacctagaagcattggatctatcgtctgcctcaacttgcctagtttctccggtggattcaatccttggggaacaccgtataggaagaaatttcttgatagaggcttgacttctccttttgtagatgatggcctaattgagatagtcggatttagaaatgtcctgcatggtcttgttttgcttgctccaaaaggacatgggactcgtttagcacaagccaatgcaatccgatttgagtttaaa

SEQ ID NO: 3158 - DNA, 435 bp, Gossypium hirsutum
  Clone ID: uC-gsronu33B113c08b1
ctcacccaagcatgtaccatcatcatatggatagctttcgctttccacgcagttgtcaatttcggacaatacccatacgccggatacctcccaaacagaccaacagtcagccgtcggttcatgccggaaccaggcaccaaagaatacgacgagctcgaaaacgacccagatttggctttcttgaaaacaatcaccgcacagttccaaactttactgggtgtatcacttatagaagtattatcaaggcattcaaccgatgaaatatacttggggcaaagagatacggcggaatggaccaccgacgatgaacccttagcggcatttgaaagattcgggaagaaactggtggaaattgagagtaggattatggaaagaaacaatgatagtaaattgaagaacagagttggaccggtgaaggtgccgtatacattattg

SEQ ID NO: 3159 - DNA, 434 bp, Gossypium hirsutum
  Clone ID: uC-gsronu33B113c10b1
tcgcccacgcgtccgctttcccttgagctctgtccaagaatgtcaaactacacagtggaacgcatcaaagttgcaactcctgataaagtggagctgatgacaaaagtttttaaacctaatgaagagatcaaagacaacttagtggtagtccttgtccatccctactcgatcctgggtgggcgtcaggctcttttgaaggggattgcttctgggttagctcaaaatggtcacagggctgttacttttgatatgaggggagttggagagtccactggaagagcttctcttacaggttttgctgaagtcaaggatgttattgctgtctgcaattgggtttctgaacatcttgattctcacagaatcctgttggtgggttcttctgcaggggcgccaattgcagggtctgcagttgatcaaatcgagcaagttgtggg

SEQ ID NO: 3160 - DNA, 437 bp, Gossypium hirsutum
  Clone ID: uC-gsronu33B113c11b1
ctctcggtccttctcctcccacgacggtccaagccggtggacgacgcccggtcaccaagaacggcccaatggttacctcttcaataggacaccaccaccaccaggtcaatcccgtaaatgggaagattgggagttgccttgctacgtcacgagcttgctcaccatcgttatcctcggtgtcggactcaacgccaagcccgatctcactatcgagacttgggcacatcaaaaagcccttgaaaaactcgccgccgaggagtcgtcatcttcttctgactgagatgttgtgaaacaaacttcaatctggatctgtagggggtacggatctttgtgaacgcttttggttttctgttgataaaatgtgtagttcgaataaaaagatggattcctttttttttttttaacagttgaagggcttgtagctgttgaaattttat

SEQ ID NO: 3161 - DNA, 440 bp, Gossypium hirsutum
  Clone ID: uC-gsronu33B113c12b1
gcgctttattatttgttaggaactgcgtgcgatttcagcaatggctaagcgagtgaatgagattatcatatttgcgttcgtagcgttattctcaaaagcaattggggcgaaaccatactggagaactagatggccaattgatagggtgtccactgagtgcttgacttggcaactagctgtggaggctaacaatgtccgtggatggcgcatcgtcccggctcattgcctcagccacatcgaagcttacatgaccggcggccaatatgagcaggatgttgactatattgtggagcaaatagagagttacgttagtgaacttgttgtaggtgaagatggcatggatgcttggatccttgatattgacgacacttgcctctcaaatgtcatttattacaagaaaaagaaatacgggtgcgagccttatgatccaatggcattca

SEQ ID NO: 3162 - DNA, 344 bp, Gossypium hirsutum
  Clone ID: uC-gsronu33B113d02b1
cgccgcggaccgttcgaattcccgttcgacccagcgtttgcctcacccacgggaacagaaaccagggcccagggttgactcaagatgccgtagcgcacacgaaaccattatgcgaaggggcgcatgcactaataagcaacggaagcagacggaaaagaccgcaaacgcaaaacggcaaggaccaatggaagcaaaaaaggtaatacaatcaaggctcattgcagtcgttgaggaatcagagggtggacacatacagaatggatgaccgcttcaattaggaaaaagccatctcataaaagtgcttgaaaaggactgaaatatagcaaataaagaagcagagaatg

SEQ ID NO: 3163 - DNA, 439 bp, Gossypium hirsutum
  Clone ID: uC-gsronu33B113d04b1
tggctgttcagggcgttgttttttgcaagtcatgcaaatacgctggatctgacaccctgttgggagcgacgcctattttgggtgccactgtaaagctgacatgcaagaacaccaaatacaagcaagaggccactgcgaaaactgacaagaatggctatttcttcctgcaagcaccaaagaccgtcaccagctttggagcccacaaatgcacagtgtctctagtatcatcgccaatggctaaatgcagcaaaccatctaatctccatggtggattgaagggggctaccttgaggcccgagaagccatttactgcgaacaagcttccgtttattctctacaccgttgggccatttgctttcgaacccaaatgctactagaaacttagattccactcttttcctttgttgctcttaatgtgttaccagtgcttacaagttcc

SEQ ID NO: 3164 - DNA, 437 bp, Gossypium hirsutum
  Clone ID: uC-gsronu33B113d05b1
gttcgtttgcgttttaggccccgcagagcagaagggcaagcgagctgtcgatctctccggcggttccatttccgctgaaaaggttcgagacaactacaagcagtattggtctttcttccgccgcccaaaggagatcgaaaccgccgagaaagtcccggacttcgtcgacactttttacaatctagtcaccgatatatacgaatggggctggggtcaatcctttcatttctctccttccatccccgggaaatctcaccgtgacgcgacgcgtctccacgaagagatggccgtcgatctcatcgacgtcaaacccggagaccgaatcctcgacgtaggatgcggggtaggcggacctatgcgtgccattgcggctcactcgcgtgctaaagtcgtgggcatcacgatcaacgattaccaagtgaaccgcgcccggatgc

SEQ ID NO: 3165 - DNA, 312 bp, Gossypium hirsutum
  Clone ID: uC-gsronu33B113d06b1
cccacgcgtccgggaactttgaaaaaagtgtggagccttttaaattacatggttgatcattaatttccataactttacctcttgttattgaatcaaactgtactttataatgattatggcaaaatcactttactttgaatttgttagggaatgtattgggtaacaaaatcccaaaatagttactatttaggatcaaaacataaaccccccactgtttaagtggtcaattgattatggtgtacaagaatataacatttccacttttttctttaaaaaaaaaaaaaaaataaaaaaaaaaaaaaaaaaacatat

SEQ ID NO: 3166 - DNA, 438 bp, Gossypium hirsutum
  Clone ID: uC-gsronu33B113d07b1
tcggcgagagccaatggcaacatgaaagagggggtcattttgacacctgtttacgaatcgaagaggcgactttcattcccattaacgcaagggatagtcggatcgttaaaatggagtaaagggtcgtcgttgttttcgggcaaggattcaaggtcacaaagggggttagataagcatcaaacattgcaatcgttggggaatttgagtgtggattctactgtttctatgcctgctacgatgggaagaaagccatttaatagatttgtgtgatttgttgttcaatttggttatttttttaaaattgagtgaatgatgatatgttgaatttataaaattttttcatgttaaataaaaaagaacagaaacttaaggaaaatggtgctttgaatgttgaagactttggggtatggagagatattatagtaatttttttaaaaa

SEQ ID NO: 3167 - DNA, 400 bp, Gossypium hirsutum
  Clone ID: uC-gsronu33B113d09b1
cggacgcgtgggcggacgcgtggggaataccatcaaccgaagagattgctgaccgaattaacaagatgcttgctgtgcttgagaccaacatcttgtgggttaacccagactgtggtctcaagactcgcaagtatgccgaggtgaagccagccctgaacaacatggttgcagcggccaagctgctccgcacccaacttgcgagtgccaagtgagaggcatatctgaggtcggacatcatcctttatatcgaagatggtccagaggaaatttgtcttaaaacatttgaataactgaggtgtggaagtatttgttaggcgtatcatatgcccctcttttaggccaattgttctcctttttctttgttggttatttaccctctaaatttttgtattttcgggaa

SEQ ID NO: 3168 - DNA, 401 bp, Gossypium hirsutum
  Clone ID: uC-gsronu33B113d10b1
gcaatacttcagtgcgacatggtgtgggccttgtagaatgcttgcaccattttattgtgaactctcagagaagcacccttctctaatgttcttgttgatagatgttgatgaactaactgatttcagcacctcatgggatattaaagccactcctacatttttctttcttaaagatgggcagcaaatagacaagcttgttggagcaaacaagccagagttgcagaagaagcttactgctgttttagattcggtggggaatcatgggaaatgacatttgtgaggtttccagtttcaaagacttggcagtatcttcttttctgtctctgtttgtgttgtcgtgagctttggttgaatgtggtgtatttgtaaactgttgtttgttatataagtgtaatatttgc

SEQ ID NO: 3169 - DNA, 430 bp, Gossypium hirsutum
  Clone ID: uC-gsronu33B113d11b1
cccacgcgtccgcccacgcgtccggaacaatgatgggttcgagaatcaaaatctcagctctgggtgttactatgcttctgctgttgattgccccaacttccaacgctgccatttcgtgcagtgttgtgataaaggacctgaggccttgcgtgaactatcttacgaaggggagcggaaaaccaccgtccgcttgttgtgcgggagcctccgctctggcatccgccacctcgtcgtctgccgacaataaggctgcttgtgaatgcatcaaatcagcgtctaagaatattaaacccaataaccagttagctcaggctcttccttctaattgtggaatcactttgcccgtcaccatttcaccaaatgtcgattgttccaaggttggttgagagcttggaagctgaaactgggagtgcttggatgggcatgaagt

SEQ ID NO: 3170 - DNA, 381 bp, Gossypium hirsutum
  Clone ID: uC-gsronu33B113d12b1
gattcttggtaggggtacaaagactacgccgtttttgaaagatgatcagcttgagtacctagaggagcgacgtttggaggattaggttaataagcattctgaatttattagctacccgacttctatttggattgataagaccactgataaggatatttctgatgatgaagatgaggacgataagaaggacgaaaaagggaaagttgatgatgttggtgaggataaagagattgaagaaaagaaaaagaagaagattaaggaggtgtcttacgaggggtctttggtgaacaaacagaagcttatctggatgaggaagcctgaagagatttccaaggaagaatatgctgttttttacatgagccttactaatgactgtgaaag

SEQ ID NO: 3171 - DNA, 419 bp, Gossypium hirsutum
  Clone ID: uC-gsronu33B113e01b1
attttctcgactgaaaatatagaaagattggcaaagagaaatgtgaaaaaaggtgaatttggaatcgttcttcgctgatttgattttaagggaaaccagcatctgaaagacaaattttcaacctctcaggacctctacatctcacttcaattgactggaataactttcatcaccgaagatcggttgctgcaagcttggtccaaggagtgtacattcaagaacgcgatcgccaggagaatcgccgaggtgcccaagctcatgcgtcaccttggtgggatttcttcaatttttaactgatccgtcctctcgtagatgatgttgataactccatttttggtgccatttatgaaaacaagtcttttacttccaattccagccattcagcttaaaatgctccgagctatgttattgcaattcgg

SEQ ID NO: 3172 - DNA, 441 bp, Gossypium hirsutum
  Clone ID: uC-gsronu33B113e03b1
cccacgcgtacgcccacgcgtccgcccacgcgtccgcaaaaccctaattttaactccgcctcagatatccccgtctccacaggcatggctaccaagcagccaaatactggcctctttgtaggactgaacaagggccatgttgtaacaaagaaggagttggtggcatctgatgcggcgctaaaggccctagctgttagggttttgcttaggtgatttgggccattgggtttagtgggttttgggccatattaggccattttaatggactatttgatttattttgattttgggtgttttgctggtatgggcccgggcaaaaatgggctcttacaacttaaatgttaagttatcttggtataacttttttctacatgctttaatatactatgataatggtgtacgtatttttttaagtataaggtaattaaaaataggcttgat

SEQ ID NO: 3173 - DNA, 437 bp, Gossypium hirsutum
  Clone ID: uC-gsronu33B113e04b1
ctttctctattctctttggcttatctatcgctttgatttcgcgtccttactgtgcactcgatggcaaatcgatggttgaggcctgaggtgtatccgctgttcgcggccgtaggtgttgctgtcggaatctgcgggtttcagttggtgcgaaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagcttcttcactgacccaaagtgaggcttcactcttgctttatgctgaaactaaaataaaaaaatagaagaactaagtcttattcaatcaataccaagttttgccctttctttctgctgactgtgatgcaaatttgt

SEQ ID NO: 3174 - DNA, 423 bp, Gossypium hirsutum
  Clone ID: uC-gsronu33B113e06b1
cccacgcgtccgctgaggataaaggtcagtccatccaatcaggagtacaagatcactggattgagcgagcagttgtgcaaagatcagttgttttcattgaagcagaaaagcatgaagaatgataatggtgaagctgagaatctagagattactgtttatgattattttgtcaaccatcgcaacatacagttgcgctattctgcagacctgccatgcattaatgtcggaaagccaaaacggccgacatatattcctttggagctctgttccctggtgtctttgcaacgttacaccaaagcgttaaccactttccagagagcttctttggttgaaaaatcaagacagaagcctcaggaaagaatgacagtcttatccagtgctttacagaggagcaactatggtgctgagccaatgctgcgttct

SEQ ID NO: 3175 - DNA, 425 bp, Gossypium hirsutum
  unsure (1)..(425): unsure at all n locations
  Clone ID: uC-gsronu33B113e07b1
tcgcccacgcgtccgagccattattgaaacaaaagctagagccttgaaggtgacggaagaggttgaaaggctagagtcggtgagccggccggtgaggatgcattggaccggttgcccgaacacgtgtggtcaagttcaagtggcggatataggtttcatggggtgcatggcaagggatgagaatgggaaaccatgtgaaggggcagacatattcttgggagggagaattgggagtgactcgcatttaggagagctttataagaagggtgtcccttgtaagaacttggtacccgtagttgctgacattttggtggaacactttggagctgtccctaggcaaagggaagaagcggaagattgattcaaaatcaacttcatttgattacattacttctatatttgntttattgatttatttttctaat

SEQ ID NO: 3176 - DNA, 437 bp, Gossypium hirsutum
  Clone ID: uC-gsronu33B113e08b1
cccacgcgtccgatcgaaaaacacagaacggtcaaaacgcgatcaacacacagaaaagccccattctgatccacatttgctttaaaatcctctcaaacatcaaaatttgtttgcaaacagaccaaaaaaatccagctatgggcaatacggagaagctgttgaaccagatcatggacctcaaattcacctccaaatcgctgcaacgccaggccaagaagtgcgagaaggaggagaaatctgagaaattgaaggtgaaaaaggcgatcgagaaaggtaacatggacggtgctcggatctacgccgagaacgccatccgtaagcgcactgagcagatgaactacctgcgtctcgcttcccgactcgatgctgtagttgccaggctcgatacccaggctaagatgaccaccatcaacaagtccatgggaaatatcgtcaag

SEQ ID NO: 3177 - DNA, 99 bp, Gossypium hirsutum
  Clone ID: uC-gsronu33B113e11b1
aattaaaaaaaaaaaaaaaaaaaaaaagaaaaaaggaaaaatttaaaaaaaaaatagaaataaaaaaaaaaaaaaagaataattgttttaaaagtaaaa

SEQ ID NO: 3178 - DNA, 420 bp, Gossypium hirsutum
  Clone ID: uC-gsronu33B113e12b1
ggctgtctctctaccacctgttccttcagagaagggtgctttcagccaaatgatactaaaccaaaggctgaaccaaagaaagaagccaaaaaggaggttgagaaacaggcagcaaaggcagaggcagctgaggaggaggaggcaccaaagcccaaaccaaagaatcctcttgatttgctgcctccaagtaagatggtactggatgactggaagaggctttactctaacacaaagaccaattttcgagaggttgcaattaaaggattctgggacatgtatgatcccgagggatactcactgtggttttgtgactacaagtacaatgaggagaatacagtttcatttgtcacaatgaacaaggttggaggattcctgcagagaatggatttggcccgcaagtatgcatttgggaagatgttg

SEQ ID NO: 3179 - DNA, 403 bp, Gossypium hirsutum
  Clone ID: uC-gsronu33B113f01b1
cccacgcgtccgcgtccctgtattggctccccttccaatagggttcgcagtgttcatggttcacttggctaccatccccatcaccggtactggtattaaccctgcaaggagtttcggtgctgctgtaatctacaataacgacaaagcctgggatgaacactggattttctgggttggtccatttgttggagcacttgcagcagctatatatcatcagtacatccttagagcagcagctatcaaagctttgggatccttccgcagcaaccccaccaactaaaaaaaatcaacccaaatagctttgtctccacttcactctttttctattttctccatttgttcgtttgtgtgtatgagaagattattatgaatgatgaatgatgatgaccctttcctttttatc

SEQ ID NO: 3180 - DNA, 415 bp, Gossypium hirsutum
  Clone ID: uC-gsronu33B113f02b1
cccacgcgtccgcccacgcgtccgctcactgctcactctctggaactttcgttcatctccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtcaccgacgtttccctacgcggtgagtccgaagaccccattcttc

SEQ ID NO: 3181 - DNA, 434 bp, Gossypium hirsutum
  Clone ID: uC-gsronu33B113f03b1
ctgatggagaaagatgcttttgaagagctcaagaagttggcagctgcatcttcgaatgagaaatcaagtctgacagtcgaagctgaaccagtcaagaggcctactcaggtttctgatgctgtgaaacatcgtggttttgttgcttatgagcgtgaaggtgttcaatatagagatcctaatgttcggatgcatgactggaaggaggtcatggaggaatcaaaacctggcccacttttaaagacacagtctgctcgctgcatggactgtggtactcctttctgccatcaggagaactctggatgtcctctcggaaacaaaatacctgaattcaatgaactggtttaccaaaataggtggcgtgaagcactagatcgtcttctagagacaaataactttccagagttcactggccgagtgtgccctgcaccatgtga

SEQ ID NO: 3182 - DNA, 438 bp, Gossypium hirsutum
  Clone ID: uC-gsronu33B113f04b1
cccacgcgtccgccctaattagaaacggagctatgctgatgaatcgagtgttagtgaagcaagctctcaactcgaacccgatttctaagaatcgagtcttgaatcaaggcattcaaatcactcctcagctgttcccatctctctcgaagtcaaaacttgaaattccccatttgcctcgaaacgacgtcgattctctctctgaagtctcctctacggggtttctttatccatttggtctcccttctctccgtttcttccttcccgacggagattcatcaagtgagccaatgctattattccccaaaagaacatatcagcctagtaccatcaggcgcaagagaaatcatggatttttcgcccgcaaggcaacgaaaggtggtagaagagtcattgctcgaagaatagcaaagggtcgttcaagaattaccgcttagaatc

SEQ ID NO: 3183 - DNA, 412 bp, Gossypium hirsutum
  Clone ID: uC-gsronu33B113f06b1
ctcaagctccggttgaaatcagggtcaacggtttcgatttcctctcaacaaaaacgaagcttcaaatccagatttctcagttttctcgagaaaatccgtcttcgccgtgagaggaaagggctaacgatccaacactcagatgttaaatcagtactgaatcgagtgaagcagttcgctgacagggtatttgaagtttttgctttgtcttatttttggtcaaactgtggttttaatcccattagtatactcaattttaagatttagtccctataatttgacataatttggctctactgattttcttttttatttggaaaaatgcgctattaataaaagccatagaataattgaaacaaaagggggaaaggaacatttgtttattgatgggctgataatactgtgaaatttttta

SEQ ID NO: 3184 - DNA, 68 bp, Gossypium hirsutum
  Clone ID: uC-gsronu33B113f07b1
cccacgcgtccgcccacgcgtccgaaggattgtaaatgatgtgtggaagaatatatagtatttgcctt

SEQ ID NO: 3185 - DNA, 439 bp, Gossypium hirsutum
  Clone ID: uC-gsronu33B113f08b1
gttttgagggtttattcatttgcagccatgaaattcagaagcttttgtttttgcatcccaggatcaaagcaagaagattcagacagttcttctaacaaagcaaaatcccataaaaagtctgacaaaagtgggaaaaaggaagggaatgtggatgatgctgattatcagggtgccactactactactacgacagccagcagtgatgctggaatggctgctgctgtagcagtgggtgccactacagcacatgcctccgctgtggaatgaagtggttgcgatggttgtcatgcaggtggtggtgttggcggctgatagccggacactatttcaaaaaagctggttcagtttttggcctttggcattcttcatcatattgatttcagaatctttctttcatcttgcatgaaagttgcttgcttttttcatctttatatttttg

SEQ ID NO: 3186 - DNA, 433 bp, Gossypium hirsutum
  Clone ID: uC-gsronu33B113f10b1
gccgattcttcttaagtgggggtttatactggaagatcaagttcataagccgtctacaatacctatgggaggacataaagaagggagaggttgagatccctgaatttgtgcaaaaccatgacgatgttcttgagcaccggcccttaacagattatggtattgagccagatcctctccacttaacagaggtacctaacactgcttactcattagggaggtatgaagagagattaacctcaagggaattcatgtcatagtttcgatattaaacacacagctgaacccagtaaaagggtttgcaggctctggccagtaggaattatcaggtaaaacaagaaataagattgtctatagtagtctttatattgcgtgccttgaattgtgagaaatcgctacgctgtacttgtagttaattaaatttggtgtgttatgg

SEQ ID NO: 3187 - DNA, 435 bp, Gossypium hirsutum
  Clone ID: uC-gsronu33B113f11b1
cccacgcgtccgcccacgcgtccgcgaaaaagagcttgggtcatctctcaccagccgcaaccatggtgaacgtacctaagacgaagaagacttattgcaagagcaaggagtgcaggaagcacactttgcacaaggttacacagtataagaagggtaaggatagtttggctgctcaagggaagcgacgttacgatcgcaaacaatcaggttatggtggtcagaccaaaccagtcttccacaagaaggcaaagaccaccaagaagattgtgctacggctgcaatgccagggttgcaagcatgtctcacagcatccgatcaagaggtgcaagcactttgaaattggtggagacaagaaggggaaaggaacatctcttttctagatgtgatgatattcatgtcaaattttatgttatgggtttttacttggaacttcag

SEQ ID NO: 3188 - DNA, 433 bp, Gossypium hirsutum
  Clone ID: uC-gsronu33B113f12b1
cccacgcgtccgataaatcaaagatttggaagctcaccgaaatcagtgaatcttctcagtgtcgatccttgaggcttcctgaaaacttaagggtgaccaagatatcaagattaatcttcacaaattccggtaatgctatcctggcgttagcatcaaatgctattcacttgctttggaaatggcagcgaagtgatcgtaattcaaatggcaaggcgactgccagtgtatcacctcagttgtggcaaccatcaagtggcattcttatgacaaacgatgttgctgatacaaatccagaagaggctgttccttgttttgctttatctaagaatgattcttatgtaatgtcagcatctggaggaaagatttccttgtttaatatgatgacatttaagacaatggcaactttcatgccaccgccacctgccgcgacttt

SEQ ID NO: 3189 - DNA, 441 bp, Gossypium hirsutum
  Clone ID: uC-gsronu33B113g03b1
cccacgcgttctatttcatatagcatatagaaggaaattgatttcatatagaaagtatagatagattactatgtatcgactgaaccaatgactattcatgattccataattggatcaatgctccaaactagaggaatgttatggtaaaacttcgtttgaaacgatgtggtagaaagcaacgtgcgacttgaaggacatgatcagctgtggatgtcaaaacccaccactttccgttatgtagaaatgaaggtgctttttgctcgacatcctttgttctattataatccgtctttttgatgggttgtaatgtaaatagtacaggatggagctcgaagagaaacatccatttttcaggggcaaggatctagggttaggtaatggaaatcaataagttggaacaacttcgtaagtctatttgtgatatagaaatcgaaaggatcc

SEQ ID NO: 3190 - DNA, 426 bp, Gossypium hirsutum
  Clone ID: uC-gsronu33B113g04b1
cagaaaccctcgttattaatcggcggaagcagatagcctctagccatgactttcaagcgtaggaatggtggccgcaacaagcatggccgtggccatgtcaaattcatccgctgttctaactgtggcaaatgctgccccaaggataagtcaattaagaggtttcttgtgaggaacattgtggaacaagctgctgttagagatgtccaagaagcctgcgtttatgacacttatactttgcctaagctgtatgttaagatgcaatactgtgtctcgtgtgcgatccactcccacgttgtgagagtccgatcccgcaccgataggaggaaacgtgatccacccgcccgcttcatcagacgcagggatgatatgccaaagcctggtcagcctggtcaagcaccacgtccaggtgttgcagttcctgctcgt

SEQ ID NO: 3191 - DNA, 439 bp, Gossypium hirsutum
  Clone ID: uC-gsronu33B113g05b1
cttgcattaagtctcaaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgc

SEQ ID NO: 3192 - DNA, 425 bp, Gossypium hirsutum
  unsure (1)..(425): unsure at all n locations
  Clone ID: uC-gsronu33B113g07b1
cccacgcgtccggttcaccacaatgggggaacaagaccattttaacaggaaaaaaccatttcggagacctggtcgtgttcgacgaccccattaccttagacaacaacttgcattcgaaaccagtgggtcgagcccaagggttttatatctacgacaagaaagacatattcacagcttggttgggtttctccttcgttttcaattctacccaaaataaaggaagtataaacttcgccggtgctgatccgttgatgaaccagacgagggatatatcagtgattggtggaacaggtgatttcttaatggctcgaggagtggctactttgatgactgatgcctttgaaggggaagtatattttcgtcttcgaactgatattaatttgtatgaatgttggtaaaccattngaaatttaattttcgatttg

SEQ ID NO: 3193 - DNA, 442 bp, Gossypium hirsutum
  Clone ID: uC-gsronu33B113g08b1
tgattaaatatcctctatggtcctcatgaagatgaatgagatcgccgaggcatatctcgggtccaccatcaaaaacgccgtcgacactgtaccagtttacttcaatgattcccagcgtcaagccacgaaagacgctggtgttattgctggcctcaatgtcatgcgtataatcaacgagccaactgctgctgccattgcctacggacttgacaaaaaggcaggaagttctggagaaaagaatgttcttatttttgaccttggaggtgggactttcgatgtctcattgttgacaattgaagaaggaatcttcgaagtgaaagctactgctggagatacccatttgggaggtgaagattttgataatagaatggtgaatcattttgtgcaggagtttaagaggaagaacaaaaaggatattagcgggaacccaagagctttgaga

SEQ ID NO: 3194 - DNA, 430 bp, Gossypium hirsutum
  Clone ID: uC-gsronu33B113g10b1
gccaatcagatcctccgagatcaattttcttgtgctgtatccactgctcttgaagatgtagacactgcaaacaacagttgcctaacatccattgattattcattacaacttgatcgtgatgcatgtgggaacatgaattcgatgattattccttgttgtgaggaattgagggaactgaagggtggtcactaccacaagattgtagaaatcacagacaatgcagggaaatgtctggaggaggaatacatggtggacaagccatcgtgttcaacaccaacgaagagggcattcaacctaccaagcatgtcatcaatagaggaactgaaaacgcctccattcgaggaactattaaagttgttttgggaagcaaaatcagcgaaagtagccaatggagatataaaacacatgttgggggaatatgaagcagcat

SEQ ID NO: 3195 - DNA, 429 bp, Gossypium hirsutum
  Clone ID: uC-gsronu33B113g11b1
cccacgcgtccgctttttatttcctttgttcgacttttctctgtttgcttccgtcacaactcaaaaaccgtacacaaaatgggcaaggatctgagcgacgagcaagtctcatcaatgaaggaggctttcactctcttcgacaccgacggtgacggcaagatcgctccatcggagctagggatcctaatgaggtctctcggcggtaaccccacccaagctcaactcaaagctattatcgctgaagagaagctcacggcgccctttgacttccctcgtttttttgatctcatgtccaagcatatgaaacctgagcccttcgataggcagctacgcgatgctttcaaggttctggataaggacaatactggctttgtctccgttgcagatctgagacatatactgactagcatcggagagaagctggagccc

SEQ ID NO: 3196 - DNA, 436 bp, Gossypium hirsutum
  Clone ID: uC-gsronu33B113g12b1
tcgaaatgaaaaaatacagtgaaaatggcagcccttaaggttccatgctcatgtacctgccccttctgaggatgctgagcaacttcgtaaagcttttgaaggatggggtacaaatgagcaattgattatcgacatattggctcacaggaatgcagctcagcgcaatttgattcgtaaaacttatcgtgaagcttatggggaagatctccttaagtctttggatgaggaactttcaagtgactttgagcgagctgtggtgctgtttactttggaccctgcagagcgtgatgcatttctggctcatgaagctacaaagaggttcacatcaagccattgggttctcatggaaattgcttgcactaggtcttcacatgaactgttcaatgtgaggaaggcgtatcacgatctttacaagaaatcccttgaagaagatgtt

SEQ ID NO: 3197 - DNA, 348 bp, Gossypium hirsutum
  Clone ID: uC-gsronu33B113h01b1
aaattgtgaaggagaactttgactttaggcctggtgtgatcaccatcaacctggacctcaagagaggtggcaatagtcggttcttgaagacagctgcttacggacactttggaagggacgacccagacttcacctgggaagctgtgaagcccctcaagtgggacaagccccaatcttaagttcagctctgctgcctgtctcagtgcctgcttattcatagtactgaataatattgccttgctgctcacctatactctctattttcatccccaagaatgttctaaatctcattcatatagggggccctaacaattacccttttttcttcccttgaattttttttttttt

SEQ ID NO: 3198 - DNA, 134 bp, Gossypium hirsutum
  Clone ID: uC-gsronu33B113h02b1
tctatccttcggactgttaaaccttaccgaaggcccagggtcaatttaaaagctgaatcggtttcaaccgctggtgaaactcattgtccttaccctggatcccactctttatcatgatggaatgttccataacc

SEQ ID NO: 3199 - DNA, 251 bp, Gossypium hirsutum
  Clone ID: uC-gsronu33B113h03b1
tgtgcggtcttttggcatactaagcgtgatgaaagggcgaggaaggctttagcaggggtggcagcctgaaccccgttagaaccggtcctttaacagtgccgaaggtgatctatgagcaaggagtagaggctttgcccatagcattaaagacttgccccataacaagggtagagacctcgtagctcacgcatctaatgaatactactaacagttcgaagagagacttgataccgagacttaggatcgaaact

SEQ ID NO: 3200 - DNA, 438 bp, Gossypium hirsutum
  Clone ID: uC-gsronu33B113h04b1
caaaactaaatgtccagaattagggtttcgataacgctaacggcagcatagcccctacaactccgacatcatttgggtccctttgtccttcaattagatcacagcttttcgttcaaaaatatattctcttgttattggtcttaatttcaagcaacaatggcggagcacttggcctcaatctttggtacggagaaggaccgcgtgaattgccccttctatttcaagattggagcatgccggcacggggacaggtgttcacggctccacaaccggccgacgatctctccgactctcctcctttccaacatgtaccagcgcccggacatgatcactcccggagtggatgcccagggccagcccatcgatccccgcaagatccaggagcacttcgaggacttctacgaggacatcttcgaggagctcagcaagtttggtgag

SEQ ID NO: 3201 - DNA, 326 bp, Gossypium hirsutum
  Clone ID: uC-gsronu33B113h05b1
gcatagaaaataagttatttagttttcaaaaaagagcactgggtcatgtttatggggtaattggccaatcatagtaatgtgtctgtgttcatacagttatttgcttttcaatcgagcactcaagcttggtgtcttttaccattttcaaattgggttaaatttagggactggattggatatttgcctatatatatatttatatattcgaatttatatatttttatatgctctaatctttgcaaaaggaaaaacccaataccaaagggtgaaaaacaatcatgttaattaatccaaaacctttttgtggagagtttggatataaagct

SEQ ID NO: 3202 - DNA, 124 bp, Gossypium hirsutum
  Clone ID: uC-gsronu33B113h07b1
gaattttgaacagcggccgctcaaagcttaccgatgccccaggtcttattttcatgctgactcgatttcaaccattgtctaactacattgacctaaccatgatccacctctcccccaagagaca

SEQ ID NO: 3203 - DNA, 453 bp, Gossypium hirsutum
  Clone ID: uC-gsronu33B113h08b1
tcggtctattggagttatgtgcatgatggaagagctaggaaggcttaggaagtagtggaagcagtaaaccctgataagaatttggtcactttcagagtgatcgaaggtgatctaatggaagagtataagagctttgtaatcacgattcaagtttcgcccaagagcgagggtagtggcagcttagtgcactggactttggaatacgagaagctgcacgatgggattgcgcatcccgagactctgctgcaattcgttcaagatgtctctaaagacattgacgcccacctcacccaagcaagctaaacagtatcacatgttgctattgttaccgctacttcaagcactattcatctatttaatgaataaagtgacaacttcctttctcatgtattttgatctgaatatgtatgtttagatcaatatgcagtcaaggggagggagctttgtattttc

SEQ ID NO: 3204 - DNA, 426 bp, Gossypium hirsutum
  Clone ID: uC-gsronu33B113h10b1
cagcacgctaccactatttatctccatcatgcaatgtctgattttgctgaagctttagcttccaaaatgcctggaaatctcaaggttgtatatttcgtgaattctgggagtgaggcaaatgagttagcaatgctgatggccagactgtactctggtaatcttggtatgatttccttgagaaatgcttatcatggtggaagttctagtactattggactcactgcactgaacacatggaagtacccaataccagagggtgaaatccatcatgttattaatccagatccttttcgtggagtgtttggctctgatgctactcgttatgccaaagatgtacaagatcacattgagtatggtacttcaggaaaagttgctgggttaatagcagaaaccattcagggagttggaggagcagttgaactagcc

SEQ ID NO: 3205 - DNA, 434 bp, Gossypium hirsutum
  Clone ID: uC-gsronu33B113h12b1
tcgaatgaattgagaagggtggaacacgttgaccatgctcggaaatcagctgaacaggcggtaaaggctatcaaggcaagtggggaagggaaatcagttgacgaatatgactacctaccgtacttctattcacgttcctttgatctatcatggcaattctatggtgacaatgtaggagatacagtacttttcggagacagcaacccgaaatcaccaaaggcgaagttcggatcttactggatcaaagatgggaaggtggttggagctttcttagaaggcggcactgccaaagaaaaccaagctattgcaaaagtggctaagcttcagccttcagttcagagtttggaagctgtgaaacatgaaggtctttcttttgcctgtaagatctgatggattcacatacctgccatgcggttccaacacaactggctttt

SEQ ID NO: 3206 - DNA, 462 bp, Gossypium hirsutum
  Clone ID: uC-gsronu33B114a03b1
ctctcccttcagatatcttcattttcatcttcttggctgggtctttctgaactttgttttcttcaaaaactgccctttcattttgcttagttcttgttaaaaagaaaatgtgtgggattttagctgttttgggctgttctgatgattctcaggcaaaaagggttcgagtgctggaactttcccgcaggctgaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgtgatgttattgcccatctgtatgaggagtatggtgaagactttgtggacatgttggatg

SEQ ID NO: 3207 - DNA, 471 bp, Gossypium hirsutum
  Clone ID: uC-gsronu33B114a04b1
gttccgctgctttagagttctggtccgctcaacagtctgccttctctctaaatctaatactcagatccgcgagtaatttttgtcacagctcgttagaatggagacctttctattcacatctgaatcagtgaacgagggtcacccggacaagctctgcgaccagatctctgatgctgtgctggacgcttgccttgcccaggaccccgacagcaaggttgcctgtgaaacatgcaccaagaccaacatggtcatggtctttggagagattaccaccaaagccaatgtagactatgagaagattgtccgtgacacatgccgctctatcggatttgtttctgatgatgtgggtcttgatgctgacaactgcaaggtcctggtcaatattgagcaacagagccctgatattgcccagggtgtccatggccacttcaccaagcgcccagaagaaattggagctggtgaccagggcca

SEQ ID NO: 3208 - DNA, 458 bp, Gossypium hirsutum
  Clone ID: uC-gsronu33B114a06b1
tcgtttatgaattgacggacctggatttgtagcactgaagtgttcccatgaaaatccatcgaaatctcgcgaaattcaacgggataaaaatagaaaatgataagtacttaaaatcatgaaattaaacttgaaatacatagaaatgataattatttgatatactgaaatatgacatggaaaatacatgtatgtgaaacttgcctgataattatgcatattcaagattatgaactactactcaaataaatataccttgaacttatagaaaattatggtacatgaaatattgtcataatgaattgaatgattcatatttaagacgaaacaaaaagaaaatgatatgtaccatgacatgtaaatatgaaactatatttgatacgttgatacaaggaaaattatgtgtattaagacgagtaataaatttaagagagacatggcgagaaaaataatttgtcaat

SEQ ID NO: 3209 - DNA, 462 bp, Gossypium hirsutum
  Clone ID: uC-gsronu33B114a07b1
tcattccgagttgagtcccggatttttaccatgcaggatgttttggatctgttttctttttcaggtctgaaaatgcgttaatcgaaccatcaatggtgatttctggggatggtagtagtaggtccaaatcgactatgtgggggtggttgttggtgggaattggatcacttgtattgctcggatttctcttcaccgctttcatctcccatcttcttccgccctcaaattatactctgattgctgccatccaaaatgacaggtattactgcttcttggtacccttaacacttcctgtacttgtggttgctgtatatttccattggcttagcatgaaattattcaggcatgcatgacttctgtagcatcaaccaatgtattcaataaacaaagaaatgatatttggaaatgagaggaaaactgaattagctgctttgtagtggctattttgaacatatgattaat

SEQ ID NO: 3210 - DNA, 457 bp, Gossypium hirsutum
  Clone ID: uC-gsronu33B114a09b1
tttgttaggcaaagacaagaatttcgcagaaggaagggtttattcaaaatttggggtaaagctccatcaaagattgaagccacctacacaacaacattcggggaaaccaaaaccagtcttcttttaacatcaggatggtggggtttggctcgtcatttccattacgtgccaaaaatattagctgcattcttttggactgttccggctttattcaaccattttctgccatacttctacgtaatgtttcttaccatcctcttattcgaccgagccaagagggatgatgaccggcgccggtccaaatatggtaagtactggaaactatactgcaacaaggttccctataagatcattcccggaatttactgagagatggatgtttggggaatccagtgcaccgactgcattttgttagcaatgtgctttgtaacatcatctcctttacaaatagccaacg

SEQ ID NO: 3211 - DNA, 447 bp, Gossypium hirsutum
  Clone ID: uC-gsronu33B114a11b1
tgatctccggtttcgacgcgggttgttcagtggcagggtctgttgaagaaaatgatgaatcaactacaagatctggagaaacagctgttggacgacgataacgacgaaggagacgctgtttctgttattaccaataccaacagtgagtggtctgaaacgatacaaaacttgatcggttcaaccggtagccctaacaacccgattgccccatcacctacatcaaccacttcatcgtgctcgtccacgtcatcgacggcttctccagcttcaccttgttcaaagcagacaatattggatgccgcagctgctatttccgagggaaaaaacgacgtcgttaacgagatcctgacccgattagctcaagctgctaactcaaaaggtagctcagaacagaggttgatggagtgcatgctatcagctcttaatctagggttactcgggtgaaac

SEQ ID NO: 3212 - DNA, 459 bp, Gossypium hirsutum
  unsure (1)..(459): unsure at all n locations
  Clone ID: uC-gsronu33B114a12b1
tctcgttttgaactgacggacctggatttgtgcgctgatagtgtttcaaatgaaatttcgggttaacacgcgaaaacaacgggataaaaatttgacagtatgccctaaaatcatgaaataaaacctgccaccatagaaatgataattatttgatctactgaaatatgacatggaaaatacatgtctgtgaaacttgcctgataattatgcatattcaagattatgaactactactcaaataaatataccttggacctatagaaaaatcatggtcacgatctntccggcataaatgaattggaatgaattatatctaagaagaaaccaaaaagaaaatgatttggttccctgacatggaaatatgaaactatatttgatacgttgatacaaggaaaattatgtggattaagaccagggataaatttaagagagacatggcgagaaaaaaaattggcaata

SEQ ID NO: 3213 - DNA, 95 bp, Gossypium hirsutum
  Clone ID: uC-gsronu33B114b01b1
ccctcgcgtccgcttccagctatcaaggagacgaggactttctagaacaaacataactaaaaaaaaaaaaaaattaggaataccaatcgcctact

SEQ ID NO: 3214 - DNA, 60 bp, Gossypium hirsutum
  Clone ID: uC-gsronu33B114b05b1
aatttattctagagatatatgcttgtatttagttatcagtgaaggtttcttttttatctc

SEQ ID NO: 3215 - DNA, 376 bp, Gossypium hirsutum
  Clone ID: uC-gsronu33B114b07b1
tccctcgcgtccgcccacgcgtccgagagaaagaaggtttgtactgaaacaaaagttgcagtgggggaatgccaattttagcgaaagcatgcattcatttatatgtttaatcaaagcaaaggacaagcagtggaaatcaaagtcatgcgactgattaggcctttgttacagtgaatctttgtatctcattagaatcacaaaaattgttctttgtagatatagagggttaagcatcataggattcatttcatgctcggttgcatgtatcagaggtattttttgttttaatccactattcttcacactatttatttacgtatttttggctgtataaatgttgaatataaataaatcaaatagaccacttattatactc

SEQ ID NO: 3216 - DNA, 458 bp, Gossypium hirsutum
  Clone ID: uC-gsronu33B114b08b1
tgtttccctgaaattttagaatggttccaagtgtgggaaaagcattatttttgtttttaacatgattgaagttaagaatcagagtacacctgttactctagagttatataatggaagtacaatttgcttatgatacagagtataaacatctatggacaaggttaaatcatgaattgatataatttcaattgatttttttccttctgtatgttcaagtttatgcaattaccgcttgtcaaatggtatcagttcccattcttttcaagcaatatgagtaattttaaggtttgatagtaataaattctgaggtatcagacttttttgtttgtggttaaagtggactgccaagttgttgatgccattcttctgttatactttgttgactcggtcaccatgttatataacattgttgcagctctgcagagacattatgcagtattgcaggctctagctttagc

SEQ ID NO: 3217 - DNA, 457 bp, Gossypium hirsutum
  Clone ID: uC-gsronu33B114b09b1
tcctcgcgtccgcaagggtcgcaaagagagagggacagtgaagtttctttttgtgttttttcagtatcgttgaagatggcgagtttgcaattgaggcgagagagtagcatggatcagcaagagagtccgaggagtccagaggcaaagcttgggatgaaagtggaggatctatggggtgttcaagaaccaaagcttagtcctaatgaaaagctcaacgcttgctttgagagcattcctgtctctgctttccctcttgctcctcaagggattgagataaaatcggatgctagtttagcagaggctgttcaaatactggctcaaaacaagattcttagcgcaccagttgttgatgttaatgcccctgaggatgcaacctggattgacagatacattggcattgtagagttcgctggaattgctatatggattttgcaacagtcagaaccaccttcaccta

SEQ ID NO: 3218 - DNA, 465 bp, Gossypium hirsutum
  Clone ID: uC-gsronu33B114b10b1
ttttgtttcttcccctcttttacttaatttctctggggcatgtctctctccgtcttgaaatccgccgccggccgtgagtacaaggtcaaagacatgtctcaggctgacttcggtcgtctcgagatcgagttagctgaggttgaaatgcctggtttaatggcttgtagaaccgagttcggccctgcccaacctttcaaaggagccaaaattactggttctcttcacatgaccatccaaaccgccgttcttattgaaacccttaccgccctcggagctgaagtccgttggtgctcttgcaacattttctctacccaagaccacgctgccgctgccatcgctcgtgactccgccgctgttttcgcttggaaaggggagaccctccaggaatactggtggtgtactgagagagcccttgattggggtcctacctggtgacctgatctgatcgtcgatgatggtggtgat

SEQ ID NO: 3219 - DNA, 466 bp, Gossypium hirsutum
  Clone ID: uC-gsronu33B114b11b1
tgatatctgcagttgttaaagagttagaagacttgaagaaggttgttatgaaaggtgaaaatgaaggagaaataaaaaagggaacatttgatcccgaaaagcatattgatgcctacttgccggttcgagttaacgaacagagagtgagcaatcttttgcagtcactcctagttgctgcatcagtatgcgctatgcctgcaatcaagttgatacctacatcggttctttggggatatttctcgtacatggccattgatagtcttcccggtaatcagttctgggaaaggatgttacttctcttcatcacacctacccggcgatacaaggtgttggaacatgttcatgcttcattcgtggagtcagtaccgtaccgatttatggcaatgtttacactcttccagttcatatatctcctcatatgctttggtgtaacatggattcctatagctggaatcttgtttccatt

SEQ ID NO: 3220 - DNA, 261 bp, Gossypium hirsutum
  Clone ID: uC-gsronu33B114c01b1
ccctctcttccgcccacgcgtccggggaaagattggggtgtttggtcgagcaagggcctcgcggcgccgcggggttggggaccgggacggtggtggcggctgcggccgtgattgccgaggcccctttgtcggctcctgctgacccacctgcctctccctgcccctcctttgccttcttccatcccttttcacttgcttccccttttggcctattctatggcctgtccgacctttgctttttcagactccacttacccccca

SEQ ID NO: 3221 - DNA, 454 bp, Gossypium hirsutum
  Clone ID: uC-gsronu33B114c03b1
ccctcgcttccgaatccctctctttccttcaagttgccaacataccaggaaattaaatatgtcctaatataaacatcgaatggacacgcaaaagagtcaacccgacgagcaaaagagtcaacccgacaaacaatcgtcgtctgctgctgctcccctagtctcgacttcgtgtaggaagaaaaagaacgaagaggccaccttccttgaagacttgaaggatcacatcgatgagttcattaatgcttcaatggaagagcacaaaacttgctttaagaagaccatccagaagatgtttgggatgtcgaaagttgtagcagaaaggagtgcggctgaatccaaggaagctgaaaccgtgtcgaaataagattatcttcttacctctttagtaatgtgacttgtggactacatttatatgcattgaggttgcactgaaatgtagcttttggtttggtct

SEQ ID NO: 3222 - DNA, 423 bp, Gossypium hirsutum
  Clone ID: uC-gsronu33B114c04b1
ctttgatcctattgctgctgttggtattgagactgggacaatgcttgatggcatattgtttgtcaatatttcgattgccaaaaatgacaaggttgctgagtcatatagggagaccacatggaagcctaagtttgaggttgagaaagaaaaacagatggctgaggatgagtccactgattcagatggactttcaggcgtccagaagaaggtctttgatgtcctttacaaggttgctgatattcctttcttaagtgaatacaagcttcaaatccttgatctcattgagaaggctgagaaacagccaaacatcaccattggtgtcatcgtctccattttggtgattatccttacagttctcttcagacttcttttcggtggcaagaagcaaccaaaagtagagaagaatccggaggttgctgagac

SEQ ID NO: 3223 - DNA, 459 bp, Gossypium hirsutum
  Clone ID: uC-gsronu33B114c06b1
ccctcgcttccgaaaatggggcaggctcttgggtgtatgcatgtgttgcagtcaactgtagctataacagaagcatttgggaagtttgatgatgtgcttcagcctggttgtcattgtttgccgtggtgtttcgggaaacaggcagccggtactctctccttgcgtgtgcagcaactggatgttcgatgtgaaacaaaaaccaaggataacgtgtttgttaacgtgggtgcttcaattcaataccgagccttagctgaaaaggcacaagatgctttctataaactcagcaacactagagcccagattcaatcctatgtctttgatgttattagggcacgtgttccgaagttggagctggatgcagtatttgaacagaagaatgatatagcgagagctgtggaaggggaacttgaaaaggccatgtcacattatgggtacgagattgttcagactcttatt

SEQ ID NO: 3224 - DNA, 462 bp, Gossypium hirsutum
  Clone ID: uC-gsronu33B114c07b1
tccctcgcgtccggttgggagattgattagtggagctgtttctcagcggcttacatgccgatcggtcgccccttccgagttaatttctcgtcgcctcatgttctcttcctcaagaacgccgtccttgctggctgtcggaaacccaagctccgtcctttcctccaattctgagtctttagcatctttgccatctctcaagtggaaccattttataggccaaaggagaagcatgtttattcaaactcaatcaacacccaatccttcgtctttgatgttttatccagggaaagcggtgatggaagtcgggagtgctgatttcccaaatgcccgttctgcaatgacttcaccattggccaaggccttgtatggaattgacggtatcactcgagttttctttggatctgattttatcactgtaacaaagtctgatgatgcttcttgggatctcctcaagccagaaat

SEQ ID NO: 3225 - DNA, 464 bp, Gossypium hirsutum
  Clone ID: uC-gsronu33B114c08b1
taattgagaaggctatggaagatcgattaatggggggctttattataacccttttggttttagcattaactgtggtcgttggctttctctttttccctcttggttttcagaaaacgcagacaccaaaaatagatagtaaaaaaaagtactttgcactttgaatttgataattgagagtcgtgaattctcctttttttacttgggttctttcactatcaaatcaaatcttaccctaaatgaggctaacacctgacacttaaaattacaaaactgtgttttttcttttcaaaagaaaaaacaatccaaattcaatgcatttgtacataaatgaaaactgagagacaagtggatgaataaacatcgttcaactttactctctttttaattcatgtttcccgcataaaatgacaaaaaagttaccgcttgaaatatgggcattatattgttgcaaatactaaggaaaa

SEQ ID NO: 3226 - DNA, 382 bp, Gossypium hirsutum
  Clone ID: uC-gsronu33B114c09b1
tccctcgcgtccgacactgctttcactcttggggggctttaccgtgatgttcatggtatcgatgtgtttgatcccaaattcaacattgtttcccctggtgctgatatggagatatacttcccttacaccgaagagaagcggaggttgaagcatttccatactgtgatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatctggaag

SEQ ID NO: 3227 - DNA, 452 bp, Gossypium hirsutum
  Clone ID: uC-gsronu33B114c10b1
cccacgcgtccgatttcacagccggaaacggaaggggaggttaatcgatatactgatctaagttcgccgacgagaacttcatcaagaagcacaccggacccggcatactatccatggcgaacgccggtcccggaacgaatggatctcagttctttatttgtaccgctaagaccgagtggcttgatgggatgcatgtggtgtttggtcaagttgttgaaggtatggatgtggttaaagccattgaaaaagttgggtctagcagtggaagaactgctaagcctgtcgttattgcagattgtggacagctttgttaagaacaagaacaagaacaagaaatggaataatgttgactctggtctatgaatggtgattcatgtctgaaatttatcatttttatgtgtttttctttgctgtttactggatttggcttagattgttctctaagaacatga

SEQ ID NO: 3228 - DNA, 447 bp, Gossypium hirsutum
  Clone ID: uC-gsronu33B114d04b1
cttttcttacgggcatgtgagagggatgcatctggatgtcttcttttgaagggtgcctctttcccagtctccaaaccattttggccaatgatgtgactgagttcttgccttatgcattccagctgttggctcagcttgttgagctgaacaaaccacccatttctccaagttacatgcagatttttgtacttctcctctcccctgattcatggaggagatcttcgaatgttccggcccttgtgcgtctgcttcaggctttccttcagaaggcacccaatgaggtcaatcaggaggggagactgaatcaggtgctgggtattttcaacatgcttgtctcatctgctagctcagatgaacagggcttctatatcttgaacactgtgattgagaatcttgagtatggtgtcatatctccatatatgggtaatatttggaatgtcctcttta

SEQ ID NO: 3229 - DNA, 457 bp, Gossypium hirsutum
  unsure (1)..(457): unsure at all n locations
  Clone ID: uC-gsronu33B114d05b1
gccttgtttnttcctacaaaaacgtaggagttgagggatggttttgttaaaattaaagttcctattggcgatctcctttggtcgacaatcgacaatccccacccagcagctaacttcttgtttttatttttgttcttcagtctgaaaatcagtgagagatcgaagagatggcctttttccttggacaaagtagccttgcgaaccacttccgatcttatcagaaggcagaggcttccatggctgtgccaacacgagcatttcatgttgaacttggggatcgtgagaaagctctcttggcaaaggacccttcgttaagtcgttttaaatcttataagaagagtgtgtcgacactgaagagaattggggatgttcttacagttgttgttgtagcaggttgttgctatgaaatttatgtcaaggcagtaatgccagaagaagctaggaacaaggcaaaggg

SEQ ID NO: 3230 - DNA, 456 bp, Gossypium hirsutum
  Clone ID: uC-gsronu33B114d06b1
atctagttgtgggttctaagaagggccttcgatgacgaggaacatccctatctgccaaagcatatcctctacagacaaaaagaacagttcagtgatggtgtcggttatagttggatcgatggtctcaaggcccatgctgcccgacatgtgaccgataagatgatgttcaatgcttctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgcttgggggttcatctctctgcttatgacgcagagactcccctcagcaacaagccatccaggttattgatagtataccacggatggactt

SEQ ID NO: 3231 - DNA, 297 bp, Gossypium hirsutum
  Clone ID: uC-gsronu33B114d07b1
ttctctttctggctagggcttcatatacccagggtcgacttcgatcgactgttgctttaccaccgcattcagtggccggcgatgcgccaaaatgggcctttagcctcgtcttgaaacaccctagagaaaccagccctcaaaacccgaaaaaaaagagttgaatagagatggttctcaaccccttcggggttcgattttgacaacggaggtggaccctccggcgttgcaaccgtggggaaccggtgagtctcttcttctccctttttgtttatgtttctatttaaaatcgtttttgat

SEQ ID NO: 3232 - DNA, 459 bp, Gossypium hirsutum
  Clone ID: uC-gsronu33B114d09b1
ttggtaatggacgggccgaatcggaaccacgggtgcgattaggtcttggaggagctgcaatcagatgcgaaggaaatggcagagaagattctagaatatagagctactattccagatcagcttaagacgactctcgattcaattctttccgctcaaagacccgatttgcccggcattgatgatgggtcggatcctggaccttcagcacaaaataatgcagattcaaaagagatgaaatcagatgacgaacaaagggcggaagagaagatacgatcacttaaaggcaaaatttcgagtaacatttcagcaatgccggttgttttgaaacggatgaaagtttgcatttccaggattgagaagctagagtcttgcaatggcattatacaccctgctttgaaaaagagaaaattagttgatccaatgaagctttattttcataattgacgaaatctagatttc

SEQ ID NO: 3233 - DNA, 99 bp, Gossypium hirsutum
  Clone ID: uC-gsronu33B114d10b1
ttggttgagcttagcttagcatctcacttcaggtctgctgttatactgggttttctttataaatagatgaaatgaacagcgtagttgtaatggtttatt

SEQ ID NO: 3234 - DNA, 441 bp, Gossypium hirsutum
  Clone ID: uC-gsronu33B114d12b1
tctctttgcgtccgtggacgcgtgggtctgtgctggggatcctttgacgggatcttgggttttcagaccgtccgcggagtattcattggttaggcatctatttgtagttggttctaggggctagagatatgaattgggcccaacgcaagatctatctctacaatgacacatttggactctacatgttggattggtgggagcgataccttttcaacacactggatattgagttgatgtggttcatcttttacaacagctggcgatatgtcacggagttttacaagaggcatgtatactagggatgctaggcgataggggtgatggaagtgtgaaatacttttgaattaccgggctgaaaagcttgcttatatgtgggtttgacataccccattgtgagcatgtttcacatatattgttggactgttttcaaagctattcctt

SEQ ID NO: 3235 - DNA, 192 bp, Gossypium hirsutum
  Clone ID: uC-gsronu33B114e01b1
gttctagcaggaattggggggggggggacatttggcatggtctatctgttctctgtaatgggtggttcctgggtcccaactcccaagcaggtcgcttaaatttagtgtttctgcttgtatgtttttattagaagaggcagtttgcatgttgtcttttacaagtaataataataaatcatagtgcatttgttt

SEQ ID NO: 3236 - DNA, 472 bp, Gossypium hirsutum
  Clone ID: uC-gsronu33B114e02b1
gcctctttctccaacatggctagagggttgaagagacacttgtagaggctcaatgcccccaggcattggatgctcgacaagcttggtggtgcattcgcgcccaagccatcgtctggaccccacaagtcgagggaatgtttgccacttattcttattctgcgaaacagactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtcttctttatgacactaaaggtcgtttccgccttcatgccatcactggtgatgagactaagtttaagctctgcaaagttaggtctgtccaatttggccagaagggtattccatacctgaatacctacgatggacgcacaatccgttacccagaccctt

SEQ ID NO: 3237 - DNA, 432 bp, Gossypium hirsutum
  Clone ID: uC-gsronu33B114e03b1
ctcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggttttatctgttgttaaaatcttataaaaatatatatcgattgctgctcttggtttgtatc

SEQ ID NO: 3238 - DNA, 467 bp, Gossypium hirsutum
  Clone ID: uC-gsronu33B114e08b1
ttcctcgcgtccggaagaagacaaggaatttgtcaagatctgcatgagttccataaagaaaggagacaaagggatggatctgctccaagaaatcctgcaacatctccgagatctgagagccgtcgaactccgaacaaggaccttgtgtggtgatgtgcaagggtgatcttaggcttgccatgcataaaaggaatcacctggacctagtaatttcatatatattcaagcgtctatagggaatatctccagattgatggggagattccttatcttccttccttttgggcttacaagaatgatgcaagttcccaaaataggaaggatctcctatttatctgccttatttacaaccaaaaaagaaagagtggaaaatgaaggaaaacataccatttacctgggttgttcatgtaaggtaagtacctagtaacatgtttttcttatttggttagatttcatttactcttttc

SEQ ID NO: 3239 - DNA, 408 bp, Gossypium hirsutum
  Clone ID: uC-gsronu33B114e09b1
tttctttatctccgtcccaagaagacccgagctgtcgggtttaggcttaccatgcgcttggcatctttgaagaccgaaagggagaagaagaaggaaatgtacttcccaatgaggaagtatgccattaaggtgtagggtaggatctctcacattctatttacatatcgattcgctctttactttctagcatcgtcttccgtaaaacccgagttgtgattttggttcaatcttcatgtttggaaactcttttttgtccccttgttaaaaaccaagattctggtctttttgattgaatggtaatttatggatttttttgcaaatattttaaaaaaaagaattttttgatgactaactaattttgacttggtttaaagggatattctggtgctaaaaggttattaaaatata

SEQ ID NO: 3240 - DNA, 322 bp, Gossypium hirsutum
  Clone ID: uC-gsronu33B114e11b1
tttatttgattcttggaagacaacccttttacttcgggtgttaattaaagctgtatgtctaattagctggaagaagatgatcttacctaaaagagctttgcgtcgtgagagttgcctgtgtttctcagtttttcattttaatggtgattgctttgttttatgtgtctgtgtgcaattatactccgtatactctcccttataacaattatttccggaaatgtttcacttgtttggccttaaattttatgatttacgctgatgatgattatactgctggttctgttccttgtgttactggatttcaaaaaacaaaaggagcaag

SEQ ID NO: 3241 - DNA, 401 bp, Gossypium hirsutum
  Clone ID: uC-gsronu33B114e12b1
ttcctacgcgtccgcccacgcgtccggaaatggggaggttaattaaacactctgtttacttccaatcttacaagggtcacaagaatggcatcaagaaacccaagaggcaccgccacacttccaccaaagggatggatcccaagttcttgaggaaccagaggtatgcaaggaagcacaacaagaagagcggtgagtctgccactgaagaagagtaaatttttaatggcaaaagatctagctttgattagtgttttctaattgttgtttttcccccgatggaattgagtgttcgtttactataatcaccttagttgaaatgttattttgggattgttgaatctcattttcaaaagagatttgaagctgtgagcttattaatattaagaacatgttttgagctt

SEQ ID NO: 3242 - DNA, 455 bp, Gossypium hirsutum
  Clone ID: uC-gsronu33B114f03b1
ccctctcttccgagacgagggtgtacctagcactgcaattagagaaatctctctcttgaaggaaatgcaacatggtaatatcgtcaggttgcaggatgtagtgcacagtgagaagcgtttatatttggcatttgaatatctggacttggatttaaagaagcacatggattcatatccagaatttgggaaagatccacgaatgataaaagcattcctttatcaaattctccgtggcgttgcttattgtcattctcatagggttcttcatcgagatctaaaacctcaaaatttgctgatagatcgccgtaccaatgcactaaagcttgctgattatggtctggcccgagcatttggtattcctgtcagaacatttacacatgaagttgttactttgtggtacagagcacctgaaatactgcttggatctcgccattactctactcctgttgatgtgt

SEQ ID NO: 3243 - DNA, 455 bp, Gossypium hirsutum
  Clone ID: uC-gsronu33B114f04b1
gattcgctgagttcgttgctactttcctattcttgtacgtctcggtgtagaccgtgatgggtgttgttaaggacaaaaccaagtgtacaactgttgggattcaagggattgcttgggcttttggtggtatgatctttgcccttgtttactgcactgctggtatctcaggtggtcatatcaatccggcggtgacatttgggctgttcttggcaaggaaattgtcgttgacaagggcaatattctacatggtgatgcagtgcttgggagctatatgtggggctggtgtggttaaagggttcatggggaagacaaggtatggtgctttgggtggtggagctaactctgtgaatcatggctacaccaagggagatgggcttggtgctgaaattgttggtacctttgttcttgtttacactgtgttctcagccactgatgccaagcgcagtgccagagac

SEQ ID NO: 3244 - DNA, 456 bp, Gossypium hirsutum
  Clone ID: uC-gsronu33B114f05b1
cttgctctaacatccttaacctcacctccatctggggggttcttgtattcttctccaacaacaccaatgagcccatttgttggtttctctgagcttgcagggaaagcgggtggtgagaggcgcactgcagtacataaacttggctcaatgcccagtctatctgagaatcaaaaacagaatggtgatgctggggctaagtttacttcttcgaatgcacagttgactccaacagctgatttcattccaacttcgggtttgggatgtactcatctctggctgcagagtcgagtaccactaggatgtgttcctgctcaatctacggctaccattaagcttgagctacttccgttgactgatggcataatcactcttgacacattacagatttatgttaaagagaaaggtcttacatatatccctgagcactcattgatgataaatgcgacttctagcatc

SEQ ID NO: 3245 - DNA, 458 bp, Gossypium hirsutum
  Clone ID: uC-gsronu33B114f06b1
aattcttgcagaggaaataaggaaaggggctgcagctggtgttggtgttgaagccaaattatggcaggtctctgagactctatcggaagaagttcttggaaagatgagtgcacctccaaaaagtgatgtaccagttattacaccgaacgatcttgctgaggccgatgggtttgtttttggtttcccaacaagattcggaatgatgtccgcacaattcaaagcttttctggatgcaaccggaggtctatggagaactcagcaacttgcaggaaaacctgctgggatcttctatagcaccggatcacaaggcggtggacaagagactacagcgttgactgcaatcactcaactcgttcaccatgggatgatatttgttcccatcggatacaccttcggtgctggcatgtttgagatggagcaagtgaaaggtggaagtccatatggtgctggaacatatg

SEQ ID NO: 3246 - DNA, 481 bp, Gossypium hirsutum
  Clone ID: uC-gsronu33B114f08b1
tgtctctgttacaacttctttctccagaattggttcggtcaaccacactcttatggatggtattcttcggaaatgcattttcggattatggccttgtattactcacaacggaattgcacaatggacgtaatacatgtcgtccggaagaattgcaaacagtaaaatacgagggcgttagctacaaagatgttttcattactacttttgctgagttccccggcctcctgatatccgctttcactgtcgatcgatttggtcgtaagttctcaatgtcagctatgttcttcctgtgttgcattttcctgtttcctttggtagtccatcagcctcagggtcttacaaccggcctcctctttggtgctcgaatatgcatcactgccagcttcacggttatgtatatatacgcgccagagatatatccaacgtctgttagatcaactggtgttggaattgcgagctcaatgggaagacttggtgggat

SEQ ID NO: 3247 - DNA, 320 bp, Gossypium hirsutum
  Clone ID: uC-gsronu33B114f11b1
tccctcgcgtccgcccacgcgtccacagacgggtgggtttactcagaagtttttctttgctttcaacgccgccaaacatatttttgatggacatgttgggatgaagagcaaccgcactaatactattccagagcaattattggagaacgtacctgttattggggatgcttaagaggctgaggaatctgcggaagtaggtacaaagcctttaagacaacattcatatgattaacccagacagaccttactggaaactgaaaagccagagggggacccagctggtggaaagtatccaaacatgctgagggtcattgtaaaag

SEQ ID NO: 3248 - DNA, 326 bp, Gossypium hirsutum
  Clone ID: uC-gsronu33B114f12b1
tccctctcgtccggccacgcgtccggaaagagaaggggtttaataaaaaatttcgcggcttacccaaccaaggaactgaagactgactagcgagcttgacgaataccaaacacccaagtgctccgggtacgattaaaaaaagattccttacccactccatttgcgcagcaaatgagggggggcccctctggacggccgcccggtgtaccgccgttgttagggccccagtggattactctctggacccccgaatgaaaggaggcggccaagagcatacccgccgaaaaccataatgcccgggaggaaccagggagcatactttagac

SEQ ID NO: 3249 - DNA, 479 bp, Gossypium hirsutum
  Clone ID: uC-gsronu33B114g01b1
cccacgcttccggccttcatgataattcaagattacgtgggttccctacgattactctagacctcaccggctcaccgtcctcctcctcgtcgttgaattatttcaacaggttccctaccaactgcccggcaacacccagatttccttcgacaaatctcaacttttcttcaccactagtatccaatgaatcattcacccaagaaaactacttttaccaacaatcattgacagacacgttaaccaaggcaatcacatcagaccctagtttcagatcattgatatctgctgccatttcatcattggttggccatagcagtgcaaagcatggagatggaaccgatcaaaaaggtgatagttttagtcagaatttgatgcaggcggccattaattctcaaagtttaaatgattcatcattacgtgggtcaagctacttcaaaggatttgaatcttcaagttctaggatcggaagttcaaatcag

SEQ ID NO: 3250 - DNA, 486 bp, Gossypium hirsutum
  unsure (1)..(486): unsure at all n locations
  Clone ID: uC-gsronu33B114g03b1
cattaactggcgtaactttggagataattttggatgggaaactgagagagagattgcgtgagagtatgaatcgccaccacgatccaaaccctttcgatgaagaagaagtcaatccattttcgaatggtggttctgtcgcacctgcacgaccactggcatccgaacctctgggttttgggcagaaacatgatgctactgtggatatacctctggattcaatgaatgattctaagaaaagagaaaaggagctcgcagcttgggaagctgatcttaaaagaagggaaaaggatataaagagaagagaagatgctgtttcccaagctggtgtttctgtagatgataaaaattggccaattttcccgattatacatcatgatatagctaatgagataccggttcatgctcagaggctgcaatatcttgcatttgcaagttggctcggcatagntctttggcttgcttttaatgttattgcagtgattgtct

SEQ ID NO: 3251 - DNA, 418 bp, Gossypium hirsutum
  Clone ID: uC-gsronu33B114g04b1
ctctccataagaactcttttgctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagattggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaaggacaggttccgaagggaattggagggca

SEQ ID NO: 3252 - DNA, 457 bp, Gossypium hirsutum
  Clone ID: uC-gsronu33B114g05b1
gtttgcttggtgtcagtagtcctgtgaaactccagaatgtcatggctggtagtgcaaaatcagagttactgccctcccaagagacaccgattgatgttgctgagaagctagtagctttaaaggccatcttccaggatgaaagacctgtggtaggagggaaagaaggtcccgtttttcttcctggtccctatgacatgagggatccagatattccatcactaaatgtccaacgatcttctccactgcttcgtcctcaattgaatcatggaggtcctatgcttcatccattagattctcatcgctctaacatcggttctcaggtgaagttcgtggctccagaaggcatgatccatcatgatgccccaccaaatcatcatttacctgcaaatatgcttcatcctctccatcatcctagcagtggactaactggatttgatccttcgattcatcatcctat

SEQ ID NO: 3253 - DNA, 458 bp, Gossypium hirsutum
  Clone ID: uC-gsronu33B114g06b1
gattatctgctaccggaaaatgtctacgtcaccgtgcgggaccgttctccaggtggtgaactttacgttccctccgacggtgaagcctcctggttccaccaaaactctgttccttggtggcgcaggggagagaggattggaaatccaagggaagttcataaagttcaccgcaattggagtttacctggaagatagcgccgtgaattgcctcggcgttaagtggaagggtaagagcgcggtggagttaacggaatccgttgagtttttcagagacgtcgttacaggtgattttgagaagttcgtacgggtgacaatgatattgccattaacgggtcaacaatactctgagaaagtatcagagaattgcgttgctatttggaaatctcttggaatctacactgatgcagaagcaaaagccattgaacaattcattgaagtcttcaaggatgaaaacttcc

SEQ ID NO: 3254 - DNA, 140 bp, Gossypium hirsutum
  Clone ID: uC-gsronu33B114g07b1
gtttgtttgttactctctggtcgaaagttggggctttatcaacctttaggttcgagttttctttggaaaatgtagttaaagataatccattcaagttgtaactttaattttggattaaaacaaattattatctatgtttt

SEQ ID NO: 3255 - DNA, 427 bp, Gossypium hirsutum
  Clone ID: uC-gsronu33B114g08b1
gttgtttcctctattaaagcgatgaaacccaggattgttttggttgttgaacaagaagcgaatcacaacggtccggttttcttagaccgttttactgaagctctccattattattctacccttttcgactcgttggaaggttcaggggtggcgccagcgagtcaagacctggctatgtccgagttatacttaggaagacagatttgtaacgtggttgcttgtgaagggatggaccgagttgaacgacacgagccgctgactcagtggagaactcggatggaaacggccgggtttagccctgttcatttgggttccaatgcttataaacaagctagtatgttgttggccctcttcgccagcggcgatgggtatagagtggaggagaataatgggtgtttaatgcttgggtggcatacaaggccactta

SEQ ID NO: 3256 - DNA, 480 bp, Gossypium hirsutum
  Clone ID: uC-gsronu33B114g09b1
tatattaaccgcttcgggcaagcccttcgttggggttttgttggaaggtggtgtccttcctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctaacatggtgacccccggttctgactccccgaaggttgcccc

SEQ ID NO: 3257 - DNA, 459 bp, Gossypium hirsutum
  Clone ID: uC-gsronu33B114g11b1
tcccttgcgtccggaacaattgtgtcaagagggatggcatgtttaaaaaaatggttggattgaacacaccaaggaaagataatgctccactgcttcaatgcacgcaccacatgtgcccagtgcgagtacactggcatgtcaagctcaactacaaagagtactggcgagttaaggtatcgatcaccaacttcaactaccggatgaactacacgctatggagccttgttgtccagcacccaaatcttaacaacgtaacacaagttttcagcttcgattacaagccgctggttccctatgaatcaatcaatgacacagggatgttctatggcatgaagtactacaatgacctgttgatggaagcagggccattaggaaatgttcaatcagaggtgcttctgaggaaggacaaggataccttcactttcaaacagggatgggcatttcccaggatagtgtatt

SEQ ID NO: 3258 - DNA, 504 bp, Gossypium hirsutum
  unsure (1)..(504): unsure at all n locations
  Clone ID: uC-gsronu33B114h01b1
gttttcttcccttggcttacaagttccattgtttagcagagcttgaaaaaaaagggaaaatggaagggaaagaagaagatgttagactgggagctaacaagttctcagaaaggcaacctattgggacagcagctcagtcccaagatgataaggattacactgagccacccncagcacccttctttgagcctagtgagttgacttcatggtcgttttaccgagctggaatcgctgagttcgttgctactttcctattcttgtacatctcggtgttgaccgtgatgggagttgttaaggacaaaaccaagtgtacaactgttgggattcaagggattgcttgggcttttggtggtatgatctttgcccttgtttactgcactgctggtatctcaggtggtcatatcaatccggcggtgacatttgggctgttcttggcaaggaaattgtcgttgacaagggcaatattctacatggtgatgcagtgcttgggagctatatgtgggg

SEQ ID NO: 3259 - DNA, 454 bp, Gossypium hirsutum
  Clone ID: uC-gsronu33B114h04b1
cggtgaactccgtgaatataacaacagggttgacggacacctttgtttccggctctatttacactgatggtcagcttgctgtttatcaaatcgatcaagttcttcaaccattgcaaatatttgcacctaggcctccagctccagcaccggcaccggcaaagtcgaagaataagaaggctaccaccgttgctgatagccccgatgttaccccatctgataactccaaagcggccaccttgcaaaatgttggtttgtttggagttgctgctctagttattgcactttctttgtgaccatgaaaatggagaaaagaagaagacagtgattttgatggtgatcaagatggcgagtgttttttattttttcaataattatcatttaaaaaatttatgttctgtatgaagattgaattttgagtttgtcttgttgatttcatttatttttgttttgaaat

SEQ ID NO: 3260 - DNA, 338 bp, Gossypium hirsutum
  Clone ID: uC-gsronu33B114h05b1
gtggtttgtgagtgttgttttgggattttgaagaggggggattatatgatgaccggcatggtgaagtggttcgatgaccaaaaggggtatggcttcatatcccctgacgacggtggcgacgatttgtttgttcaccaatcttccatccgttctgagggtttccgtagtcttgctgatggtgaagaggtcgagtacgttgtcgagtcttctgaaggtcgccccaaggctgttgaggtcactggccctaacggcaaccctgttcgtggatcctccagatccggacgcggcggcggcggtggtggcggttatggcggtggatccggtggttatggtggagg

SEQ ID NO: 3261 - DNA, 462 bp, Gossypium hirsutum
  Clone ID: uC-gsronu33B114h06b1
cttttctttttcaatcaatttttacaacaaagatgggggggctcaatacggtcccaccgtcgattacttggtggtctttttcttccggtttcgatgccggaccgccggtaccggttcccaaagttggtttctttaagttaccaaggtcaaacggcggtaaccatgccaagttgagcttagttcaggcgacggaggaatccaccgttgcgacgacgaatggtcgtgttgctgcagtttccggtgaaaatgcccatcagatggccactaatggaaaggcatggaacatagtatggcacaaaagttcagttgataaagttcatcggcaagagttacttcagcaaaagggttgtatcatatggattacgggtctcagtggttcaggaaagagcacattggcatgcgcgctgtgccatgccttgtattcaaagggaaagttaacttacatccttgatggtgataatg

SEQ ID NO: 3262 - DNA, 490 bp, Gossypium hirsutum
  Clone ID: uC-gsronu33B114h07b1
tttttatagaagaaaatatagaagaaatagctggaggggtttctaaaaatggtggcgtcgctaactcactatgcaagctcatcgacataccagctgcttcaatggcactacgttactatgcaggtgcagctgataaaatccatggaaccgtgttgaaattaagcaaaggactccaaggctggtgtccctgatggagtgcttaatgttgtgaatggatacggagagactgctggtgctgccattagctctcatatggacattgataaaactgataagaagcaattcgagaaaatcctatcatacatcgagcatggcaaaagagaaggagctactttactaacaggaggcaaacacattggccaaaagggatattacatacagcctaccatatttgctgatgttaaggatgatatgatcgtagcaaaaaatgaaatttttgggccagtaatgtcattgatgaagctcaaaactatggaagaggggattaaga

SEQ ID NO: 3263 - DNA, 491 bp, Gossypium hirsutum
  Clone ID: uC-gsronu33B114h08b1
cttggatcttttaagaacatctccaaaccttgtgggttgtaatgttcctccaatgtcgaaacatttatggcagcttataagattaagcttgtaggaccggatggtgaggtgagcgagtttgaagcccctgacgatcaatacattttagatgcagccgaggaagcaggagttgaactgccatactcttgccgagctggagcttgctccacatgtgccgggaagatggtgtcgggttcagttgatcaatcggacggatccttccttgacgaaaaacaaattgccgatggttacctgctgacttgcgtttcgtacccgacctcagattgtgagatccacactcacaaggaagctgatctttactaggtattttatggtttgaaatcagtagaatctatctaaaatacccagaaatttcatctgaatttgttggaaaataaagggtaaatgactaaatgcttatcagggacaatttgttgcttaatatgcttagt

SEQ ID NO: 3264 - DNA, 389 bp, Gossypium hirsutum
  Clone ID: uC-gsronu33B114h12b1
ttttcctcgcgtacgcccacgcgtacgaagaagggggggtttgatataggtcagaaatttgtagacatggctgcatctctagaaggggtggctacacatgttccactttacaaagttactgaaggaaatgaaccttgcttcttgacaacattcttgtaatgggattccacccaagctactgttcaaggaaactcattccaaaagaaggtggctttgctctttggggctagccatgctgtagagggccaggatcgatccaacggaaatcaagggggacctacacaatgagcttcagcgttagctgccttatcatctgcatttaatccatcatcagcgctacacttgtccttactactctggttggaacctacacatatgtccagaacttc

SEQ ID NO: 3265 - DNA, 452 bp, Gossypium hirsutum
  Clone ID: uC-gsronu33B116a02b1
ctcgaagcttccttttccgttttagatctcaaaattcaaaaggctctctttttcatctcatggctgctactatcgtctccgtcaaagctaggcagatcttcgacagccgtggaaatcctacggttgaggttgatgtggaaatatcgaacggtataaaggctagggccgcagttcctagcggtgcatccactggaatttacgaggctcttgagttgagagatggaggttccgattacctcggtaaaggtgtatcgaaggctgttgctaatgttaacacaatcatcggccctgcattgattggaaaggacccaaccgagcagactgcaattgacaatttcatggttcaacaactggatggaacccaaaatgagtggggttggtgcaaacaaaagctcggtgcaaatgccattcttgccgtgtcccttgctgtttgcaaagctggagctgaagtc

SEQ ID NO: 3266 - DNA, 465 bp, Gossypium hirsutum
  Clone ID: uC-gsronu33B116a05b1
tctttctttacttccaaaaacatctctctctgccctttcgggctctcactcatctcttttctctccacaccccttcaaacaatgcctgctgattccggcgataggcgtcaggttgcagttccaggaactatggcgtcccacccaccacctaagctgacggagccacttccatgccctaggtgcgactccaccaacaccaagttctgctactacaacaactacaacctctctcagcctcgctacttctgcaaggcatgccgccgttactggactcaaggaggaactctccgtaacgtgccggtcggtggtgggacccgcaaggcttccaagcgctcacgttgttcttctggctcttctccttctgttgcagtttcttcttcctcgagcgtgacgcatgaagctgagtccgctcctatggttgttaaccctaccccccctatgcctggactcggaattaaacctgag

SEQ ID NO: 3267 - DNA, 467 bp, Gossypium hirsutum
  Clone ID: uC-gsronu33B116a06b1
cccactcgttcggcaatcgtgcaaggaatcaactgataactctaaggatgcatcttgtgttgcagaaagtcaggacactggttcatctacaacatcgtcgtcaagaatggtagcgcaagatctgaacgatggttaccaggtaactgaagctctacgagcacaaatggaagtgcaacgaagactgcatgaacagttggaggtacaacatcgccttcagcttcggattgaagcacaaagcaaatacctacagtcaatgctcgagaaagcctgcaaagctctgaccgatcaagatcaagctgcttccacaggtctggaagctgcaagagaagagctatcggaactggctattaaggtttccaatgattgtcaagggatgatccctcctcatgataaaataaaactgccttccttgtctgaacttgcagtagttttagagaacaacagaacttccaatatgccgggtcgga

SEQ ID NO: 3268 - DNA, 122 bp, Gossypium hirsutum
  Clone ID: uC-gsronu33B116a07b1
ctttgtgttagatcttttagggtttggaccgagctgtcttttagattttgtgaaaaaaatataatccattccacatgtgtttcgggtttgagttatttggatttaggtttctgatttctttc

SEQ ID NO: 3269 - DNA, 444 bp, Gossypium hirsutum
  Clone ID: uC-gsronu33B116a08b1
cccacgcgttcggtgagtgtatgtgtgtgtgaaagcttagtgaggtgaaagccgagctgtcattttgcatgttgtgagaaaaagggtatggcctgaagagctggagtgatccaacaaagattcctctgccagatgcataacattagtttattcagacaattagaactaggaagcccttttttttttgtcataatcaatggaaagaaagggtaaataaccctattttccttctggtcttttgcatcatattatcacctggtttgggtctactttttatttaggagggcaaagttgagttacatgtatactacatgcatccatctgtaagtatataaagtgattgttttgtattgctgtttatactgttttaagagctgtgctttactttgttgtatatacacgttctttgctctaaagtcttttaaaaagtataaaataagagtg

SEQ ID NO: 3270 - DNA, 460 bp, Gossypium hirsutum
  Clone ID: uC-gsronu33B116a12b1
aacttcaatagcatctctcactttgatatctttaaagggtggtttgctcagttgagttgcttagaacaatggagggtagcaaaatggccatgattttgattgcctacgttacggttcttgccgttttcaccaatggagccacagctttgagggaagatcaaggggccgtcgcaccatctccgatggaaagtgcaggagcggctttgggtgttccagctgcagtagctgccttagcttctatggctgcatggttcttttgaatttcattccttgttatttatcttttcattccttggtgaatatggtctaaaccctttttaatttctctttctcaatatttgtcctgttggtttatttgagtttattattattccaagcaactggtattgtggatggagaccgaaatttttattcttcttttcaagtaattataatgttaataaaatcttgatttgtagtg

SEQ ID NO: 3271 - DNA, 312 bp, Gossypium hirsutum
  Clone ID: uC-gsronu33B116b01b1
ctcctctaagttaccgttttggtccctggttattggatactccccccttatggctgcccctgatgtcgagctcccggtgcttttttcggagggctcgcatgggccaccgacgaccgggcccttgaggaaacctttagtgcgtttggtgaaatcgtcgaatcgaagatcattaatgatcgtgagactggaagatccccaggctttggattcgttacttttcgtgacgagaaagctatgagggacgcgatcgaaggaatgaacggtcaaaatcttgatggaaggaacataactgtcaacgaagcccaatcgcgc

SEQ ID NO: 3272 - DNA, 303 bp, Gossypium hirsutum
  unsure (1)..(303): unsure at all n locations
  Clone ID: uC-gsronu33B116b02b1
aaatggggttttagaagggcacatagcgaattggaaagggaaacatgggaatactttcgtacacgaagaacagcaatgaaagaagaaggcactcaaataatcagtgtcattagcagccaattggatgctttaacgggctcatctttgggaaaacgtgtttttaagcttccaaaacctctgcattacaattctcaaaccccaacactttgacgttagatctggcgtcttttttttttttcttctgcttacagtttctggaaattttcaattaaacaacatggacgattggagactttcgggntt

SEQ ID NO: 3273 - DNA, 450 bp, Gossypium hirsutum
  Clone ID: uC-gsronu33B116b03b1
gttttattttatcaatgtggttggttgaggcaagaattccaggagtttactccggtggggcatggcaaaatgcacatgctaccttctacggcggttctgatgcctttggcaccatgggaggagcttgtggatatggaaacttgtacagccaaggttacggagataacacggcagccttgagcacagcattgttcaacaatgggttaagctgcggtgcttgctttgagataaagtgcgcaagtgatccaaaatggtgccattccggaagcccttccatcttcatcacggcaaccaacttttgccccccaaactacgctctgccaaacgacaatggcggctggtgcaaccctactcgctctcactttgacctcgccatgcccatgttccttaagattgctgagtaccgtgcaagaatcgttcctgtttcttaccgccgggtgccatgccgga

SEQ ID NO: 3274 - DNA, 451 bp, Gossypium hirsutum
  Clone ID: uC-gsronu33B116b04b1
aaattttctttcatcctctccgatcacattcgcaatggattacgatttcaggaacagaacgggtccaccgtacgaggcgcagatcccgatttaccggcaacaacccacttcatcgtcatctacccatccgatgtacggatcttcaatgtacccgaggatcggtggtcaacccgccgctcacagtgttgcccctcccaccactcgcgcctcttctttccaccagaattcttcgccttcctcttcctcgggattgggcattagggttgctttgaaaccagaatatcgtattacacctccgcctcagttgtctccccaagttggggatattcctcgaagcaattttcagtttgatttcgagtttgagaggaaaattttggctgaagcagaaaaagaaaacatgaattggagtaagcttggcttggaaaacctttcttccaagcctatcgaaact

SEQ ID NO: 3275 - DNA, 457 bp, Gossypium hirsutum
  Clone ID: uC-gsronu33B116b05b1
ctaaattccaatgatggcgggaccgaatccgccaaaacaaccgtcatcctcctccaacaaccaccgcaaatcccgctgggaatcttcctcttccagcgccaataaaaacccctcctccacaaccgccgaccacaagtcctccaccaagcccagcccatccaccaggactggcccacctccaagctccgctgctcaaaacaagtcacaatccgaccccaatcaagctcatccacccttccccttccccgatccagccgcccttggccctccgcctccaccggcttatggattccacatgctggagcgtcggacaatcgtcctttacgacggcagcgtccgctcctactttgctctcccgcccgattaccaggactttcctacccgacccatactcggacctcgtgacttcggtagcccatcaatgggcttccgcgataatcgcgattattggaattcg

SEQ ID NO: 3276 - DNA, 449 bp, Gossypium hirsutum
  Clone ID: uC-gsronu33B116b09b1
aaaaaaaagaaatctccaacccaaacccttcctccggcggcatttgtttgcaaaaaaaaaaaaaaagaagttcaaattgaagaatgcctgtattttcttcaagagctatgttcaggaactacgacaagcatagaaagcaaaaaagtgaccctaaaggcaaattgtccgacgtgttcaggagctatgctgattctaatggggagctaaacaaggaaaagctgaaagacgcttttctacatctggatgctgccatgccgtaccggcaagccgaagaagccctccgtgtcgtcggcaaaagctattacattaacatcaaggatgaaaccgaccttaacacccttgtcgactatgcttacaataagggttacgggtattcaatttgattagctaatttataagcttattttctttttctttttcacttttaatcatctaatatgtttttttta

SEQ ID NO: 3277 - DNA, 248 bp, Gossypium hirsutum
  Clone ID: uC-gsronu33B116b10b1
acgttcttcggttcagcctccctcaacaaattccagacggctctttgtaaaaagaagaagaaaactttgggaatttcaggtttaaagctgtaagatataagattagctttgggtttgggtttggccgaaaacaaaaccccatgaggtcttttccttttctccttaattttgattgcgaggaataaaagagcgtgtataaggttatatatatagaagaaatgaaaatgaagatgctttaatttgtgaat

SEQ ID NO: 3278 - DNA, 453 bp, Gossypium hirsutum
  Clone ID: uC-gsronu33B116b11b1
ttccattcgtccggtactcactcaacattcccaggtggaatctctagctcccaaggttaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtacc

SEQ ID NO: 3279 - DNA, 432 bp, Gossypium hirsutum
  Clone ID: uC-gsronu33B116c01b1
cccacgcgttcgcccacgcgttcgattacttctcagctattcggtccactggaatcatagccattcaattggttcctggtgatgagttaaagtgggttcgttgttgcacaaatgatgaccttgtggccatggcttcacaaaatggaatggtcattctaagttcctgtgacattatccgagcactaagcagaaacaccagaggagctattgccatgagactgaaagaaggagataagatggcaagcatggacatcataccagctccaaggcatacagatttggataagacagcagaagattccattagctatgataagggtggcagtggtccgtggctcttgtttatctctgagaatggctatggaaagcgagttcctttgagtagcttcaaacagtcgcctttgaacagggttggtttaataggatacaagt

SEQ ID NO: 3280 - DNA, 403 bp, Gossypium hirsutum
  Clone ID: uC-gsronu33B116c03b1
cggtatctcaagcaacgctatggggataatgaacagtttcattaacgatatctttgagaaacttgctcaagaagcttcgaggctcgcgaggtacaacaagaagcccacgattacttcaagggaaattcagaccgctgttaggctcgttcttcccggtgagcttgcgaaacacgccgtctctgaaggtaccaaggcggtgactaagtttactagctcttgaatttaatgaaatttggggattttaggtttagcgttttttatggaggttcctttttgaaattgcgttgatgtatgtaactccttgttactgatggttttgaaattgttggaaccatgaaatgaaagtgcatccttttgtctatgttaaggaatcgaaatgtttctttgtttaacaatggctatt

SEQ ID NO: 3281 - DNA, 424 bp, Gossypium hirsutum
  Clone ID: uC-gsronu33B116c04b1
gtttgtgccacaaatgacaagacagtggcagtggaagtggtgcgtttagccccgcatcccaagtacaagaggcgtgttaggaagaagaagaagtttcaggctcacgacccagataaccaattcaaagttggcgattatgtgcagcttgagaagagccggcctattagcaagaccaagactttcattgcggtggctgtaccaagtaggaatgggaagcaggagaaggaggaggcaggggagcttgggattccattggagtctaaacagactcaagagcagccgcaggcttagtgttaagcccttcgcgtgggctccttttgttgttggtaaatttgtaatcttttgcaagtgatttcactgtttcaaaaactgcttttccttaatgtaataattgttgcttttcaagggtatggattgttttttg

SEQ ID NO: 3282 - DNA, 452 bp, Gossypium hirsutum
  Clone ID: uC-gsronu33B116c05b1
ccctttcgttcgcgacgttctttcgcttcaatttggggtggaggagatggaaatcagttgcagcttctgaaagttttaagctagcttgttcgaggattccgtcacgggaaccttggtttttcatggtggatcccaatcttaatcaatccgtagtcttcgactctgctgagagaagttggaagaaactcagtcatccgcctctcctctcgcagaactgtaactgcaactccattccggttgcagcagttggcggactcgtgtgtttccgcaatatgtccggcgattacttcgtatgcaatccggtaacaggatcatgtcgtgaactccctccggtgaatccggattctcaccatcgttcccttcatgctatagcaatgaatgcatattccaattatcatggctcctacaaactattcttagtctcgggtgatcttccgaagctttcatacaaa

SEQ ID NO: 3283 - DNA, 450 bp, Gossypium hirsutum
  Clone ID: uC-gsronu33B116c06b1
ggcctagatcgttttaggacaataactagcagctattatggtggggctcacggtatcatagttgtttatgatgcgacagaccaagagagtttcaacaatgtcaagcaatggctaaatgaaattgaccgctatgccagtgagaatgtgaacaagcttttagttgggaacaagtgtgatctaaccgcaagcagagctgtatcctatgaaactgctaaggcttttgcagatgaaattggaattcctttcgtggaaacaagtgctaagagtgctactaatgtcgaagaagctttcatggccatggctgcttcaatcaagaacaggatggcaagccaaccagcaatggataatgcgagacctacaacagtgcagatgcgaggacaggctgtggaccagaagtctggttgctgctcttcttaatgaaaaataaggttttagtggggctcataatgc

SEQ ID NO: 3284 - DNA, 447 bp, Gossypium hirsutum
  Clone ID: uC-gsronu33B116c10b1
tttggaaattaatttgcttatcacttagacttcagtcttcatacaccagcttttctggaatattgtctcgggttgtaaagccttctgaataactcagggactagagcacttattaacaaactctggacttggaagcttgttaatctcatcttaagcttggttgcactatacgagtatgattgcaatttttggttttattggtaataagtttgtacatcctactatagtgaatataactttatggatgacggttttgggaagatcaaggtgattccagatcattttcaagtctcaactcctcccagtgaggattctcttcaaaacagaagttcacctgattcacaaccaagtactggaaattcttcgaggtcccgtagcagtttatggtctcggcgaaaattgagaagggctgcattcatgttgaatctgttcagtttacgtgggttg

SEQ ID NO: 3285 - DNA, 92 bp, Gossypium hirsutum
  Clone ID: uC-gsronu33B116d01b1
gttttataccaaccaagggaaaaaaaaaacgggggggggtagaaaaaaaaacaccgggggcgcccccaccacgcacaacagggcgccccccc

SEQ ID NO: 3286 - DNA, 457 bp, Gossypium hirsutum
  Clone ID: uC-gsronu33B116d03b1
cccacgcgttcgcccacgcgtccgcccacgcgtccggcaaaaatggggttaattcccatgagaaacatacacattcttcttgtttttacggtgacaatagtactccttgaaacaaatggttgcaaagctgcttttctagtgaagagcaacttcagctacaagtgcaaaggccgtctcaacgaatgcaggatcgctgaggctttggactcggagctagagttggagttggacatggtgatgaattctaacgttgttagaatccttcagagcagtaacacgccggtaaccagtaacacgggaaaccggaatacgccggtgcaacagacttgcccgagtcctcagtatgctagttgtcttgccacaggaggtagagctaattgtaggggaacttactgccgcggctaatccatcttttggatcattcctcttgttattatatgggcaaatgctaaatgag

SEQ ID NO: 3287 - DNA, 378 bp, Gossypium hirsutum
  Clone ID: uC-gsronu33B116d04b1
tgaattttgtaaagaagagaaaaaatgcataatccaccaggaccagacccccaccatcctgaccatccccaccacccacatccggaaccccatgctccgcctccaggtccgccacatgctgatcatcctcctccaggccatgctcctcctcctggaccaggcccccatgcgccaccgccaggaccaggtggtccaggtcatcatcccgagccacacaagcctcgtccatgatccttataccgtgtatccaatattatgtacgcttaggctccgtaccgtacttgtataactctatcacctacttggtgttaggctttatgtaataaattatgaaaacctatttctactagaataataataaagtagcacgtttgatgt

SEQ ID NO: 3288 - DNA, 60 bp, Gossypium hirsutum
  Clone ID: uC-gsronu33B116d05b1
cccacgcgttcgcccacgcgtccgcccacgcgtccggccacgcgtccgtctagatcgcga

SEQ ID NO: 3289 - DNA, 451 bp, Gossypium hirsutum
  Clone ID: uC-gsronu33B116d07b1
atcctgagtttcatgggaaaaaatagatgttagttttcagagcagtagacagagatttgctgctcatagtgttatacaggttctctctctttctggagttgataaaagtttatacgatcatatatgcagtcggaagttcttactaagcgaagttttgcaggttaaagatgaagttatgcatatagaaggtgcagatgtcatccaacatatgattgaccattttcttacgtgaaaccttatggtgtttgagatacacatcatacgagcaaagaagattaattcgctacctcaccgtatttgtcgactgctaagttattgctcgaattcccattggttaaagttgaatgatggatcagtactcacattggttggtaaagatggctatgacaagggcaattaagtcagcagttcattcattaattatctctagtttgcttcctaagaaggatga

SEQ ID NO: 3290 - DNA, 435 bp, Gossypium hirsutum
  Clone ID: uC-gsronu33B116d10b1
tgaatgtactgctgaagacgcatatacatggagtcagggccgagccatttttgccagtggaagcccatttgatcctgtagaatacaagggaagggttttcgttcctgggcaggcaaataatgcatacatcttccctggcctcggtctgggtttaattatgtctggtgcaattcgtgttcatgatgatatgcttctggcagcctcggaggctttggctgcacaggtgacacaggagaactttgacaagggactcatttacccaccatttagaaatatcagaaagatttcagcccatattgcagccagtgttgcagctaaagcatatgaactgggtttggctactcggcagcctcagcccaaggatcttgtgaagtatgctgagcactgcatgtacaatcctgcctaccaaagctaccggtgaaggtagttagaacg

SEQ ID NO: 3291 - DNA, 405 bp, Gossypium hirsutum
  Clone ID: uC-gsronu33B116d11b1
tggtgccaccactccggccggtcttgatggcgcttgtatagctcacggcttaggactgttcggccttgtatccgtcggcgctaacatgtgcggcggtgacgtcaatgccgacgtcacttgcggagctgtcggagacggtaacatcagtcttttacgcggcatcctatattggatcgctcaactacttggctcaaccgtcgcttgcctgtggctcaagttcgctactagggacatgaccggaccggcttgcggactttcatcgcgagtaggggtgaggaacgccctcgttttgagatcgtgatgactttcggattggtctacacgggttacgccacgggcatcgatcctaaaaagggagacctaggagtgaccgtaccgttggcgatcgggtttattgtgggagcc

SEQ ID NO: 3292 - DNA, 435 bp, Gossypium hirsutum
  Clone ID: uC-gsronu33B116d12b1
cccacgcgtccgcggacgcgtgggcaaatatgcgggggcgtctttcccaaaaccagatccaaaagccagcagattcatccaccgatggccgacgaagccaaagccaaaggcaacgccgccttttgctctggtgatttcaacgccgcaatcaaacacttgaccgatgctataaacctttcccccaccaaccacgtcctttactctaaccgatccgctgcgtatgcttctctccatcaatacgaggccgcattgtcggacgccaaaaggaccgttgagcttaaacctgactggtctaaaggttacagcaggctaggcgcggctcacctcggtttgcaccaatatcaagatgctgtttcggcgtataagaagggtctggagattgatcctaataatgaagctttgaagtctggattggctgatgctcaatcggcggcg

SEQ ID NO: 3293 - DNA, 437 bp, Gossypium hirsutum
  Clone ID: uC-gsronu33B116e01b1
catggacaaaccattaaaacggtttccagggatggggcatggtttaacatcggtagagcctgatgaaaacatcgagattgtttttgcagacatcacggcttggcttgacaagcgctgcaatgccgtgactttcgagcagattcttcgtcctttgaaccaagggttcgagaagttcgataacgcgatggtatcgatggctgcgacaagcggtaggacgcaatcgaatgggacgtatttgtgtggattgaaaagacctcgcacgcaacgtcgctctgctatgtagcttgatggtagtagtatcggattatagctaccgtcaatgtatattcgtgtgcaacatagctttcatttcatgtacttccaaacgtaggaatgcagaacttttgacgggggaaatcgatggaataaaaatgaaatttgttgctgttcgtgtcatt

SEQ ID NO: 3294 - DNA, 300 bp, Gossypium hirsutum
  Clone ID: uC-gsronu33B116e03b1
caatttctttaggagcattggtgtggggctggatatgtcttggcctttccttctcggcattgcccagggtttcgatttccacgacaatgatttagcgtcggaggatagttcgtgggatctatacgagcgctggcggagccaccacacggtttccaggagtctcgacgagaaacatcggaggctcaatgtgttcaagcagaatgttttgcatgttcacaacaccaacaacaaggacaaaccttacaagttgaagatcaacaagtttgctgatatgaccaaccacgaatttaggaatgctta

SEQ ID NO: 3295 - DNA, 446 bp, Gossypium hirsutum
  Clone ID: uC-gsronu33B116e04b1
attttgtctttgcgccggtcttctatctcctggactcacttgccagccaaaggtaagccatggttaagcataacaatgctattcctaatgggcactttaagaagcactggcagaactacgtgaaaacttggttcaaccagccagcaaggaaggctagaagaagaattgcatggcataagaaagcagtaaggatctttccaagacctactgctgggcctcttcgctcctgctggccatggccagaccttgaagtacaacatgaagttgagagctggaaagggtttcactcttgaagagcttaaggcagctggtatttcaaagaaacttgcacccaccataggtattgctgttgatcaccgtcgtaaaaatagatctcttgaaggtcttcaagccaatgttcagaggcttaagacctacaaggccaaacttgttgtcttcccaagatg

SEQ ID NO: 3296 - DNA, 445 bp, Gossypium hirsutum
  Clone ID: uC-gsronu33B116e05b1
ctctttttagcactcaacattcttttcttttccctagtcagtgctacttgtcgatcttgctcttcttccggctctaatcccatccccacccccactccatctgcacgaggtaggtgtcccagggatgctcttaaattaggcgcatgtgccaaagtgcttagcttagtcaatgtcactgttggttcacccccagtgatgccatgctgctcccttctcaatggtctcgttgaccttgaagctgccggttgcctttgcaccgctatcagagctaacgccttaggcctcaaccttaatgtcccagtttcccttagcttgcttctcaacgtttgctcaaggaatgttcctactggcttccaatgctaattttagtcatcactctccctacattctttttcatctttctatttgagcttggcttttgaaagttatggctttcccttatttg

SEQ ID NO: 3297 - DNA, 440 bp, Gossypium hirsutum
  Clone ID: uC-gsronu33B116e10b1
ttcctcgcgtccgcccacgcgtccggtgagatcttttggaattcggcgtaatgagaagattgcttgttatgtgactgtgaggggggagaaagctatgcagcttcttgagagtggtttgaaggttaaggaatatgagcttttgaggaggaacttcagtgatactggctgctttggatttggtatccaagagcacattgatcttggtatcaagtatgacccttcaactggtatctatggtatggacttctatgttgttctcgaacgagctgggtaccgtgtgggtcgtcgtcgcaggtgcaagtcacgtgtcggtattcagcaccgagtcaccaaggaggattccatgaagtggttccaagtcaaatatgaaggtgttatccttaacaagtctcaaaatatcggggcataggaatagccaggtaaacaagatcaatcgagtt

SEQ ID NO: 3298 - DNA, 436 bp, Gossypium hirsutum
  Clone ID: uC-gsronu33B116e11b1
gtcttgagaggtgctggtgtgacagatttggaaactgaagatgaagatggctttccagtttctgcttcacaaaaaagcgaagatgctattcagcagcctcaaccagaaaccaaggaacttagagaaaaattaaaaacactgatgaagaaggggggaaaaagaagaagaaaaagaagcaaaaaggaaatgatacagatgacatcaatggtttaccgggtgatgaagttttatgtagcagaggtcttgctagtactagaatatcttcacatgctcgggattatctatcgtgaccttaaacccgaaaatgttcttgtaagagaagatggtcatataatgctttctgatttcgatctttcccttcgttgtactgatagtccgactcttgtcaaaacgtcctctctcgaatcagagccgttaaggaagaaccctgtttatt

SEQ ID NO: 3299 - DNA, 439 bp, Gossypium hirsutum
  Clone ID: uC-gsronu33B116e12b1
ggattttggaagcaaagacatgttggaatgtgtaggagaaaactatgtgatagggtgaggtggagctggcattgtgtacagaggaattatgccaaatggagagcaagtagcagtgaagaagctgttaggcatcagcaaagggtcttcgcatgataatggcctctcagcggaaatacagactttgggtaagattcgacacaggaatatcgtgcgcttgctgggattctgttccaataaagagatcaatttactaatatacgagtacatgccgaatggaagcttaggtgaggttcttcatggaaagggtggcggctacctcaggtgggatactaggctcaaaatagccatagaagctgccaaaggcctgtgctacctgcaccatgattgatcccctctcatactccatcgagatgtcaagtccaacaacattttactcaac

SEQ ID NO: 3300 - DNA, 380 bp, Gossypium hirsutum
  Clone ID: uC-gsronu33B116f01b1
gtcgtccatgaatctataagggaaggatggcaatagggcacaggtttcatcacggaaagtgtaatgagggatcacatcccggagggctccagcgacacccttgcgttggcttgtgggccgccgccgatgatccagttcgccgtgcagcctaacatagagaagatgaagtattacgtcaaggattttttgttggtattttaaggaaaatttggagatgtttaaatgttttttagtcactgttctttgtcttgtattattattaatttttcccatggcatagcaaagttgttgggaaaacgatgtacatagagaaataagggtgttgtagtttgagagaaggaaaataaataataataataaatcttcttgtatcatgttct

SEQ ID NO: 3301 - DNA, 459 bp, Gossypium hirsutum
  Clone ID: uC-gsronu33B116f02b1
gcatatcatgccactggttgctataatctactttggtgaggcttcattcaaatcaacaatgaaatagcaatgggtgcaagcatctaccctgttactagctatcatgattcccaatatgatataagcttacttgtgtggaaggatcctaaggaggggaactggtggctacaatttggtaatagctatgtgttgggttactggccagctttcctattttcctacctatcagacagtgcctccatgattgagtggggaggtgaggttgtaaactcagaatcagatggacagcatacatccacacaaatggggagtggtcatttccccaaagaagggtttggcaaatctagttacttcaagaatattcaaattggtgatggctccaacaatttcaaggttcctaaagacattgcaactttcactgagcaatcaaactgctatgatgtacaaactggaaaaggt

SEQ ID NO: 3302 - DNA, 446 bp, Gossypium hirsutum
  Clone ID: uC-gsronu33B116f04b1
cccacgcgttcgcccacgcgtgcgcccacgcgttcgcccacgcgtccgttcagaatcaaaatctctctttctcggaatatggcagcacatggcgttgtttctgacacgagcttgatcgtcagcttcggtgagatgctgatcgattttgtccccactgtctccggtgattctctagccgaagctcccggcttcctcaaagcccctggcggtgctccggctaacgtggccattgctgttgctagactcggaggcaaagcgtcatttgtcggaaaacttggagacgacgagcttggacacatgctggacgatattctcaagcaaaacggtgtctccagtgacgggatcttgtatgaccaaggcgctagaactgctcttgccttcgttacgttacgcgccgaccgagagcgtgagttcatgttctataggaatcctagcgccgatatgct

SEQ ID NO: 3303 - DNA, 447 bp, Gossypium hirsutum
  Clone ID: uC-gsronu33B116f05b1
cccacgcgttcgcccacgcgtccgctttttctctctctatattgtctcatctcctgttccaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgttccaaagagcagaatctttttcatcgcatggtctcccgatacatcaagggatcaggagcaaaatgatatatgctagctccaaagacagattcaagcg

SEQ ID NO: 3304 - DNA, 322 bp, Gossypium hirsutum
  Clone ID: uC-gsronu33B116f08b1
gcgttcgagctccaaccagggttcaacacaggcactggactgggcgctgagatcattggtacctttgttcttgtctacactgtcttcgacgccactgatcctaagaggaatgcaagagattcccatgttcctgtgttggcaccactccccattggattcgctgtgttcatggttgaccttgccacaattccagtcactggcactggtatcaaccctgctaggagttttggagctgctgtcattgacaacaaagagaacgcctgggatgaccaatggatcttctggggcggacccttcattggagctggcgcaggtgcattct

SEQ ID NO: 3305 - DNA, 435 bp, Gossypium hirsutum
  Clone ID: uC-gsronu33B116f10b1
atctgccatcaatttgctctgaagatcatgttggctatttttcacaaggcatttgctaatccaccagaggagctgaatagtccagcttctcataaatctaccaagaagcctaaacagcctgaagaaaccctaaatgatttcctatctcatcaccctcacaacactttctccatgagctttggcaacgctgctgttttggcttatgtccgccatgaacgtgctgcttcagttcatcagaggttgttttgtgggtttgatgacatatactgcctcttcttagggagcttgaacaatctatttatgctgaatagacaatatggtctttccaaagggagcaatgaggcgatgtttgtgattgaagcatataggacgctgagggataggggtccataccctgctgatcaggttgttaaggatcttgaaggaagctttgcc

SEQ ID NO: 3306 - DNA, 376 bp, Gossypium hirsutum
  Clone ID: uC-gsronu33B116f11b1
gctcactccacccgccacgcgtgctgacacgcttgcactttgatggtctgtgtggggataaaactcctgtctgcagtatcggaggttgacgaccatccaaatctagggataagctgcagaacgatggatctagggtgattaagaaatgtctatcaaggagacagaatgtagcatctggctctagggatggtatatactatgtacttttagatgctaccaaacaacaatgatatgtaggtgcatgtgaaaagtctggatttaaatcggtcgattacatgctgtgggcatacaaacctctgaagggaaagcatgtagcgtttacaggctacatgaccattgaagaggctgacaaactcatacgctctgtgagtaatgg

SEQ ID NO: 3307 - DNA, 452 bp, Gossypium hirsutum
  Clone ID: uC-gsronu33B116g04b1
aagtgatattaagggtctctggaatgatgtccaaccgaggatttggtgactttgacaggatgaggcatagaagccccagtcccatggcttcttcaaacattatgtcaaatgtttctggaactggattaagcaactggaatagtcttcctcaggagagactaagtggacctcctgggatgacaatggactggcaaggtgcaccggcaagccctagttcatacaatgtgaagagaattttgcgtcttgaaattcctgtcgatacatatccaaatttcaattttgttggacgactcctaggccctagaggcaattctttgaagcgggtagaagctactactggttgccttgtatacatcagaggcaaaggatcaataaaggatccagacaaggaagagcagctcagaagtagatctggctatgagcacctcaatgatccactccacatattaatt

SEQ ID NO: 3308 - DNA, 97 bp, Gossypium hirsutum
  Clone ID: uC-gsronu33B116g06b1
ctgtattgtggattttctgcgtcagatcaaacattcgtcaatggggactttggctgtaattttaaaaattatattgcagaggctcttatgcttatgt

SEQ ID NO: 3309 - DNA, 459 bp, Gossypium hirsutum
  Clone ID: uC-gsronu33B116g07b1
gcattcctcttgatctttcttcttccatggggaatccagtaaatttggaggactctagaggaaacatctcccaagtcagtctaaataataatgtcattcagaatattgattacacaacaaagcaacaatggggagatagcagacatgattacaacggcaatatgaataattcattcagccgaggagactccctggtccctgcaagtggacctatgatggaccaaagcaatctcatcagtgataaaatgaatgatgtttctttgttcagccaatttagtggtgacagtacttatgttgttccacaccttgatggtgagaaatcagctttcgacacaaaaccaagatccaatgaggactttctatttgagacaaagccacaaaacggcttcaatcaaaatagttttgaacctttggagaatataatgatgtccatgatcaaatcggatcaaaataatgaga

SEQ ID NO: 3310 - DNA, 398 bp, Gossypium hirsutum
  unsure (1)..(398): unsure at all n locations
  Clone ID: uC-gsronu33B116g09b1
gaaatcaaatcccttctccctttttctcaaagggngggtcattgagatctttggccctcggcgtacaaccgtcatggcaggtggccggagtcgcgaaacgggcttttcagccctcgcttcacggtgtccctgaaggcttggccttctcgaccgtgggaatgagagaaaaaaggagaaagagacctctacctatccaactccggtgacggcgaagacaagttccgacaccgactcccgaagcaagcaggtgattgacatgcgccggtgatgggtcagtggcggtgatagacgcgcagcggcccggagaccaagggtctgaagcgagtggcggcagaagaccatcggtctggagctagtgcggcgcttagggttttaaaaactgaaacccttagttgact

SEQ ID NO: 3311 - DNA, 403 bp, Gossypium hirsutum
  Clone ID: uC-gsronu33B116g10b1
tgtccacgcgtccgctggccaagccttttcgccaagctcctcgagaaagtcaacgtcgatgatctcatcaccagcgttggctccggtggtggtgctgcccctgttgccgttgctgctgcttctggtgcagctggcggtggtgctgctgcggcagcccctgctgttgaggagaaaaaggaagaagagaaggaagagagtgatgatgacatgggattcagcttgtttgactagacacaattcttcccagtttggatttttcttttgttttgttgtttgaaattgcggaaaattaggactcgttttaaacattagttgaatttttgtattgggttttgagaacttttgcagagattcaagaagttacatggttaatcttacttggtttaattgattttgccattgg

SEQ ID NO: 3312 - DNA, 246 bp, Gossypium hirsutum
  Clone ID: uC-gsronu33B116g12b1
tttaagatgtctcgagaccttagtgctcttcaagaggaggactattaattgatgatcgttgttcagattgaaagatccagaattgagaaagtgcaaaaagaggctgaagtcgtaagaaacgacttaagagatcttcatctggaaaataagaagttaagaggcacaataaaaaatagtgggctgggaaagtcgtcgacagactggaaagaagaaattagcaacattcaaggcgggatggaattttgg

SEQ ID NO: 3313 - DNA, 430 bp, Gossypium hirsutum
  Clone ID: uC-gsronu33B116h01b1
ctggtgtgtatccctccagataagactaggacctactgtcccggagcttgagcacattccggaggtttgtagagacgaagtggttcaatggaacttacattcgacaacattaggagagcagctgatggggttattgtcggaagggctgggattggataaggataccatcaagaatactacatgtttggatgcaagagtaatggttgggcactactatccatgctgcccccagactgatctgactgtgggcatcgtatcacatacagatccgggagtgttaactttgttgctgcaggatcacactggtgggctgcagattaagcatgaaggggagtgggtggatgttaagcctgttcatggagctcttgttataaacattgcagatattcttcagataatgtcgaatgatgagtataaaactgtggagcac

SEQ ID NO: 3314 - DNA, 279 bp, Gossypium hirsutum
  unsure (1)..(279): unsure at all n locations
  Clone ID: uC-gsronu33B116h04b1
atttctgccaaaataatcccatggaacatcatcaacagcaaggtacatatagtggagatgaagacccaaataattctcaatgatgtggctagtaggcaaaaactgtaattcccatagttgagatgcttttgaatttttttttcccttcaagaaaatacatttagttttatggttnggacaaaattcaagttctggaacttattgaggaagctgaaaaaagttaagaagaacaaatggtcaagtacttgccatcaatgagatttttgagaagaaccctgg

SEQ ID NO: 3315 - DNA, 453 bp, Gossypium hirsutum
  Clone ID: uC-gsronu33B116h05b1
cggactcgtgggcggacgcgtgggcgcgactccttgagatacttactatctttccctcaaaaatggttactttcaggtttcatcagtaccaagttgttggaagggctcacccaacagagagcgatgagcatcctaagatctataggatgaagctctgggccaccaatgaggttcgggcaaaatccaagttctggtacttcttgaggaagctgaagaaggttaagaagagcaatggtcaagtccttgccatcaatgagatttttgagaagaaccctaccaagattaagaattacggtatctggctccggtaccaaagccgaactggttaccacaacatgtacaaggagtaccgtgacactactttgaacggagctgttgaacagatgtacaccgagatggcttctcgccacagagtccgtttcccttgcatccagattatcaaaactgcaacaa

SEQ ID NO: 3316 - DNA, 450 bp, Gossypium hirsutum
  Clone ID: uC-gsronu33B116h06b1
gcgttgccttctttccatttcttccacttttgcccgggctgcgtttagattaccccattcctccctcgattcctcgagggtatccccgtcttttcgcacccaagcttcagccgccaccgtgaccatgggtgacgctcccgacgttggtatggacgctgtccaaagacgcctcatgtttgaggatgaatgtattttagtggacgagagtgataatgttgttggccatgaatcgaagtacaactgtcatttgtgggaaaagattctaactggaaagatgctgcatagagcattcagtgtatttttgtttaacacaaaatatgagttgctccttcagcaacgatctgcaacaaaggtaacattccctcgtgtctggacaaacacctgttgcagccatcctttatatcgggaatctgagcttatttcggagaatcatcttggggtgaggaatgc

SEQ ID NO: 3317 - DNA, 287 bp, Gossypium hirsutum
  Clone ID: uC-gsronu33B116h07b1
cccacgcgttcttatacaaatacgagaacccctactgccaaatggaagattgatagagctctctcatggcgttttctactcgtctcctctacaaatctcgccggcttgacggtaatcaagctcatctgcaccaggaggttgcacactactgtccggctttactctagagaggcctctacccctggcactggcggagatgagacatcgaaaaatctgtgaaaacccggtcagaacccaacctagacagcattgggaatattcacgatggagcaaatcgccattgaccc

SEQ ID NO: 3318 - DNA, 361 bp, Gossypium hirsutum
  Clone ID: uC-gsronu33B116h09b1
tccattcgtccgcccacgcgtccgttcaacgggaaggtttttttcaagtagattcatcccccaaaaacggattcagaaaattcatgcacggctagcatcctgacatacacctcgtaacagaaaatacagtcgatgtaataatactcgggaagaacgcggttcatatttgttcaagatgtgcaataaaatagtggttagaaaaatgttatcatgtagttaggacaagttgaagatttaaactagttagatccctctcttttctactggcaaaaagttcaattgtaaacccaaaaaacataaattttgtttcatctctttaatggcagcttttttttaataggctttgatgccatgttgccat

SEQ ID NO: 3319 - DNA, 444 bp, Gossypium hirsutum
  Clone ID: uC-gsronu33B116h10b1
gtctttgttctagatcgcgagcggccactcctgggggaaggtacaaattgtgcctgtgaaatggcaactaccaggcaacatcagggccaagtggctggaagggttcaccccacagagagcgaggagcagcctaagatctataggttgaggctctgggccaccaatgaggttcgggcaaaatccaagttctggtacttcttgaggaagctgaagaaggttaagaagagcaatggtcaagtccttgccatcaatgagatttttgagaagaaccctaccgggatttagaattacggtatctggctccggtgccaaagccgaactggttaccacatcatgtacaaggagtaccgtgacactactttgaacggagctgttgaacagatgtacaccgagatggcttctcgccacaaagtacgttttccttgcatccagattattaaaact

SEQ ID NO: 3320 - DNA, 302 bp, Gossypium hirsutum
  Clone ID: uC-gsronu33B116h11b1
tctcttgctttctctggtgccctttattttcaggggaaggtgattgttaaccagggcatatgtgttccagacgaaattataatagatttactgtccaaacggtcttgaagcacgagaagctaatggtgaatcatggttcattcttgatggtctttctcgcacagtaagacaggcggaaatattaaagggggtgacagacattgacttactgattaacctgaaactatcggaagaagcattgtttgcataatggatagtaagaagaagctcccttgcgtgtggagggaactatgatgtgggct

SEQ ID NO: 3321 - DNA, 409 bp, Gossypium hirsutum
  Clone ID: uC-gsronu33B116h12b1
tcttctgagggtgttaaggaaggcctcacaagtgtatcggtgggagggactccaccttgatttttgatcgcagatgatggttggcagcatattgaaagtaagcccaaggagagtgattgtgttgtacaagaaggggcgcagtttgcgagtaggttgactgggattaaagagaatgcaaagttcaaaaagaatgaccaaaacaatgaacagatctctggcctaaaacatgttgtagacgaggccaagcagcgtcataatgtgaagaatgtgtatgtgtggcatgcttaggctggctattgggggggagtcaaacctgcagctgctggtatggaacattatgatacagcatcggcatatgctgttcagtccccaagggtgatgggcaaccagccggatatagttatggaca

SEQ ID NO: 3322 - DNA, 130 bp, Gossypium hirsutum
  Clone ID: uC-gsronu33B117a01b1
cggacgcttgggattttatggatccacgcttggtatgtaggcaagcttaagaaaaaaggaacgaggggaagaatcgacaaggaatccataacaaaaaaaaaattgtgaatgaaaaaaaaagcgtgacgag

SEQ ID NO: 3323 - DNA, 439 bp, Gossypium hirsutum
  Clone ID: uC-gsronu33B117a02b1
gaaaatgctatcatttttctcttccccttcaccgaaatatgcagcaattaaagggttttgaagctggaaaatttcagcaacatatttcccttgcttagtttccaggttagctcgggttggaggccgtcagagatattatcaccctatcgagttaacgttatcggaataagtaaactcaagtgattcgagtctatggcatgtatagggttttaatgtgagtatgtaatattatgatttagccaaaggcattggcttgttattaaggtagtattagtcatgtaaattggcctatgtcggctaatgacgctatgggcccatatgattattcttatgcatgtatgttattatctcttgtgatgtggcttacaacatgtatgcctagagattgaattgggattcattgatgagctagtaactaatgcaggattaagtgattggt

SEQ ID NO: 3324 - DNA, 464 bp, Gossypium hirsutum
  Clone ID: uC-gsronu33B117a03b1
cccactcgtccggctaccttaacacaagttacaaactcaaaaaccccaagttctcactttcaaaaaacttcccacattcaccatgtctgacaggtgcggcaactgtgactgcgctgaccgcagccaatgcacgaagggaaacagcaacaccatgatcattgagactgagaagagctacatcaacactgctgtgatggatgctccagctgagaacgatggcaagtgcaagtgcggtactggctgcagctgcacagactgcacctgtggccactaagccaacatacaatggtcatgcttcaggtcatggcatatatagggatctaaataatgaatttaaggttgaataatttgtctgttgtagtttgtgtggtgacttatatctgtcagttaacctttgtatcctttactatgatgtaatggctatgcttatggccttatctggttaatgaagtatccttactatt

SEQ ID NO: 3325 - DNA, 503 bp, Gossypium hirsutum
  Clone ID: uC-gsronu33B117a04b1
attttaaactacctgcttttagctctccttttgaatcaatcggcatttttggcttttcgtaaagtgaaaggatgttaggcattttcaagaaagaattaatgaatcctccaaaggagctgcatagcccagcttcactcacttcatcaaacaagcccaagcttcccaatcaaatcatcaaccatttcctttcttcaaatcccaacaatgctttctcaatggggttcggatcctcagcttgctttgcttatgctcccacagagaatcgtttccccagtcatcaaaggttgttttgtggagtggatgaaatatactgcatattcttgggggatttgaataatttgagcagcctgctaaagcagtatgggctgtcaaagggcaccaatgaagccatgtttatcatcgaagcatattcgaccctccgagaccgtggtccgtaccctgctgaccaggtccttaaggatcttgaaggcagctatggatttgtggtgtatgatagcaaaact

SEQ ID NO: 3326 - DNA, 542 bp, Gossypium hirsutum
  Clone ID: uC-gsronu33B117a05b1
ctcgttgagtcgtttctctcttcagcgtccagacagtcagagatcctctcaatcaaacaacaatgacaaagagaaccaagaaggctggaattgttggaaaatatggtactcgttatggtgccagtttgaggaagcaaattaagaagatggaggttagtcaacacagcaagtacttctgtgagttctgcggaaagtatgccgtgaagagaaaagccgtcggtatctggggctgcaaggattgcggaaaagtcaaagcaggctgtgcttatactttgaacactgctagcgctgtgactgtgaggagtaccatcaggaggctgagggagcaaactgagagctgagcaaccactggtgattgatttgtattctactttcataggatgttgttttgcatgttctagctatgagacttaactgagactttcttttgacaatgatgttcgtactatgagttctcattgttatatctgagtcttgttttagaactttatttaagttcaattatttgctccattcgacattatcctggtaacttcacatgc

SEQ ID NO: 3327 - DNA, 373 bp, Gossypium hirsutum
  Clone ID: uC-gsronu33B117a06b1
agaattcatgaaaccaagctacaaggcactgttagatgttgatgttgaaatgaaacaactggtggctgagcatgggagacaatatcgtgttgaatatgcgaaaaatgcgatgatacgacttgctcagtcttaccttgtggaagccagatggactcttcaaaactacaaaccatcattcgtggagtttaaggcaaatgcattgccaacttgtggatatgccatgcttgctattacatctttcgtcggcatgggagatatcgtaacactagaaacctttaaatgggcagtcaatgatcctaagatcattcacgctttcacaattatttgtaggattatggatgatgttgctgaacacaagttcaagcataggaga

SEQ ID NO: 3328 - DNA, 571 bp, Gossypium hirsutum
  Clone ID: uC-gsronu33B117a09b1
ttcattcgtccgcccacgcgtccgaaaaaaggaaaaactagcaaattccgcaaggcaatcgacttccattagggttcttcgattccgattttacagaacttttatcgaatttgtgaaatttcatcttcaaaaccctagtttctgctaatatcttattgattcaacatggctactgcatcagtggcgtttaaatcaagggaggatcaccgaaaacagctggaattagaggaagctcgaaaagcggggcttgctccggctgaggttgacgaggatggaaaagaaattaaccctcatattcctcagtatatgtcatcagcaccttggtatcttaacgctgaaagacctagtttgaaacatcaacggaagtggaaatctgatcccaattataccaaatcttggtacgatagaggcgcgaagatatttcaagctgaaaaatatcgaaaaggagcctgcgagaactgtggagccatgacacatgatgcaaagtcatgcatggagaggcctcgtaaaaagggcgcaaaatggacgaacatgcacattgcacctgataaaagatagagactttcgaact

SEQ ID NO: 3329 - DNA, 510 bp, Gossypium hirsutum
  Clone ID: uC-gsronu33B117a10b1
gttattgactctggtgatggtgtcactcatgtggttcctgttgttgatggcttttcatttccgcatctcactaaacggatgaatgtagcgggtcggcacataacatcctatcttgttgatttactctctcgtagggggtatgcaatgaatagaactgctgattttgagactgtcagggaaatcaaagagaaactctgctatataagttatgattacaaaagggaatatcaactgggacttgagaccaccatccttgttaagaattatactctgccagatggaagagttattaaagtaggcactgaaaggttccaggctcctgaggctcttttcactccggaacttattgatgttgaaggtgatggaatggctgacatggttttccgctgcattcaggagatggacatcgacaaccgcatgatgctctaccagcatatagttttaagtggagggagcaccatgtaccctggattacctagtcggctggagagggaaatcctagaacgatat

SEQ ID NO: 3330 - DNA, 475 bp, Gossypium hirsutum
  Clone ID: uC-gsronu33B117a12b1
ttcacgcgtccgcgagaggagtttacatgatgctttgtgtgtggttaggtgtttggttagcaagaggtttttgattgccggtggcggtgctccggagattgaattgtccaggcagcttggtgcttggtctaaggtgatgcatggtatggagggctattgtgcgaggtcatttgctgaagcactggaagttattccttacacattggctgaaaatgcccggttgaaccctattgctattgtgactgagctgaggaatcgacatgctcaaggagagatcaatgctgcgatcaatgtgaggaaaggacagattactaatatctttgaggagaatgtagtgcagtctttgcttgtaagcacgagtgcaattacactggctacagagtgtgtgaagatgatttttaagattgatgatatcggtaatgctaagaaattacatgctctggagatgatatgtggttctctaggtatcttttgc

SEQ ID NO: 3331 - DNA, 594 bp, Gossypium hirsutum
  unsure (1)..(594): unsure at all n locations
  Clone ID: uC-gsronu33B117b01b1
ctagttactacagcagaaggtgataactctcctgatgctgtaaatgatgagaagaatgaggaaggttatataggtgaagagactgttgccgaaggatctgaaaagtcgaatgatggtaatgagcagagtgtagtggagacggatccaatgcctgaagccgctgccgctgccgctgccgctgccgctggcactaatgagagtggcacaacaagtggtacacctgagggtgaggtctcaaaaaaacgtaggtagttcaagcggtgcagcagcagcagaagcagaggatgtgaagcagatgtctcccataagtgggactgggagcgggagtggaggtagtgcaacctcaacgttggtaaatcttcaagagagagccagggaaagagcaatgttaagacaggcaggagtactgggttctactacttcaggtagaggtcgtggaagggttgcagtgcgtgctcgaagtgctaggaggcgcantgcgcgtggtggacgagcaggtggtggaccgcaaaattctgatcaacagtgacctatnatttgtatgcttgagactggagaggtaagaatagagaagatgaaatgagatgagaggat

SEQ ID NO: 3332 - DNA, 559 bp, Gossypium hirsutum
  unsure (1)..(559): unsure at all n locations
  Clone ID: uC-gsronu33B117b03b1
cccactcgtccgaacaatagcaaggcagttagggaggcaatgtgcttcttgatggacccacaagtcggtcgagatgtctgctatgtgcagtttcctcaaagatttgatggcatagataggagtgatcgatatgccaatcggaacacagttttctttgatgttaacatgaaaggtcttgatgggatccaagggcctgtttatgtgggaacaggttgtgttttcaataggcaagcactttatggctatggtccaccttcaatgccaagttttcccaagtcatcctcctcatcttgctcgtgttgctgccccggcaagaaggaacctaaagatccatcagagctttatagggatgcaaaacgggaagaacttgatgctgccatctttaaccttagggaaattgacaattatgatgagtatgaaagatcaatgttgatctctcaaacaagctttgagaaaacttttggcttatcttcagtcttcattgaatctacactaatggagaantgaggagtggctgaatctgccaaccctttcacactaatcaaggaagcaattcatg

SEQ ID NO: 3333 - DNA, 505 bp, Gossypium hirsutum
  unsure (1)..(505): unsure at all n locations
  Clone ID: uC-gsronu33B117b05b1
ctaaatactaaaagcgattttggatctggaaaggcgaagctgagggtgaaccatgagcggcgatactagtgattcctccagttactttgatgggcgagagccagatgaactgatcagggccatcgtcgagaaacggccgggtaccgatggtaaaataacgctcggtttgcactttattgatctggaaagcaataaagtctttattaaggcgatgccacctgctgctccttcatgttccactgccgtttcctgtggcaaccgcgtttacgttattgggggaatgcgcgaaaatgatgctaattttcgtggttatgatggagtaaacgatgttttccaattagatttgaaggaccttgaacgtgggtggagaaaaactacttctatgttgttccctcgggcttatccccatgttcttgctgctgaaggaatgatttacgtcttcgaatgtatgggttctgaatcttttggcgaggtttacgatataagtggngatatttgggaacca

SEQ ID NO: 3334 - DNA, 480 bp, Gossypium hirsutum
  unsure (1)..(480): unsure at all n locations
  Clone ID: uC-gsronu33B117b06b1
aaacttaacccgtagacaacattcttgttacattgggactttttttcctgccaattcttacttgatctcaaagtttaggtactctcattagcaggaattggtctttagctgtaaaggtgatggtgttaatttccattttccatcatcattaattcactttgtaaagaaagaatttagacttaaaatgaaaaaaaaaattgtagactaatggtctgtgacataacagaggtaatgagttactcaaaaattacaaatcaagtactttgtctaacagatcatctgggaagaagggaagggaatgaaggcttagatttagagaatttaggaagtgtaggttcggtcaattgggtcagatgatgtggcatagaatgtctctttctttttttcttttgtactgtatttaccttgatgtgccatactntgagtgatggaactatgaaaagctttttggattaaacatgatcccttaccttctctttt

SEQ ID NO: 3335 - DNA, 304 bp, Gossypium hirsutum
  Clone ID: uC-gsronu33B117b08b1
ttcattcgtccgcccacgcgtccgaaaccaccatcctgtggaaaccatgaggggaagcccatgtttgggatgctgtttccatggtagaaagaaaggaaagagccaaagtgtttgttttgtcccctccagtgggatacactcatttcattgcacttagtaattaggtcatggttgcccttgcttggatttgaggtagaaagggttgtttctactgctttcttgcaattacggttaatcttgtgttaaataaatgagaatgcttttattattattaataataatgaagggctagattttgagtttc

SEQ ID NO: 3336 - DNA, 538 bp, Gossypium hirsutum
  unsure (1)..(538): unsure at all n locations
  Clone ID: uC-gsronu33B117c03b1
gaactgtttcttacttcctaatgaaaggcttctggcgaccctttgctaggcttgggggtgctaggagctattcagtgttaagcaatgatcaactgagaattaacggggttaaagatgtaattgctgttgcttctggtaaaggtggtgtaggcaagtctaccaccgcagttaatttggcggttgcattagctaacaagtgcggattgaaagtgggcgtgcttgatgcagatgtgtatggaccatctgttccaaccatgatgaacatccaccaaaagccagaagttaataatgatatgaagatgattcctattgaaaactatggagtgaagtgtatgtcaatgggattcctggtggataaggatgcaccaattgtctggagaggccccatggtgatgagtgctcttcagaaaatgtcgagggaagttgcttggggagttcttgatatccttgtggtggatatgccccctggcacaggtgctntaatagtttcaaccccacaagatgttgcactgattgatgctcgtagaggagttagaat

SEQ ID NO: 3337 - DNA, 507 bp, Gossypium hirsutum
  Clone ID: uC-gsronu33B117c04b1
aatgtagctaatctgcaggcagcatgggatctcccgatgggcattttttaagatcaatattgtcaaccgttccctcactaagctaaagcatgttattgaatctgtccaaggtgctgatgaagcatttgatttaacttcacttgccacaagttcactcccagctgctgtaggttccatttcatggacaaccggtttgaatggttcccatcaacaaaacttaacaaattccaaaccttcctagcctgaagttgacaaaaacgatttgcccacatgtgatatgccaggaagtaacacacaaggtttggcggatgatcagttgctgggagggaggacattgatccaagaacaacttttccctcaccataatgggctttcaccaagcttggataaaggggcaaacagattcaaaacagggagtggatctagagacgagagtgctgagacacctacttctcatggatcatgccaaggtagccctgcaactgaaagtgccgctactaaggatcc

SEQ ID NO: 3338 - DNA, 337 bp, Gossypium hirsutum
  Clone ID: uC-gsronu33B117c05b1
cccattcgttcgggcggagaaacgcgccgttaacggcggagaatgctatgagagtgagggaagcgatgcgtggggttgcgttcgctggattgactcctgattgggccaatcaaattcccgaggaccggtggatcgatcagcttcggcggttgaggcaaccgcaacgcccttccagtacggtttaaaaccatctttcctagattttgggtcaatttcaatgcttttttttcctttttgaattttggacaaatctctggcaaattatagatctttatctgtccttttggcaaaacatcagcattaaagaacaattgctcagttggatcaattctgttcc

SEQ ID NO: 3339 - DNA, 555 bp, Gossypium hirsutum
  Clone ID: uC-gsronu33B117c06b1
cccattcgttcgcttcactccacatctcatattccttcatttctctctaaatccttccattttttgatattttttttgtaagtaaaggaacagtgaaaagcaacaggaaatggcaaatatagatatcgatgggatcttgaaggagcttcccaatgatgggcgtatccctaaaaccaagatcgtttgtactttgggtccggcttcacggtccgtacctatgatagagaagctgttgagggccgggatgaacgttgctcgcttcaatttctctcatggcagtcatgagtatcatcaagagaccttggataatcttaggtctgctatgcacaacaccggcatcctttgcgctgtcatgcttgacaccaagggccctgagattcgaactggattcctgaaggatggaaaagctgttcagctgaaggaaggccaggaaattactgtaacaaccgattacgaaattaagggagatgagaagatgatctgcatgagctacaaaaaagctgctgttgatctgaagcctgggaataccattttgtgtgccgatggtacaatcac

SEQ ID NO: 3340 - DNA, 513 bp, Gossypium hirsutum
  Clone ID: uC-gsronu33B117c07b1
gtaatgggaacttcgcagggaatgattgtatgtttctcaatgcacataatgcacctcaggagagtttggtggttgcgattggatctgaatacatcccaccaaagatcctacgaccaagattcggaaacagagagcagcaggcaagctgggtgaacgtaaatgaccgaagacacgtgtatggtgacggacacgtgatgataatgagatcgcgggatcaaagaagggcaaaggtgttgtgcagcatagaagtgtgggggataagcctaagaagtgggaattgggagtatgtgtcaaatgtcccgagtgagataatggagcaaatagggaaaccttacggggtgatgatagggtgtttagaggcgagaaatgggagaattcgggtggtgttgatgtcgaattacgagggctcatgggacattatttggctgacttaccatcaacagagcggcgtatggaattgggtgttgttgcctgattgcaagaagaaaggggctaacttggctggaatcacat

SEQ ID NO: 3341 - DNA, 494 bp, Gossypium hirsutum
  unsure (1)..(494): unsure at all n locations
  Clone ID: uC-gsronu33B117c08b1
cgttcgctagcttttgatatcctctttgccattttggtgtcttttagggttctaattggtacatgttggatgaaggtgagggagatgatgaacatggaattacctcgcggaattgagggaagatttcaaggccaagtctttaacggttatatcattgcacaggccaagaatggttttgcatacgagccatgggcttaaataattggagcaaattatgaagacgatgatcttggtttcgaggaactattaacctctaggcaagtctaatgcttggcttatcctcctgtctctgggttttcttttggtttttttttttggctgttcttgatagtgtttggttgctgagaaaatggaggatattatatgaataagatttggaaacttgacttcatctaagatttacacgacttctcttctttgaaacactattgtttttttagcaaccgaacaggtttttaaatatgtgaatgacatagtttctnggtcataattta

SEQ ID NO: 3342 - DNA, 434 bp, Gossypium hirsutum
  Clone ID: uC-gsronu33B117c09b1
cccattcgtccgggaaattgaaggcatggagtaatgggaggttgtaatcagtaaatcacagagtgatgatgagcggagacaaagatcgatactctatagcagcctttgtcattccaaatgagggtactataatcaggacacccgaagagcttatagatgaccaacatcctcggcttttcaaggacttcgatttcatggatttcttcctttttgccttttccgacccagcaaagcacatcgacaacggggagttgctccatgtctttgctggcctctcaccaccagtttccaattaaaatcatgcccatatcgacaagtaaaatccagtaaaatcaatgttacaaataataaactgagttctatactcgagatttgcgttcttgtattgtactactatgttatggttagtaataattttataattgtattgtacc

SEQ ID NO: 3343 - DNA, 491 bp, Gossypium hirsutum
  Clone ID: uC-gsronu33B117c10b1
gtttgtctttgctggcctttccaaatcagcggacacccttttcaggtacatcactgctgaacaagtaccggtcaaatatggaggactgagcaaagacagtgaattcgccaccaccgaaactgttaccgagataactgttaaatcagcggcaaaacacacagtagagtttccagttactgaggcatgccttgtcagatgggaggtaagagttattggatggggtgtgagctatggtgcagaattcgtacctagtggtgaaaacagctatgcagttataatccaaaaggctaggaaggttgccgcctctaccgaggaaccggtggtgtgcgacaatttcaaggttggcgaggctggcaaagttgttctcactatccacaatccctcttccaaaaagaagaagctcctctatcgcttcaagtcccaccctactacatctcactagttttattcaaggaaattaatatcacacaaggcattcacatacataacca

SEQ ID NO: 3344 - DNA, 355 bp, Gossypium hirsutum
  Clone ID: uC-gsronu33B117c11b1
ttttattacattttgctattctaggctttttagctaccaatcacctccaagttcctcactgaattttttttacctcgtgattttgatacacttgtgtttttcatgattgcattattgctataatcattttttttaaaaaaaaaaaaaaaaaaaagaaaaaaaaacataaacaaaaaaaaaaaaagaaaaaaaaaataaaaaaacaaaaactacctaaaaaaaaaaaaaaaaaaaatatatattataaaaggaaatcaataataaatacaaataaacggggggggcctctttatagaatcacataattcttccccggcctagcataatacaaacattttttttattgggccccaaa

SEQ ID NO: 3345 - DNA, 516 bp, Gossypium hirsutum
  unsure (1)..(516): unsure at all n locations
  Clone ID: uC-gsronu33B117c12b1
ttaaataactaaaagagagagtaagagactgctattagagaaacaatgggagaccaaatgccatgtgcagctttgtctaatgtatggaacaaagtgaaaccattcttggcaatcatctccctgcaatttggatatgcagggatgtatatcatctccttggtttctttaaagcatggaatgagtaatttcatcctttgtacctatcgtcatgttgttgccaccattatcattgctccctttgcctttgttctcgaaaggaaaatccggccaaagatgacccttcctatcttcctcaggattgtggttcttggtttgctcgaaccagtacttgaccagaacttatactatctgggaatgatgaagacaactgcaacatattcatcggctttcgtcaacatgcttnctgctgttactttcatattggcaatgatttttaggttagagaagatcaatttgaaaaaagatatacagtgtagcaaagatcattggaacagcaatcactgtgataggggcaat

SEQ ID NO: 3346 - DNA, 564 bp, Gossypium hirsutum
  Clone ID: uC-gsronu33B117d03b1
tttgtatttagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaggtcacgtttaggaccaaggtcttccatcctaacatcaacagcaatggaagcatttgtcttgatatcctcaaagaacaatggagccctgcactaaccatttccaaggttctgctctcaatctgctcgttgctgaccgatccaaaccctgatgaccctcttgttccggagattgctcacatgtataagactgatcgggccaagtatgaagccactgctcgtagctggacccagaagtatgccatgggatga

SEQ ID NO: 3347 - DNA, 570 bp, Gossypium hirsutum
  unsure (1)..(570): unsure at all n locations
  Clone ID: uC-gsronu33B117d05b1
ctgatttattttaagaaaacatttccttagagcatagaagaaaatttacgaacatgccgggtgtcaatcctgaaattgagttcccagccattgagttccgttcatcggatttgaagcgaggaaccgaagggtggaaccgtttgtgcaagagggttcaacgggcttgtgagactttcggttgtttcgaggtggtatacgaaaaggtatccacgaaacttcgagaggatgcgtttgggttgatgaaagaaatggttgagctcccagtggagacgaagcagaagaataatagtcccatgccttaccatggttgggttggaccttgcaagcaggtttctgtgttgtatgaaggctttggagttggagatgcctccaactatgactctgttaaaagttttgctcaacttatgtggcctaatggtcacccacacttttctgacactattcataccctagcgacgcanatggaggatttgaacaagttaatttggttaatgttaattgatagttatggattaggggatgactcattgaagatgaactacnacaacgtagtgcggatgatgaaatata

SEQ ID NO: 3348 - DNA, 521 bp, Gossypium hirsutum
  Clone ID: uC-gsronu33B117d06b1
cccattcgttcgcccacgcgtccggtcttgcttcaaatgcagtcattgcaaagggacactaaagttgggtaattactcctcgatggaaggtgtcgtttattgcaagcctcatttcgagcaactgttcaaggagtcggggaatttcaacaagaatttccagtcacctgcaaggtcagctgagaagttaactcccgagctgacaagatcacctagcaaagccgccagcatgttttccgggacacaagaaaaatgtgctacttgtggcaaaactgcttatccactcgagaaggtaacagtggaaggacagtcgtaccacaagtcatgtttcaaatgctctcatggtggctgccctataactccatcaaattatgcagcacttgaaggcattttgtattgtaaacatcacttctcccaactttttaaggagaaaggaagctacaaccaccttatcaagtctgcatcgattaagcgcgcagctgcctccgttccagaagcttaaatccgtgtgttaatatccatat

SEQ ID NO: 3349 - DNA, 64 bp, Gossypium hirsutum
  Clone ID: uC-gsronu33B117d07b1
gttattagattgtgtgtgaagctctatgttctatatgtgtgaaaaaaataagtgggtcgttatg

SEQ ID NO: 3350 - DNA, 309 bp, Gossypium hirsutum
  Clone ID: uC-gsronu33B117d08b1
gtgattgcaaaagctactaagtacaatgcagctgcatttatgccttttggattgggacctcgatcttgcgtaggcatgagctttgcaatcactgaagtgaaaactgcactttccatgattctgcaacgctatactttcaccgtctcccctacctatgttcacgcacctgcaccacgtctttcactcaagccacaacatgggattcagttgttgtttcattcactacattatgatgcttaaaattctaggctgttggtctccaatattgtaatatataataaaatgtggatgatactgtattttgcaacc

SEQ ID NO: 3351 - DNA, 281 bp, Gossypium hirsutum
  Clone ID: uC-gsronu33B117d09b1
cccactcgtccgaggggagggtatgagcaaacaatctcttagtcagtagttatgtgttttgtatatggttgattatatcaagtgtggatagtgaggttttgaacactaagttctgtccatggatgctttgcctagcaacctaagtgatgtctattgatttagaacatcaaaaacaagttcatgcttttaaagaactgtctatgttatgtttcttattgtgactgcttttaagtgatttctggttaaatggtgaacttttaaatctttgtttatatattttt

SEQ ID NO: 3352 - DNA, 423 bp, Gossypium hirsutum
  Clone ID: uC-gsronu33B117d11b1
tgtatgcttcctctcattagtcccccgactgtgcacgtgttaagacatcaatgggcatatacttgtgacaaggccaaactggagttggattatagacctagaagcttgaaagacgggcttgaagaaatgctcccctggttgaagagcttgggcgtgataaaatactaattactaatatgaattatgaagatgtacgaacttgatctcattctttaggccattgagaagtattccattaaatgctgagaggaatctatgttgttccttctgtttcatgcttgatgtagctttagccggtaatggcagtaataagaaactggttggcttgtttctttgtgttcaatgttgatgaataaggatcactgttgtacgatgattatgattcaggaattcttaatgaaatacttgaagctcatttgtatt

SEQ ID NO: 3353 - DNA, 276 bp, Gossypium hirsutum
  Clone ID: uC-gsronu33B117d12b1
ttaagggataaaatctcaagaaatcctccaaattgtgatctgaatctttgaagggatatgtaacttccataatttgttgtagaaattttttgtctcggtatgtaataataaatcattaggatccagattagaatcatgtaatagtttataggcactcctcacgagaactcccctgtcggttctcctctccgtgcttgaaaaccttcttgttctgtcttcgcaaaagggatttgtaaaatttgctctgcaacatctggttgaaaggtatttcttatc

SEQ ID NO: 3354 - DNA, 505 bp, Gossypium hirsutum
  unsure (1)..(505): unsure at all n locations
  Clone ID: uC-gsronu33B117e01b1
gagattcttttctggtgcaatcatccacatgttcctgcatgtgcttcgtttgttgagatattggctcccgtgttttcacgagacacatggcggtgcgtatggcatatgattcagaatgacttggtccatggctggggtcttgattttgccctcagaaaatgtgtagagcccgcccatgagaagataggtgtagtagattctcaatggattgttcatcaatccgttccctctcttgggaaccagggagagtcattagatgggaaggcaccatggaaaggggtgagggagaggtgcaaaaaggaatggagtatatttcaaacgaggttttcaagggcggagaaagcatacttgaaggaaataaattcaacatctcattaggaatatatatatatagcaaagcaaaactagaaaagctaaccctatcattattagttattaccccacccccgcattgngatttcatcggatcttccagtattcattcacaaaacctcactcccaatac

SEQ ID NO: 3355 - DNA, 159 bp, Gossypium hirsutum
  Clone ID: uC-gsronu33B117e02b1
gttcatgctgtgattcttcttccacttcttttccaggcatggtgtttggggtttgttttgaagtcgcagccagagacgactctacccgtaccgtgctgtgctgtgctggtgactgtgtcaatggttaaacaatgaataatattatttgcaatgactgcg

SEQ ID NO: 3356 - DNA, 265 bp, Gossypium hirsutum
  Clone ID: uC-gsronu33B117e04b1
cccattcgttcggtttactggcttgcatctcttcacggcctggtcaatgcggccgtgctgatggatatatcttggagggcaaagagctggagttttacatgaagaagatgcagagaaagagggggaagggagctgcctaaaattttgttgcttttgagtatttcatcattaagatcaaaatgtccttttttttttgcctttcaccatttgagaacatttgaaattgtgttagttttgagctttttttttttttagtttgaatatt

SEQ ID NO: 3357 - DNA, 538 bp, Gossypium hirsutum
  Clone ID: uC-gsronu33B117e05b1
cccattcgtccgaaaaaccaaacacccagagttaaccaaaagagaaaatggtcaccaaagtctacattgtatactattccatgtatggacatgttgagaaactggcccaagagatgaagaaaggagctgaatctgtcgagggagtggaagtcaaactttggcaggtagcagaaacactaccagaagaagttcttgggaaaatgggagcaccaccaaagacagatgcccctatcataacaccagatgagctgacggaggcagatggtgtgctatttgggtttccaactagatttgggatgatggctgcacagtttaaagcattcatggatgcaactggtggtctatggagaacacaagcccttgctggtaaacctgctggcattttctacagcactggctcccaaggtggtggacaagaaactactcccttaactgcaatcactcaactggttcaccatggaatgctatttgtgcccattgggtacacttttggtgctggtatgtttgagatggagaaagtgaaaggtggaagccctta

SEQ ID NO: 3358 - DNA, 190 bp, Gossypium hirsutum
  Clone ID: uC-gsronu33B117e07b1
tccattcgtccgcccacgcgtccgggtaatttgagttttgaggtgaaaaatcataaaattgtttctttggagttgaataatgtaatttaaattaccaaaataagttcactttgaggcaatataatcaacatactatcatgtattgaatatttgaagtatttcacacgatatttattttatgaggtttggt

SEQ ID NO: 3359 - DNA, 512 bp, Gossypium hirsutum
  unsure (1)..(512): unsure at all n locations
  Clone ID: uC-gsronu33B117e08b1
tttgtatatgctgttgtgcaaaataatggtgagccaggctgatgatgttgctggtataatatcatcaaaagctgggcttcaatacgtggggcctgaacttgatgccatgaaagctgtcgctgatgcccatgcaaaacgttccctgaagcttttcgagattgctcttcgtgatttcaaggctcaactagaggaagatcctattgtccacaggcacctttcttccctctatgacactctactggagcagaatctctgcagattgattgagccattctcaagggttgagatcgctcatattgccgaactcattgaactgcctgtagaccatgtggagaagaaactttctcagatgattntagataagaagtttgcagggactctggatcagggtgccggatgtcttgttatatttgacgatccaagaccgatgccatctaccccacaacattggaaaccatctccaacattggcaaggtcgtagacagcctctatgtcaggtctgctaagataat

SEQ ID NO: 3360 - DNA, 514 bp, Gossypium hirsutum
  unsure (1)..(514): unsure at all n locations
  Clone ID: uC-gsronu33B117e12b1
tccacgcgtccgcggccatgtacaggaagcaacacaggatggacattgcccaagaagctgtgaagaagaggagacgtactgcaaagaagccatactccagatccattgtgggtgccaccttagaggttatccagaagaagaggagtgagaaacccgaagttcgtgatgcagccagggaagctgctctccgagaaatcaaggaaaggatcaagaagactaaggatgaaaagaaggcaaagaaggcagaagtagcagcgaagcaacagaagacacaaggcaagggtaaccctccaaagggtggtgcacccaaaggtcccaagcttggtggtggtggtggaaagcgataagtttacccagttattatctgtttttacataggtagtatgttgattttgaaggcatttgtatggactgaatggccatcggccgtgtatctttntttgctttctatgcgttatcattaaaccttgaactctgtattgaagatgagtgatcaagttattttatgcttgac

SEQ ID NO: 3361 - DNA, 390 bp, Gossypium hirsutum
  Clone ID: uC-gsronu33B117f02b1
atgcattttatgtttgtaattgtattgatgagatgaaccgtaattttctttgagtttttttaattgcattttttttgcttaaaaaaaaaaaaaaaaaaaaaaaaaaaaaaaaaaaaaaaaaaaaaaaaaaaaaaaaaaaaaaaaaaaaaaaaaaagcaaaaaaaaaaaaaaaaaaaaaaaaaaaaaaagggggcggccgtttaaaagaaccaaagttaacgtccccgtgcatgcaacgtaaaagctttttaatagggccaccaaaattaaataaactggccgcggtttaaaaaagtcgaaactggaaaaaccctggtttaaccaaactaaatcgctttgaaaaaaaacccctttttccaaactgggaaaaaaccaaaaaggcccaaacca

SEQ ID NO: 3362 - DNA, 504 bp, Gossypium hirsutum
  Clone ID: uC-gsronu33B117f03b1
cgattatactgtcacaaagttgcttttctaaaaggagtgaaagcatgaaaaaattcgattaagagatagaaagatggcggtgatgcagaagctgaaaatattcgtggtgcaagagccagttgtcgcagcttcttgcctcatcgctggttttggtctctttctaccagctgttgtaaggcccattctagattccttagaatcatcgaagcaagtccctcagcctgctttaagagatgtggttgctggtgtgactggtaaaaagcagggctgatgtgatttatgagttgggaagaagcagacactcaaatgtagctagtaatcagcaacaaaataaacttgactttaaagttgaactcttgcgccttcaacttcatctttagcatgaggaatttgagtgttaatttgttttgattttcagtggtggaggattactcaaaaatcatggatgattcatatcagactggaatttgatatcatctactttaatttgttccctacaattaa

SEQ ID NO: 3363 - DNA, 145 bp, Gossypium hirsutum
  Clone ID: uC-gsronu33B117f04b1
ggcgtctttctggagcgtaattcccaccgagcggcgggtagaatcctttgcagacgacttaaatacgcgacggggtattgtaagtggcagagtggccttgctgccacgatccactgagattcagccctttttcgcttcgattcgt

SEQ ID NO: 3364 - DNA, 491 bp, Gossypium hirsutum
  Clone ID: uC-gsronu33B117f05b1
catttcttaattatggcttaccagttccagtgtgaaaatactagtggctcagtagaggcatcagagagaaatgttgcccacattggggctgataaactttgttaagcttggataggttggcaagttatctcgagatctgaaagcatcaaattgtcatggcttgctcacgactgcatgcttgattggcatgcacagttcaaattgactgtaaagaacgaggggttttctgttggtggtctgcaattgaatttgttcacaccaagtggctattgttctatggttgcaataagatcttttttggaatgagtgactaaggttggtttatctgaatatccaagatgattttatgtttggttgatttgttactcgaaatatttgtctgcctgccccgaaaaggattacacaagtcgagttaagagagacatttgagatcttatcatctataatggaggtgaggtgcctgtggtctgtgggtccttgcaaaccatcat

SEQ ID NO: 3365 - DNA, 602 bp, Gossypium hirsutum
  Clone ID: uC-gsronu33B117f06b1
gtctgttgtgatgcaccatgaatccctcccggaagctttccctggtgacaatgttgggttcaacgttaaaaacgttgctgttaaggatcttaaacgtggttttgttgcttcaaactccaaggatgatccggccaaggaagctgccaacttcacctctcaggttatcatcatgaaccaccctggccaaattggaaatggttatgccccagtcctcgactgccacacctctcacattgctgtcaaattttccgaactgttgaccaagattgacagacgatctggcaaggaactcgagaaggaacccaagttcttgaagaacggtgatgcaggtatggtaaagatgattcccaccaaacccatggttgttgagactttctctgaatacccaccacttggacgttttgctgtccgtgacatgcgccagactgttgccgtcggtgtcatcaagagtgttgagaagaaggacccaactggtgctaaagtcaccaaatctgctgccaagatgacatgagagattatttgagagagaattatatcaggtttcattacagctttggacaataatcttaaattggactttagatttacttttgtgagacttt

SEQ ID NO: 3366 - DNA, 528 bp, Gossypium hirsutum
  Clone ID: uC-gsronu33B117f07b1
ttcattcgtccgctccatttcccgtccgcttgagggccatcagacggtgataaccatgccgatccgaaacatagccgtgggccgacccgaagaggcgactcaaccggacgcactcaaagcagctttggctgagttcatctccacactcatcttcgttttcgccgggtcaggctccggcatggcctttaacaagttgaccgacaacggagccaccactccggccggtcttgttgccgcttctatagctcacggcttaggacttttcgtcgctgtatccgtcggcgctaacatctccggcggtcacgtcaatcccgccgtcactttcggcgctttcgtcggcgggaacatcagtcttttacgcggcatcctctattggatcgctcaactacttggctcaaccggcgcttgcctcttgctcaagttcgctactagtgacatgaccgtaccggctttcggactttcatcgggagtaggtgtgtggaacgccgtcgtttttgagatcgtgatgactttcggattggtctacac

SEQ ID NO: 3367 - DNA, 522 bp, Gossypium hirsutum
  Clone ID: uC-gsronu33B117f11b1
ttcacgcgtccgaattgctggaaaagtaacaaattgggacaatgttgttttggcttatgaacctgtttgggccattggaacagggaaagttgcaacccctgctcaggctcaggaagttcattgcgagttgaggaaatggcttcatgagaatgttggcggtgacattgctgcatcaactagaattatatatggaggttccgtaaatggagcaaactgcaaggaattggccgcacaacccgatgttgatggctttttggttggtggagcttctctaaagcccgagtttgttgatatcatcaaggctgcgacggtgaaaaagaattagaagttgaaaagcaggaattaaaggtgaaacagaaacaaccttctgggaaactttaatttttgtagttgagatctttccttggaacctaatgtctgttgaaaatttcccgatgtaataagccaaatttaacaatgtgttttttttgtggtggttgaggcattgatcctcatttcggactttccctgaattaccttaca

SEQ ID NO: 3368 - DNA, 466 bp, Gossypium hirsutum
  Clone ID: uC-gsronu33B117g01b1
gacctacgtttccgcccacgcgtccgcccacgcgtccggaccaactcatttggtgtacttggccgtactggaaggggtctgactgaatactgcggggttccgatagagaagatagacattgtcactgctgccatgggacatgcattggcaacagaaggaggattctgcactggaagtgctcgagtcattgatcatcaacggttgagcagttctggctacgtcttctctgcatctttacccccatatttggctagtgctgcaattactgctattgacatcctagagcaaaatcctgatctgacatcaaagctgaaggaaaacattgccattttatggaaaggactctccgatatccgggggctttcaatagcaagcaatccagaatcaccgattgttttccttgtgcttgaaaaatcaactggttcgctgaaaagtgacctccagctccttgaagacattgctgatc

SEQ ID NO: 3369 - DNA, 445 bp, Gossypium hirsutum
  unsure (1)..(445): unsure at all n locations
  Clone ID: uC-gsronu33B117g03b1
ctgattacttaattgttccgcgcagtgttgatgctgatgatgctgacgtggaagtcaacagtgacaatgaaagtgatgacgacgacgacgacgatgatgaggatgatgaagaagctctcttggctgagctcgaacggataaagaaagagaaggctgaggagaagctccgccaggaaaaactagagcaagaagaacagctaaaagccaaagaagctgagcttcttcgaggaaatccactactcaataatccaacatcttttggtgtaaaaagaaggtgggatgatgatgtggtgttcaagaaccaggctcgcggtgaaaccaagcctcanaagcgcttcattaatgataccataaggaatgacttccacaggaaattcctgctgaaatacatgaagtaattcgcttggataccctagcagctagcgaatcaagtaaaagaacttac

SEQ ID NO: 3370 - DNA, 501 bp, Gossypium hirsutum
  Clone ID: uC-gsronu33B117g04b1
caaattctttgctttcccttttttttttttttttgccaatggcttcttcaccaaaattcatctcttacttcttccttttagccctcttctccgttgaaatacatggtagggatttttttagcaaaatcccaagtgttaacacaaatgagaaagaggtgaccaacaaagaagaacaaaccactttggggaagaaggagcaagagccaaggtttgtccccgagacccaaaatggctatgggctttacggtcacgagtctggtcagctccctcctagcaccgccagtaccaaagaaacctatgaaccctatgtcacacctgttaaataccaccctgatgaaccctacaatagcatcccagcgtccaaaaccaacaacaaagactcttacttttatagcaagacaaatgcgtacgggaacactgagcagcaaagtgaagccaggttcaatgagaaaggatggaccaccaaggaaaccaacaactacaatggcaactattacaatg

SEQ ID NO: 3371 - DNA, 485 bp, Gossypium hirsutum
  Clone ID: uC-gsronu33B117g06b1
ctcgtgggtgatggagagtttggctttcaacattatggcagggatagatgatgttctttacgttgatgatgctataaagcaacgtgctgcggcagaaacagtttctcttttcagcaggagcggtttcagtggtcgtccaatccaaaggcgattgtctcctagtcccttctcaattcaacagactccttatgcctctcctttcgcaacacccaccttttgttctccaaccccactcaccggaagtccacgacgagcagcttcctctttgaagagaaatgatattaaggaagaacctgaccggaaatttgaaaaaccgttcgcgagtgaatttgagaaggtgtggtcgtatacagatagcctgagcgcgagaagggtttcagaaaatgctccggagagagactgaaatcaaagattcatgatcccatgtaagataaagttctataaatggaagtaactcagtttagttgggtgtctgactggttaag

SEQ ID NO: 3372 - DNA, 535 bp, Gossypium hirsutum
  Clone ID: uC-gsronu33B117g08b1
cgaaataagaagttcatgatggaatcattggtgaaaggtccttcaatcacaaatccgtgtaccttgccacctccttatgacactcgagctcttgcagtatttctcagaagaaaaaataactcaatattgcaagtgaagaaatgggagaaaggttattgggaaagtctcaacaagcagtagttgatgcctggttttttctcgttttctttttgtcatgatgaatctagacaactatacttttggtttatgtccaaatttaagaaatacatggctgaaccctttacagcaacatggaagaatacccccgatcaatcaaataaacttggatcgagtgaatttgtcgagtcaactatggttcgattgaaaccaagattaagaccaagatccatcaatttataaaggggactatagataaataaagtggtgatttcagacaggtctggcttccattgaatcggccggatcattcagacagattaaggtggatcagttgtagaatccttaaataatgtaccttcagctatgctatcaaatg

SEQ ID NO: 3373 - DNA, 503 bp, Gossypium hirsutum
  Clone ID: uC-gsronu33B117g09b1
gattttggtttcgctttcaacgatagtaatttctctgacagacttcttcggattgagattatgggcgggccccctcagtgccgccccgatggagagggttgcaccagcatcgccgattgggctcgccaccgcaaaaggcgtcgagaggatatcaagaaggaaaccgttttggatcttagtttatgtcctgaggagcagattttaaatgacaaccagcctgatatggacgatggtgtaggctgtgagaatcaagacgaggagccagtggcaatggttgaagaaacacaatcaggtgatgaggatgcgaatagcaatgaatcaagctggagcatggattgttctgcagttctgagagttaaaacattgcatatcagttctcccattttagcagcaaaaagtcccttcttctacaagcttttctcaaatgggatgagggagtcggagcaacggcatgtaaccttaagaatcaatgcctctgaggaagctgctctcatggagctttt

SEQ ID NO: 3374 - DNA, 551 bp, Gossypium hirsutum
  Clone ID: uC-gsronu33B117g10b1
gtttgaggcagccgcaaccaatggcccccaaagttgagaagaaatcagatccaaaggcacaggccttgaaagcagcgaaagcagtgaaatctggagccacatttaagaagaaggccaagaagatccgaaccaaggttacattccacaggccaaggaccttgaagaaggataggaccccaaagtaccctcgcattagtgctccaccaaggaacaagcttgatcattatcagattctcaagtttcccctcacgactgagtctgcaatgaagaagattgaagacaacaacactttggttttcattgttgacattcgtgctgataagaagaagattaaagatgctgtcaagaagatgtatgatattcaggccaagaaagttaacaccttgatcaggcctgatggaacaaagaaagcatacgttaggttgacacccgaatacgatgccttggacgttgcaaacaaaattggtattatctaagctagttagtagctaccttgttgagcatttattttccttttctttgcaaagagaaattatttcgagacattgagc

SEQ ID NO: 3375 - DNA, 116 bp, Gossypium hirsutum
  Clone ID: uC-gsronu33B117g11b1
tttgtgtgataggaaaaccatttgcatcccagagttatgatttgattgctcatacttctgattaaaaataaatgtgtaccaaaccaagttcaaagcattaaatcttcatatttttc

SEQ ID NO: 3376 - DNA, 382 bp, Gossypium hirsutum
  Clone ID: uC-gsronu33B117g12b1
accagccctacaagcgaggggccggatcgcgtggggggggactgagagatggagatggcttaaaagaagcatggttcccagctgatattatggattgaaaatatggccaagcttatgtgtgttacaacgagcttacatcagaggatggtgataagctaccggcctgggtcgaacttgaaggtgaagggtaaagactacccaggatccgtactggattgcctgccacagtgcatgcccttggacggaacaaggaagagatacaacacagctatagttgactataattcggactactgtggatagaggcgacacatggatacccgatagctgatgctaccgggttcacacttttgagcgccacacatcagaggcatcatggact

SEQ ID NO: 3377 - DNA, 486 bp, Gossypium hirsutum
  unsure (1)..(486): unsure at all n locations
  Clone ID: uC-gsronu33B117h01b1
cccactcgttcgcccacgcgtccgcctatactcaacttcttccacttaaaagcaagttagctagctagggttttgtgagccagagagatgggttcaaaaagaacggcatcactagccctcttctttgcactcaacatcctcttcttttccctggtgagtgcttgtggttcctgcccttcccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatatnttgggcatcaaccttaatgtcccactttccctcagcttgcttcttaatgtctgctcaaagaaagtaccctctggc

SEQ ID NO: 3378 - DNA, 419 bp, Gossypium hirsutum
  Clone ID: uC-gsronu33B117h02b1
ggtattcctttcattaggaattctgttgcatcagagccgacagtctctcatatgcaagctgcatcccgccaagttcttgaatttgagtctgctcaaaattctgaaaagatgaaggccttgcaattggcagaggcggaggacctgtctaattataacgagcaggagatacagcctcatacacgagagattcaaagcaaaccttcaagtgcctcaactaggagttgtaccaaggttcacaagcaggggattgctcttggtaggtcggaggaccttactaagttcaatgactatgatgaactcgatgctgagttggatggattatttgaatctaaaggcgagttaatggcccctaagatgaattggctcgcagtttatactgatgatgagggtgatatgatgcttgttggagatgatccctg

SEQ ID NO: 3379 - DNA, 372 bp, Gossypium hirsutum
  Clone ID: uC-gsronu33B117h03b1
atggttccttaatgaacccagctgtttcattcggaccagccttggttagctggacatgggacaaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctacgatcacatttgagtctcctatctctttccttgtattttgtgtttaatttgtggccgtcgatcttgcatacttttttgctttttttcattcccatcctctatcatgatcatcatgaatggcagatgtttacaattgcatgccct

SEQ ID NO: 3380 - DNA, 518 bp, Gossypium hirsutum
  unsure (1)..(518): unsure at all n locations
  Clone ID: uC-gsronu33B117h04b1
gggcaatcaattttgtaagcaagtatggctaaggacgttgaggttggtggtgagttccaagccaaggactaccatgatcctccaccagctccattagtggacggggaggagttgacaaagtggtcattttatagggctgtaatagccgagtttattgccacgctcttatttttatacatcactgtgttgacagtgatcggatacaagagtcaggttgaccctgataagggcagtgacgaatgcggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacangtatggaggaggagccaacagcctcgctgatggatacagcac

SEQ ID NO: 3381 - DNA, 384 bp, Gossypium hirsutum
  Clone ID: uC-gsronu33B117h06b1
cttttacgtgggacgtcagtcgtaaagcaacgcaagcaatttccggtgatgatcaagatgctggttccgttcaagttcacgatatgtgtaaaggtggtatttgctggcacggcgtggctgtccggttccctgcttctcaactccggttcagcctccctcaacaaattccatacggttctatgtaaaaagaagaagaaaactttgggaatttcaggtttaaagctgtaagatataagattagctttgggtttgggtttggccaaaaacaaaaccccatgaggtcttttccttttctccttaattttgattgagaggaataaaagagcgtgtataaggttatatatataattgaaaatgaaaatgaagatgctttaatttgtgaat

SEQ ID NO: 3382 - DNA, 456 bp, Gossypium hirsutum
  Clone ID: uC-gsronu33B117h08b1
ctctctcatcctgcttctggtcaagccaatctcaaaagactccccttttagctcacagctctctcgagttctgtaatgggtaaggagaaggttcacatcaacattgtggtcatcggccatgtcgactctgggaagtctacaaccactggtcatttgatctacaagcttggtggtattgacaagcgtgtgattgagaggtttgagaaggaggctgctgagatgaacaaaaggtcatttaagtatgcatgggtgcttgacaagcttaaggccgaacgtgaacgtggtattaccatcgatattgccctctggaagtttgaaactaccaaatactactgcactgtcattgatgcccctggacaccgtgacttcatcaagaacatgattactggtacctcacaggctgactgtgctgttctcattatcgactcgaccactggtggtttcgaagcttgtatc

SEQ ID NO: 3383 - DNA, 522 bp, Gossypium hirsutum
  Clone ID: uC-gsronu33B117h10b1
ttcactcgtccggccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgctagaaggtactcttttgaagcctaacatggtgacccctggttccgactccccgaaggttgccccagaggttattgctgagtacactgtccgtgccttgcagcgtaccgtccctgctgcagtccctgctattgtgttcttgtctggtgggcaaagtgaggaggaggctacccttaaccttaatgccatgaacaagctccagaccaagaaaccatggtcactctcattctcatttggacgtgcccttcagcagagcactctcaaggcctgggctggaaaggaggaaaacgtgaagaaagcacaagatgctttccttgttaggtgcaaggctaacttcgaggccaccttgggtacataacagggtgac

SEQ ID NO: 3384 - DNA, 528 bp, Gossypium hirsutum
  Clone ID: uC-gsronu33B117h12b1
ttacaatcgaaacccttaggcggcgactactcgagcttcataacacccgaagcttttaactatggcggatgtagagacggaggttgcgacggccggtgtgcccaagaagagaacattcaagaagtttagcttccgaggtgtcgatttggatgctctccttgatatgtccactgatgagcttgtcaagctcttccctgctcgagctcgcagaaggttccagaggggtttgaagagaaagcccatggctctaattaagaagcttcgcaaggcgaaaagggaggctccacctggtgagaagccagaaccagttagaacccacctgcgtaacatgatcattgtacccgaaatgattggaagcattatcggtgtgtacaatggcaagacattcaaccaagttgaaatcaagcctgaaatgattagccattaccttgctgagttttctatttcgtacaagccagtcaagcacggtagaccaggtattggtgctacccattcttccaggttcattcctctaaaatgaagtcttat

SEQ ID NO: 3385 - DNA, 252 bp, Gossypium hirsutum
  Clone ID: uC-gsronu33B121a02b1
agcagtccagcttacagcttccagttagaaacaatcaattcgaagaggctggccttggtttagaggcaaggcactatctttcagtataccaagatattgagtcccataataaggctttgttggagtctgcttagatcgttttcaacatgttatcaattctgcttattatagatcttatttcgttctttttttatttatttactacaactcttcttttatttatttcttttattttattttctttcttattat

SEQ ID NO: 3386 - DNA, 165 bp, Gossypium hirsutum
  Clone ID: uC-gsronu33B121a06b1
agcagtccaggctttagattacccagaaacagagtggagaagagggggggggcagtttgaacttcgccgccgtttctttactgccaggaacaacaggactgtctccagcttgcaaggtcgtccagctagctccggaaagaacacgactgctcctaagcaaaattt

SEQ ID NO: 3387 - DNA, 193 bp, Gossypium hirsutum
  Clone ID: uC-gsronu33B121a07b1
agcagtcctcgtttctctttcatttagcccgcactagcagcagggagctcctcactcttcacagtagctgatcaaccatggcggagcagaccgagaaggcatttctaaagcaacccaaagtgtttttaagctccaagaaatctgggaaagggaagagaccaggaaagggaggaaacctgttctggaagagcat

SEQ ID NO: 3388 - DNA, 188 bp, Gossypium hirsutum
  Clone ID: uC-gsronu33B121a08b1
tcgccctacgcgtccggtcaatggacaattaaaaaacaaatatggtagacgcatttattcgcgggaataacgtactttatataagcacatcaaagaggacattagctgatggtgcataatgtgttgagagttttaacttaaatttcaagaccaatgtgcccttttcctattctaagtttgtatgttga

SEQ ID NO: 3389 - DNA, 438 bp, Gossypium hirsutum
  Clone ID: uC-gsronu33B121a09b1
tccctcgcgtccgcccacgcgtccggtggtttaccgtgtccgtgttaggaggggtggtcgcaagaggcctgttcctaagggtatcgtgtatggtaagcccacaaaccagggtgtcacccaattgaagttccagcgcagcaagcggtctgttgctgaggagcgtgctggccgaaagttgggaggtctcagagttgttaactcgtactggatcaatgaggactctacttacaagtactttgaggttatcctggtggatgctgcacacaatgctatccgcaatgacccaagaattaactggatctgcaatccggttcacaagcacagggaacttcgaggacttacatctgctggtaagaaaaacaggggtctccatggaaagggtcatttgcaccacaagaaccgtccttttcgcaaggcatcctggaagagaaacaacac

SEQ ID NO: 3390 - DNA, 250 bp, Gossypium hirsutum
  Clone ID: uC-gsronu33B121a11b1
tttccggtatttcccttttcgtccctcagcagtctcggatgtctccaagctgcaggaaagaattgcaatggtgaagattagattatcagacagggttcatgagatccaggatttaaagatagctgtatttgttgctttgcagtagattttttttgttaatacgcttattacttttctaatttttatttattttatatgagttctttttctctccattttctgtctttttttttacttttatctttttatt

SEQ ID NO: 3391 - DNA, 301 bp, Gossypium hirsutum
  Clone ID: uC-gsronu33B121b03b1
aataatgttagctaagagatccctattagccatcttcctcctcctttccttcctctccatatcaaccgcaacatcaactcgaaaaacccgaacccgaaatccatgcaagagcatggtgttttatttccacgacatattctacaacggtcataacgcaaagaacgcaacatcagccattgtaggttcaccacattgggggaacaagaccattttaacaggaaaaaaccatttcggagacctggtcgtgttttatcctcccctattccttagacatcatcttgcttctagtatctctgttagt

SEQ ID NO: 3392 - DNA, 222 bp, Gossypium hirsutum
  Clone ID: uC-gsronu33B121c01b1
atttttctgaaggaacggggtttgggaatagctaatactgtttctgcatctgcttcagcaacaactcttgcaagctcctcaaaatctgacccccatgggaagcgccccatgaagagttagttttttggacatttctgtatatttagatttatcttagatacaccgatattttatgaatatttccaatgacttctaaccaaattatgtcatctcattaaatgt

SEQ ID NO: 3393 - DNA, 168 bp, Gossypium hirsutum
  Clone ID: uC-gsronu33B121c03b1
gataattttaactttttcgccattgagaaagaattaaagctcgatgaagggtaccaaaagacatacaaaaacgtcgatgaactgctgcccactctccctcgaagtaaaggctggtggcttgaccagctttttcaataccaagggttctggttctcatcttacagtgtt

SEQ ID NO: 3394 - DNA, 184 bp, Gossypium hirsutum
  Clone ID: uC-gsronu33B121c04b1
ctggatacttgtatggaataagccctcctagataatccccaggttatgagaaatccgatgcattgccatgccaccgcaatggggcactcatcagcaagtcaatcttccatcagctcttcctgaacatgatttcttgaatgatctggagcctttgggatggcttcacacacagccaaatgagctt

SEQ ID NO: 3395 - DNA, 157 bp, Gossypium hirsutum
  Clone ID: uC-gsronu33B121c06b1
agcagctcggtcttcgcaaactcagcacttagattagcatctatgctatctgatgatgagtctgcgaataccttcattacagaaagcaaagagctgctatcccatatacacaagtactccacttggatttttttttaagtccgattaagttgtttat

SEQ ID NO: 3396 - DNA, 266 bp, Gossypium hirsutum
  Clone ID: uC-gsronu33B121c09b1
tcgcagtccagcctacagcagtccagtagtttgggttagctagatggcaaaagctccttttttcctttcccccaaaactggtgagttaaaggctacacgttgattcttacacttttagaagcccctaatatccatagctacatgctattagtatcaaaatattatgaaatggttgccacagatccgtgaagaagcaactttgtgtttgatcctgttttagcgctgcattacttcttttttctacaatctcatcctcttatttctat

SEQ ID NO: 3397 - DNA, 519 bp, Gossypium hirsutum
  unsure (1)..(519): unsure at all n locations
  Clone ID: uC-gsronu33B121d01b1
aaaaaaaataaaaattaaaaataaaaatttaaaaaacaaaaaagctcngaataaccagaaaaaaaaaaaaaaaaagaaacaaaaaaagaataaaatttgatagaaaaaaaattttccaggtttaaaacaccccaaaaaaaaaaaaaagaaaaagaagaaaaaaaagagaacacaacaaaaaaaaaaaacaaaaacaaaaataaaaaaaaaaaaaataagaacaaaaaataacaaaaataaaaaaaaaaaataaaagcaaaaaaaaacaacaaaaaagtaaaaaaaacaaaaaaaaaaaaaaacagacaaaaaataaaaaaaaaaaaaaaaaaacaaaaaaaaaaaacaatcagaaaaaaaaacaaaaaaaaaaaaaaaaaaaaaacacaaaaaaaaaaaaaaacaacaaaaaaccaaaaaaaaaaaaaagactaataaaataaaaacaaaaaagaagaatacaacaaaaaaaaaaaatgacataaacaaaaaaaaaacaaagaaaaaaaagaacacaac

SEQ ID NO: 3398 - DNA, 659 bp, Gossypium hirsutum
  unsure (1)..(659): unsure at all n locations
  Clone ID: uC-gsronu33B121d02b1
aaaaaaaaaaaaaaaaaaaaagnaaaaaaagaacaaaaaaaaaaacacacaaaaaaaaaaaaaaaaaaaaacacaaaaaaaaacaaacaacaaaaaaaaaaaaaaaaaaaagaaaaaaaaaaaaacaaaaaaaaaaaaaaaaacaaaaaaaaaaaacacaacaacaaaaaaaaaaaaaaaaaacaaaacaaaaaaaaaaaaaaaaaaaaaaaaaacaaaaacaaaaaaaaaaaaccaacaaaaaaaaaaaacaaacaaaaaaaaaaatcaatacgaaaacaaaaaaacaaaaacaaaacaaatgaaaaaaaaaaaaaacaaacataaaaaaacaaaacaaaaaaaataaaacagaaaaaaaaataaaaaacaagacaaaatnaaacaagaagaaaaacaaaaaaacgcaacaatggaaaaacaacaaaaaaacaaaaacaaaaaaacaaaacaaaaaaataaaaaaaaataaaaaaaaaccaaaataaaaaaatcaacaaaaaaaaaaaaaaaaaccaaaacaaaacaaaaacaagagaaaacaaaacaaaaacaaaaaaacaacaaaaaaaaaaaaaaaacaaaaaaaacacaaaaaaaaacaacaaacacaaaaataaaacaacaaaaacaaaaaaacaaacaaaataatcaaaaac

SEQ ID NO: 3399 - DNA, 100 bp, Gossypium hirsutum
  Clone ID: uC-gsronu33B121d05b1
agatcccatcagcgtccgctttatttcgatcaaagatatctctaaagacattgacaggcacctttcccaagcaagcttaactgtttcacatgttgctatt

SEQ ID NO: 3400 - DNA, 115 bp, Gossypium hirsutum
  Clone ID: uC-gsronu33B121d07b1
agcgctcggataaaacaaaaacagcaagctatcacagggactccatcaatggcaggctccagatgaagagccgaggaagaggaaccaggagatagagaaggaacagaaggagagc

SEQ ID NO: 3401 - DNA, 82 bp, Gossypium hirsutum
  Clone ID: uC-gsronu33B121d08b1
tgccttcgcgtccgcagcccactcagaacgggtgcggttttggggaattttacttgttaaccccaacaaagcatcgcgattg

SEQ ID NO: 3402 - DNA, 183 bp, Gossypium hirsutum
  Clone ID: uC-gsronu33B121d09b1
tcgggtgtcgctataggtgatgggctaacggatccggtcacccaggtgacaactcatgcagacaatgcttactattgtggtttagtcaacgagaggcaaaagggtgaacttgaggaagcacaaagggaggctgttgagttggttaagatggggaactggagtgaggcatcatatgctagaagc

SEQ ID NO: 3403 - DNA, 97 bp, Gossypium hirsutum
  Clone ID: uC-gsronu33B121d10b1
cccttcatgttcctttcctttattcccttttcttccctcagcgtctctccctcgcgtccggtaagatgctggagaattgggggatttttttattcct

SEQ ID NO: 3404 - DNA, 103 bp, Gossypium hirsutum
  Clone ID: uC-gsronu33B121d12b1
cctctagctgcagaagttccattggacacgttagtttcatattacaaacaaggctatgaagaggtgcggaaatactctccatcagcgtatgtgattatttgcc

SEQ ID NO: 3405 - DNA, 68 bp, Gossypium hirsutum
  Clone ID: uC-gsronu33B121e05b1
ttactttaactcctcaaaattcttcttcaaagagcaggctcgagttcttgtttcggcctcaatcctta

SEQ ID NO: 3406 - DNA, 75 bp, Gossypium hirsutum
  Clone ID: uC-gsronu33B121e07b1
ccctctctactcgtatactctcaatttcttgccagcttcgtggtagtcaatctattctacaaaaggagaatacca

SEQ ID NO: 3407 - DNA, 174 bp, Gossypium hirsutum
  Clone ID: uC-gsronu33B121e08b1
tcggatcttcattcattgcagaagataatgcttggtgattcattctatttacattcaaccaaaaacccctaatgctacctactcagttcccgaccatgccaccaacacacccaccatttcatccttcatccaagccaccctacatcgagtcatgtggtattgctggtcgctgtc

SEQ ID NO: 3408 - DNA, 118 bp, Gossypium hirsutum
  Clone ID: uC-gsronu33B121e09b1
cctcgactacgcgtccggtccccggaggaccaaacccactgttcaactgatctctattcttcattcttctcctccctttccatgccaaaatatctggaatcagatttttcctttttta

SEQ ID NO: 3409 - DNA, 151 bp, Gossypium hirsutum
  Clone ID: uC-gsronu33B121e12b1
tcgccctcgcgtccgtgtctattgaattcttgccttgactttctcgagaaaaaaaaaagtcttcaggttgcaattgcggatctagctgcagctgcggcgactgctgctcatgcagcaggatccttaaccttggatactcggtgaagacaac

SEQ ID NO: 3410 - DNA, 255 bp, Gossypium hirsutum
  unsure (1)..(255): unsure at all n locations
  Clone ID: uC-gsronu33B121f01b1
cttggatctcaggtggtcatatcaatccagcggtgacatttgggctgttcttgggaaggaaattgtcgttgacaagggcaatatactacatggtgatgcagcgcttgggagccatatgtggngctggtgtggttaaagggttcatggggaagacaaggtatggtgctttgggtggtggagctaactctgagaatcatggctacaccaaggttgatgggctcggtgctgcaattgtggttacctttgtgcttgttt

SEQ ID NO: 3411 - DNA, 401 bp, Gossypium hirsutum
  Clone ID: uC-gsronu33B121f02b1
cccacgcttccgttaagcttcattcttaattagagaataccaatggcctcacatgacaagaaacctgctaagccgtcgagcagccgttccggtggcatccgtacgcttgccgatctcaacaggccgtctggacctgattccggcagcgattccgataatcctcaggagtactacaccggcggcgagaaaagtggcatgcttgttcaagatccttcgaagaataatgaagtagatgggattttcaatcaagctaggcaactgggagccgtagaacggccaattgaacagcttaatccatcgtcaagttcaacaagttttactggaaccggtagattactttcaggggaaactgtatcttctgtacctcagcagcctcagactgttattcacaacacttgttt

SEQ ID NO: 3412 - DNA, 123 bp, Gossypium hirsutum
  Clone ID: uC-gsronu33B121f06b1
tcccatcagcagtccggctggtcttattattggtcatctagcgcctcttaggagggccacatccacctcacataagcttggctaacatggctgacaaatatggaagaatgttcgctatcaagt

SEQ ID NO: 3413 - DNA, 289 bp, Gossypium hirsutum
  Clone ID: uC-gsronu33B121f07b1
tctagctaactttcttgtagctaagcacacccgaaccctcctctgccatgtctgtcagaacccaactccatggctcgcctctggtcaacacctcagccctgctgtctccgtttgcgagtcatgtgtagccaacaaaaatactacttgcgaaatgacgacggagcaggaggagtcatcggagggagagtatgaggatgctgccgacgctctttcctttctcttttctactttcttttctttctcttctcactccctctctctctctttttttttctctcttatcccttct

SEQ ID NO: 3414 - DNA, 290 bp, Gossypium hirsutum
  Clone ID: uC-gsronu33B121f08b1
ccctcgcgtccgctcttctttcctcctagccaaaaaaaaaaaaaaaaaagcctctttcctgtctctcgttctttttcctgttcaatcatgtcttgcttcattagcaaatatgctgatgagttggctaaaaacgctgcttacattggaacccctggaaagggtatccttgctgctgatgaatccactggcaccatcggcaagcgtctttcaagtattaatgtagagaatgttgaagacaacaggcgtgctctccgtgagctcctacccacaactcctggtgctcttcagca

SEQ ID NO: 3415 - DNA, 222 bp, Gossypium hirsutum
  Clone ID: uC-gsronu33B121g01b1
acctccttcaccaatccaccgatccatcgatccagtgtgtgttggtcacctccagctagcctcaagctcagctcaacttcttcatttttgtttcttcatttgcagtctcggtagcccattctcggtgctccccaaagtttggtccttactccttaggcctcactaaggctccccataggcctatgactgctggctggtgctgtcgaagactgctgctgtgcc

SEQ ID NO: 3416 - DNA, 66 bp, Gossypium hirsutum
  Clone ID: uC-gsronu33B121g02b1
ccctcgcttccggtagcagataaaggatgagcacactggatgcaactagagcagaacttgctcttg

SEQ ID NO: 3417 - DNA, 198 bp, Gossypium hirsutum
  Clone ID: uC-gsronu33B121g03b1
cttaagctagctgctcttttggcctctcctcaatcaaagaaaaacaacaaatgaatccatttgcttctttcttgcttctcttatcttctctagcttttcttgcctccatcggtaatggccacgacagagcctccccttggcattgctcacgagaattcgtaggccctcctcccgtcggtcttcgatattttccacccc

SEQ ID NO: 3418 - DNA, 117 bp, Gossypium hirsutum
  Clone ID: uC-gsronu33B121g12b1
ttcccggttcgtccctcgcagtctctgatctttcgtgtttgtctattaatctcctcacggggctttttcaaaaaaaaaaacgtcttcatgccgcaatcgcggatctaactgcatctg

SEQ ID NO: 3419 - DNA, 303 bp, Gossypium hirsutum
  Clone ID: uC-gsronu33B121h01b1
ctttccgttcaagaaaagtagaagaaagcaaaaaaaaaaaaaaaaaaatggcgcctgaaccagaggatgagttcaaggacgagaaaaaccctagacctcttgacgaagatgatatcgcgcttctcaaaacctatggtttaggtccttattcaacgagcattaagaaagttgaaaaggagattaaggaaatggcgaagaatgtaaatgatttatgcggcatcaaggaatctgatactgggttagctgcgcctagccaatgggatcttgtctccgataagcaaatgatgcaggaggagcaaccac

SEQ ID NO: 3420 - DNA, 120 bp, Gossypium hirsutum
  Clone ID: uC-gsronu33B121h03b1
ctttatctgagcgacgaacactgcgccaagttttggaagatctgttatgaagctttgccagtcaactgcaaagcgatcgctgccgaatgcattcttcctgatttcccctatccttgtctt

SEQ ID NO: 3421 - DNA, 302 bp, Gossypium hirsutum
  Clone ID: uC-gsronu33B121h06b1
tatatttttttttatttttatttaaaaataaaaaggggggtttttttttaatttttgggtttttttactccaacattattacataagttttacttgtttctttatatcccctcgtcttcccctcccgctccgggggggggcccccctgggggtcccgggcttccgccccggggggggggcccttttggcttttttttgggggcccctttatttctctcccggggggggggttttcccccgcggggggggggtcccccggggcgccccccccttttttcgccgggggcccccccccccttgtc

SEQ ID NO: 3422 - DNA, 473 bp, Gossypium hirsutum
  Clone ID: uC-gsronu33B121h07b1
gattgctacatatgatgaaattaaggctgctatcaaggcggaatctgaaggcaacttgaagggaattcttggttatgtggacgaagatttagtctcaactgacttcatcggagacaacaggtcaagcatttttgatgccaaggctggaattgctttgaatgacaactttgttaagcttgtgacttggtatgacaacgaatggggttacagttcccgtgttatcgacttgatccgacacatgtctaaggcttaagtgagtgagtgattgtgctttgtgtatccaagctttagcaattttaatttagaggagatgttatgagagaataaacgaattgtaccgagcatatttttgtgtgaagatggggtggttcagttttattacccaagttcttgaatgtttcaagttttatttgcagtttttcttctactttaatgcatatgttgggatcattggtcttcttctttaaaaaata

SEQ ID NO: 3423 - DNA, 447 bp, Gossypium hirsutum
  Clone ID: uC-gsronu33B121h08b1
gttttggtgtcttggtggccttgctggctgggggggggtgctttttctgatggcttggggttgggccccctcgggggtgcgggctgtcgggctctcctcttgtgtctcctctccttccttccggggccgccttttggggggggcccccccggggggccccgggtttccgcccgggggctggggcggctttggctttttttggggggcccctttttcctctcccggggcgggggtttcccccccggggggggggggtcccccgggggtcccccctctttttgccctgggggccctcccccctttccccggggggggtttttgcgggggggcccccccccttccccctcccccccgggggccccccctggggggcgttggggccccccccttttggggcccctttgggcgggggggggtggggggtcccccccgtgcttcccttccccc

SEQ ID NO: 3424 - DNA, 484 bp, Gossypium hirsutum
  Clone ID: uC-gsronu33B124a01b1
ccctctcttccgattatgatggtcggagaaactgaccgtcttaatccgactgtccatattccaccatggcctaaccttgacgatgatcaaacggccgagatttactctccactcaactacaatgcaaccgacagtcacttcaacaacaacggcggcaacccggttcatctccatgaagcgttagcagcgttacaacgttacttgccgtcgaacgaaccggacgttctctacccggattccgatcttccggttctcgaaaacccggattctccggtcgacgcttactcgtgcgatcatttcaggatgttcgagttcaaaatccggaagtgtccacgtggccgagcccatgactggaccgagtgtccgtacgcacatcccggcgagaaagctcgccggagggatccgaggaagtatcattactccggcactgcttgtgctgatttcaggaaagggaactgccggaaaggcgacggttgtgagttcg

SEQ ID NO: 3425 - DNA, 430 bp, Gossypium hirsutum
  unsure (1)..(430): unsure at all n locations
  Clone ID: uC-gsronu33B124a02b1
ctcattcactcatcataagggtgcttgttgaccgaggggaagttaaattcaagtcactgttgcactccgttgattctgtgctcacagaaggatatgctttgaaggtcgcgatggataaaatcaaaaaagatttgaaagatgttacggacaccatcccggatgtgcttcgacgggcggatgaccttgaccgtgaaacaatgatggattggcaagagattttgaagcggatgatggacacgctgtagcacatctgtggaattattttaaatattatttgacataaaaaatttagcggatttttttcaaccttagaaaaataacccataattcatttatgtattattttttacaagctttcagaaaatttggtggttatgtcttgagggattttatttcgggtttcagggtttagttttttcatnntcaaaaa

SEQ ID NO: 3426 - DNA, 499 bp, Gossypium hirsutum
  Clone ID: uC-gsronu33B124a04b1
gttattgtaaaatcttgaaaccgtagcggcaacagcactagcccagagatgtttggtggtattcaaagcacttgatcctttcttccctctgtcctcttccaccatttccaccgtttccaaattgttatccccgttttgcccccaatctgctcctgattccccaacatacccttcctccctcgacaaactcaccaataaaacccaaccccctttgccaccacctttcctcgacttcacaggacacagagtttgaccacccgaaaatcaagaaatcgaacacacattttcattttcatcaacaaaacatttctgggtctttactgaaatgaggacggaactgttttgttgctaagaaacaggccaccatgtcatgaggccctgatcaaccatttttgagcttccaaatgaagatatggaacttgagcttaaattcgagctttccaacgatgaagtcgcgccaaagaataatctgagatccatggctgccgctcaagctaga

SEQ ID NO: 3427 - DNA, 428 bp, Gossypium hirsutum
  Clone ID: uC-gsronu33B124a05b1
cttatttatgctgagggggcagagaatggccttgatttcaccattgtgagaccttttaactggattggacctaggatggatttcatccctggtattgatggtccaagtgagagtgttccaagagttctggcatgctttagtaataatctcttacgccgtgagccactaaagcttgtggatggtggtgaatctcagagaacttttgtttacattaaggatgctattgaagctgttctcttgatgattgaaaatcccgacagggccaatggtcatattttcaatgtcggcaacccaaataatgaagtcacagtgaggcaacttgctgaaatgatgactaaggtctatgcaaaggtaagtggagaacctttactggagtcaccaacaattgatgtcagttccaaagaattttacggggagggatatgatga

SEQ ID NO: 3428 - DNA, 520 bp, Gossypium hirsutum
  Clone ID: uC-gsronu33B124a06b1
gctttttgcttcacctaatgagccataagcggggggggtctatgcaatgaagtactgtagcctggtggctgaaaactcaggaagaggttggaagctattagcattaatactttctgcagacaggcggttcaaagatgctgaaaccatacttgagttcgctttagatgaatccagtggatcagatcaattagaacttctaagactgaaagctgtgcttcagattgctcaggaacggcccaagcaagcaattgaaacttacagcatattgctatctctgattcaagcacaaagagaagctcagtctaataactctggtcatgcaaagagttcccatacagagaatatagctggaagaaatatggaaatggcggactggcaagatctagctactgtttacaccaagtttggttcgtggcccgatgcagaaatttgtttaaacaaagccaagtcaattgatttttattcaccccaaggttggcatacaacaggtttgctatttgaagcccatcactttataaag

SEQ ID NO: 3429 - DNA, 481 bp, Gossypium hirsutum
  Clone ID: uC-gsronu33B124a09b1
tgttcagcgaaaatggcaggcgaagcagctgggggggctaatttctggggtgatgtgccggaggaagactattacaggtcgcagggtgtacgcaacaccaagtcttacttcgacactcccaacggaaagctcttcacccagagcttcttacccttggataaaaaagtgaaggcctccgtctacatgacccacggctatggatccgacactggttggctcttccagaagatctgcatcaacttttccaattggggttatgctgttttcgccgctgatcttctcggccatggcagatccgagggtctccgctgctacttaggtgacatggagaaagttgctgcaacatccttatcattcttcaagcacgtccggaacagcgatgaatacaaaaacttacccgcattcctgtttggtgaatccatgggaggagcagcaacaatgctcatgtactttcaatccgaccctgaaacttggaccggtc

SEQ ID NO: 3430 - DNA, 505 bp, Gossypium hirsutum
  Clone ID: uC-gsronu33B124a10b1
tcttcgtcctgttggttctttcaagaatatcagtgattataactaccaaactttgaaagataacgtggatatgttgaagttaatccaattagggctcactttctcggatgagaatggcaaccttccctcttgtggaactgacagctcttgcattcggcaatccaatttctgcgagttcaacataagcgaagatatctttgctagtgatcccattgagttgttgcgccagtgcgggattgattttaagaagaacaatgagaagggtattgacgtgaagcggttcggcgagcttctgatgtcttccgggattgtgctgaatgatggtgtgcattgggtaacttttcatagtggatatgactttgggtatttgctaaagctattgacttgcaggagtttgcccgataatcaagcgcgattctttgatttgatcaatatgtatattcccatgctgtacgatatcaagcatatgatgaagttttgcaatagcctgcatggtggtttgaac

SEQ ID NO: 3431 - DNA, 505 bp, Gossypium hirsutum
  Clone ID: uC-gsronu33B124a11b1
tgtttaattcacctcatgagccttaagctgtggcgatgcataagcgaccaccttgccctcttgcatcagtacgcaacctaaccccacatgcgacgcatcgctgtatacagtaaagtccttcccagacaccggttgaatcaacactggcgcttcggtcaatacctttttcaaccgatcaaaagctttttgctgtttctcggtccagacaaatggtactcctttccttatgagttttgtcaagggtgccgccatcaccgagaaaccctccacaaaccttctgtagtaacctgctaaccctagaaaactctgaatttccgataccgacctaggtggcttccattccagaattgcatcaattttacgaggatccaccttaatcccttcggcagagaccacatgccctaggaaggttacctccttcaaccagaattcacacttgttgaatttcgcatagagctccttttcccttaacactcgcagcacaatacggagatgctcatcatgc

SEQ ID NO: 3432 - DNA, 289 bp, Gossypium hirsutum
  unsure (1)..(289): unsure at all n locations
  Clone ID: uC-gsronu33B124a12b1
gctttttgcttcacctaaggagccatatgcggggggggtctatgcaatgaaatactgtagcctggtggctgaaaactcaggaagaggttggaagctattagcattaatactttctgcagacaggcggcccaaagactcccaatgaacgcctgtcacaatgattgtcgcatgcaatttgccttttttgtatttgctgcttttgtgtgtaatgagctacttgctcttattttcgagtgaaaaaataaattaactcattgtacccttaaataaaattgattattaagttntc

SEQ ID NO: 3433 - DNA, 494 bp, Gossypium hirsutum
  Clone ID: uC-gsronu33B124b01b1
ccttctcgtccgcagagactctatttgctgtcggtttcacttgctgtccgaagcccaagatggagctgaggttctcatgtccgagatactcattagtgccgaaaagggtggggaatttttcattgatactgaccgacaaatgcggcagggaccaactccaatacccagtccgcaaagcagtggggacttttcagcattaagtccgattgccggtggtttcgtaatgagctgcagagtccaaggggaaggtaagagtagcaagccattagtgcagctagctatgcggcatgtgacttgtgtggaggatgctgccattttcatggcacttgcagcagctgttgacctcagcattgaggcatgcaagcctttccgaagaaagataaggatagggtcccgccattctttatgaaaaaaaaaaaaagaattaaggtgatgtatttccatgaacaaagaatggctctatatttgtgttgatttgtgtaacatttggcact

SEQ ID NO: 3434 - DNA, 431 bp, Gossypium hirsutum
  Clone ID: uC-gsronu33B124b02b1
cattactgctgcagaatatgaacgtcgcagagaaaactttttcaaggagctggaaatcgtttttgctgatgtggtaatggccataattgcagatttcatgcttgtgtatcttcctgctcctactgtttctctccggcctcctcttgcagtcagtgctggagctatttccaagttcttctatagctgccctgataatgctttccaggttgctcttcctggtacttcgtattcacttttgcagagattaggagcagtaatgcgtaacggcgcaaagctttttgcagtgggcaccacttcttcgctggttgggacagccatcacaaatgctttgattaatgctaggaaggccgttgataagacatcggcagctgaagttgaaaatgttcctatactatccaccagtgttgccctatgtgtatatatggcagttt

SEQ ID NO: 3435 - DNA, 445 bp, Gossypium hirsutum
  Clone ID: uC-gsronu33B124b03b1
ccctctcgtccgaaggcgactgaaaatggagcatccatatgtgcccagggatctgcaactgcctggatatgttcccgtctccctttctcagtccaccattcttaccgtctatggtctctcttccctgctcgtcgtctcccttgtttggttcctctctgggcgatcgcgcagcatatctaaacttgatagattgttgatgtgctggtgggctttcacgggacttacacacataattcttgaaggatattttgcattctcccctgaattctataaagacaagactggattttatctggctgaagtttggaaggaatatagcaaaggtgattcaagatatgcaggaagagactcaacaattgttgctgttgaaggaataacatcagttcttgaaggtccaccttgccttctagcagggtatgctattgccaaaggaaaaggatatagc

SEQ ID NO: 3436 - DNA, 508 bp, Gossypium hirsutum
  Clone ID: uC-gsronu33B124b06b1
ccttctcgtccgcaaagttctgttgttcattgctctatgtgtgcttccagctttggttagtgctacacgcattctgaataaccaattggtggttgaaggctatgtgtactgtgatacttgccgtgctggttttgaaacccctaagactagaaggctagctgatgccatggttaagctggtatgctccgacaggaagaccggcggagttgttttcgagaaggagggatataccgacacaaccggaaaataccagattcgtgtatccgaggatcacttggatcagatctgtgatgcagttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaagttggctgtgctgagatgatgaagatgtatcgggaggatgaggaggatgtctagtgtgtgggtttggat

SEQ ID NO: 3437 - DNA, 487 bp, Gossypium hirsutum
  Clone ID: uC-gsronu33B124b08b1
gtttaagtgacggcgccaattggctgtccgccttgactgagcttccggcatcgtcttggccctcgattttgcactttaaaaccttttttttaccactaaacgttttttgtttttagaaatggcagtgaaaccatccaaggccgataagaaaatcgcctacgacgcgaaactatgccagcttttagacgagtacacccaaattttaattgccgccgccgacaacgtgggttctaaccagctccagaacattcgtaaaggtctccgaggtgactcagttgttcttatggggaagaatactatgatgaaaaggtcggttaggatgcatgctgagaagaccgggaaccaagcttttcttaaccttatccccttgcttcagggtaatgtgggtttgatctttactaagggtgacttgaaggaagtaagtgaggaagttgccaagtacaaggttggagctcctgctcgtgttggtctagttgcaccaattgat

SEQ ID NO: 3438 - DNA, 486 bp, Gossypium hirsutum
  Clone ID: uC-gsronu33B124b09b1
tctacgcgtccgcccacgcgtccgattttgttcacaaactacaatggcttccgcgtctttagtaaccaagaggctagatggtaaggtggcactgataactggtggtgccagtggtttaggagagtgttcagccaggctatttctcaaacatggagccaaggttctgattgctgatattcaagacgaattgggccactccctttgcaaagagcttggaactgaaaacttcagctatgtccattgtgatgtaacatgcgaatctgatgtcgaaaatgccgtaaacttagcggtctccaagtatggaaaactcgatatcatgttcaacaatgcaggccttattggtgatggtgaagtcagagtgacagacgccagcactgacaacttcaagagagtgttcgatatcaatgtcttgggtggattcttgggagccaagtatgcagccaaggtcatggttccggccaagaaaggttgcattctcttctcgtc

SEQ ID NO: 3439 - DNA, 371 bp, Gossypium hirsutum
  Clone ID: uC-gsronu33B124b10b1
ctcttgcgtccggccacgcgtccgattccttgggatttccttccttatatgctcgaacttgctttatataaaccctaaatcgtaccattgtagaactttggtcagttattgctaagattttatcagggtttagagaatcgcatgttttgttcgatcggggttgatatttgctaacaaattctatcgaaatgtgtgactgtgtttcgattttttgccttgcggattggatttctttgcaaataggtaaactcaagaactaagaccatgaaattatatgtttaagaaaaaaatgatgaatgatttgaacattgcactttcgagtaaaaaaaaaaaaaagggagaaaatagtgagcttctaattcaatacaccg

SEQ ID NO: 3440 - DNA, 500 bp, Gossypium hirsutum
  Clone ID: uC-gsronu33B124b11b1
ttagccttcatttttatttttattttctccttctttcaccaaacaaaaacaacaatggcgatcagaaaatcatccaagctaccacaaaccgccgtcctcaaacaaatcctcaaacgatgttcgagtttaggcaagaaacaacacggcggtggctacgacgacgttggtctcacccctcccttagacgtacccaaaggtcacttcgccgtttacgtcggcgaaaacaggagcaggtacattgtacccatctcgttcttgactcaccccgagttccaatgcttactccgacgagccgaagaagagttcgggttcgatcacgatatgggactcactatcccttgtgaagaagtcgtttttcgatcacttacctccacgctccgatgaagttgaaaagtatagcacggcggcatcgtcattgtacggcgctaagcttttttttttacatcgatttttctggtttttttaatgatattctgaacccattaattgggtttttttta

SEQ ID NO: 3441 - DNA, 489 bp, Gossypium hirsutum
  Clone ID: uC-gsronu33B124b12b1
ctcaaccttccatttattctcttctttgaactcaaagtcccaactaatattagattcatgggtgttgtcacttatgactatgagaatacctccccagtcgcccctgccaggcttttcaaggcctttactgttgaagctccgaaagtttggcccacggctgcacctaatgcagtcaagagtattgaggttgaagctaatcctagctctggaagtatcgcaaaaatcaactttgttgaaggccttccattccaatatttgaagcaccagataggaggacatgatgaaaataatttttcatacagctacgatttaaatcaaaggtggcctttgggggacaaacttggaaaaataagctatgagaacaagtttgaggcaactgcaagatgaagaagtatttgcaagagctcaatgaaattctacactgttggctacaatgttatcactggagatgaaagccaagctttcatttagggaagtgagggagtttac

SEQ ID NO: 3442 - DNA, 493 bp, Gossypium hirsutum
  Clone ID: uC-gsronu33B124c01b1
gtccttggcaatcgaccacccaacatctcttgatggaactcaaaggttcaccaatctcatgtggcctgctggaaacgatcgctttcgcgaaagtgctcaaaggtactcagaggttgtggcagaacttcatcgaaccgtgatgagaatgttgtttgaaagctatggtgttggaaattgctacgattattacatcaaaatcacccgctaccttctacgatacttgagatacagtgagcctaagatgggggagagtaatgctggtttattgcctcatacagacaaaactttcttgtctatacttcatcaaggtgatatcagcggtttgcaggtgcaattgaaagatggtcaatgggttgcgccgccaccatcgccaacttctttcgttgtcatggctggggatgctttgatggcatggagtaatgaccgaataccatcttgtaatcatcaagtaatcatgaaggagaagggaataagatactcattgggcatgttt

SEQ ID NO: 3443 - DNA, 495 bp, Gossypium hirsutum
  Clone ID: uC-gsronu33B124c02b1
cttttagcctgccatataatcatataaccaggctccgtcgtggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagctgcttgtatacttctcaagtatctcaccggaggattgaacactccggttcacacattagcaagtggaatggggttccttcaaggtgttatatgggagattattct

SEQ ID NO: 3444 - DNA, 494 bp, Gossypium hirsutum
  Clone ID: uC-gsronu33B124c03b1
ccctttcgtccgattgttttgaccataattagagatgggttgaaggcagatcccaagaagtatacaaggatgaaggagagattagttggtgtttctgaggaaactacaaccggtgttaagaggctttatcagatgcaggccaatggaaccttgttgttccctgctattaatgtcaatgactctgtcaccaagagcaagttcgataacttgtatggatgccgtcactctcttcccgatgggttgatgagagctaccgatgtcatgattgctggtaaggtcgctgttgtctgtggttatggtgatgtcggcaagggttgtgctgctgccttgaagcaagccggtgctcgcgtcattgtcaccgagatcgatcccatctgtgcccttcaagctctcatggaaggacttcaagttttgacccttgaggatgttgtcttcgaggctgatatctttgtcaccaccactggtaacaaggacatcatcatggttaaccacat

SEQ ID NO: 3445 - DNA, 495 bp, Gossypium hirsutum
  Clone ID: uC-gsronu33B124c06b1
agtgtttcaaattcagatctatatcgcattgccttagtgttttcagtttcatttttgagattcgatgagtcgcttcgatgctaaccctttcgcagaggaagaggtcaatcctttttcggatccagcagttaggaaaggatcggggcaatcaaattatggtggaggtgccttttatactactaaccccggtagtgttcctcctgcaacatcaaggctttcaccccttcctcctgaaccatatgaccgtggtgcaactgtagatattcctcttgattctgccaaggatctaaaagcaagagaaaaggaacttaaagcaaaagaggctgaactgaataagcgtgaacaggaattgagaaggaaagaggatgcaatagcacgagctggaattgtaatacaggacaaaaatggccaccgtttttttctattatccatcatgatattgcaatgaaataccagtccacctacaaaagattcagtatgttgctttcacaacat

SEQ ID NO: 3446 - DNA, 477 bp, Gossypium hirsutum
  Clone ID: uC-gsronu33B124c08b1
cccacgcgtccggaaaccgtttcacttgatggtcctatttcaactagaactgcccaaacatgtcaatctcctttagtacctcatgaatttgtctgcccaattatgttggaaatcatgacagatcctgttattgtagcaactggacagacttatgaaagagacagcattcggaagtggttaaattccaaccatcgaacctgtccaaagactggacaaactttagaacacttgtctctagcaccaaacttcgcactccgcaaccttattctgcaatggtgtgagaagaacaaccttgaactgcccaaaaaggataattatgcttcttcagttaattattctgcagaaatcatggaagaaatgtcttcattggttctaaacctatcttctagtcagccaaatgtgcgtagagatgccattgtgaagatccgtatgctttcgaaagagaatccggagaacagaattttcattgccaacgat

SEQ ID NO: 3447 - DNA, 460 bp, Gossypium hirsutum
  Clone ID: uC-gsronu33B124c09b1
tttacgcgtccgcccacgcgtccgatcggcgacttcattccggcgcttgaatggctggatctgcaaggggtgcaagctaaaatgaagaaactccataacaaattcgataggttcttgagtgccattcttgaagaacacaaaaccaaagctcgacaaagtaatgggcaagtgaaacacaaggattttttaagtacgttgatttcattggagaatgttgatggcgctgaaggtggaaagctctccgacactgagatcaaagcattacttttgaacatgttcacagcaggaactgatacatcttcaagcacagttgagtgggcaatggctgagctaattcggcatcccaacatcatggctcaagttcgtaaagaattggactcagtcgttggtcgagaccgcctcgtctccgacttggacttgcccaatctaacctacttccaagccgtcatcaaagaaacct

SEQ ID NO: 3448 - DNA, 498 bp, Gossypium hirsutum
  Clone ID: uC-gsronu33B124c10b1
tttaaatgaacgggctgatgcaaaaggcgatgtcgggagtttcagtgccattcatgagagcaatattggacggctatgatgggttgaaaggagtgaagagattagttgatgtgggaggcagcgcgggggattgcctccgaatgattttgcagaaatatccccatgttgagggaatcaactttgatttgcctgaggtcgttgccagagcacctagtattccgggcgtgactcacgttgggggtgacatgtttgagtcaattccagcggctgatgcaatcttcatgaagtgggtgttgacaacatggacagatgatgaatgtaaggcgataatggagaactgctacaaggcacttcctgtgggagggaaattgatagcatgcgagccagtgttgcccaaggaatcagatgatagtcataggactcgggcactcctggaaggtgacatttttgtgatgacaatttacagggccaagggtaagcataggacacaagatgaat

SEQ ID NO: 3449 - DNA, 502 bp, Gossypium hirsutum
  Clone ID: uC-gsronu33B124c11b1
tttacgcgtccggttacgataaaaatcctttcgacgaggaagaagaagaagttaatccttttgctgatacaacagcaagagggaaggcacctggccagtctaaatttggggaggtctattttcaacgcgcactgcaagcgttccacctgcctcaaactcaagactttcaccactacctcctgaacctgctggttttagttatgagcgtgaggcaacagttgatatccctcttgatacagcttcaggaggatcacgtaatcaggatttaaagaagaaagaaaaggaactccaggccaaggaggctgaactgagaaggcgggaacaggaagtgagaaggaaagaagaggcagtggcaagagctggagttgtgctggaagagaaaaattggccacctttttttcctatcattcatcatgatattgccaatgaaattccaattcatctacaaagattgcagtatgttgcgttttcaacatatttaggattggttctatgccttcta

SEQ ID NO: 3450 - DNA, 486 bp, Gossypium hirsutum
  Clone ID: uC-gsronu33B124d03b1
gtttctcttgatttcaaactcgaagtctccgccgctactaccagctttctattcatcgctcaacccaatggcagtcgcttccaactcgctcgtttctttcatccacggctcattgagtcaacccggaaggacctcccactttcttccttcaccttctctttctttccccggatctcgctcgctctctctgaaactcacccgccgctccaactcgccccttctttgctctttagatgcaaccaacgccacagataaggacaccccaatcgaaacaaggttcccagcttatccaactgtgatggacatcaatcaaataagagagatattaccacacagattcccattcttgttagtggatagagtgatagaatataatccaggggtatcggctgttggtataaagaacgtgaccataaatgataactttttccctggacatttccctgagaggcccataatgcctggtgttctcatggttgaggcgat

SEQ ID NO: 3451 - DNA, 459 bp, Gossypium hirsutum
  Clone ID: uC-gsronu33B124d04b1
catgagaaacaaacaaagccttagggtgggcttgaaccctctgattgttgatttttctccaattaaacggtggttttgataactgtgtactcgtttttccggttgcctcgttttagcaaaaataaattctaggtattggttccaattttcactccccccccggctcggattatagggataggacaattttcatctaggaatttttttgagaagaaaaagatgatgagaagacaacaacgaaatcagtgccaacaatcaaggtttttctacgagctgttggcgctggtcctaaatcttctacgattgcctacgatgccgcttcccttctctgaccaaccagccgccccggagaggattcctcttacgcgaacggcatctatgacgacgataccgacggcgggattcgcttggctgatgctaggaatatctatttcgttgatgctgtgtggatcagttact

SEQ ID NO: 3452 - DNA, 484 bp, Gossypium hirsutum
  Clone ID: uC-gsronu33B124d05b1
ctctgtacttagaagggtgttttcagttttcagttttcacttcaagttcctacctctcactttcttttcttgaagcttaacaacacagtagaaaaattttgttttgtttttttggctatggattttctcaggaatgtgtcagtctcgggtgaatatcatcaaccagagcaagtcctttcatcaccatgctctaaactgggcgcctctattgatgaccttttccctactcaaaatacggaagtggatgtgagtttggagtggttgtctatatttgtagaagatggcaaagctgtcagtgttgatacgcctctgtttgtgattgaaccttgaaataagactgtcgagtagcagagtaaaaggtaggaaggacaggcaggcaagcaggttgagttggtgggatttttcttcctggtaatgtagtttggattcattaaatgggcagtattatatactcctagtcttacagctatagtaaatagtcttt

SEQ ID NO: 3453 - DNA, 499 bp, Gossypium hirsutum
  Clone ID: uC-gsronu33B124d06b1
ccctctcgtccgctctgaggcggaaaagttacacagagatggagcaaacattcatcatgatcaagcctgatggcgtccagaggggtttggttggtgaaatcattggcagatttgagaagaaaggtttctatttgaagggtttgaaactcatcaccgtggatcaatcttttgctgagaagcactatgcagacctctctgcaaaacccttctttaatgggctcgtagagtacattatctctggtcctgttgttgctatgatttgggagggtaagaatgttgtcaccactggtcgcaagattattggagccacaaaccctgctgagtctgctcctggaacaatccgtggtgactttgcaattgacattggcaggaatgtgattcacggaagtgattcggttgagagtgctaggaaggaaatcgcattgtggttcccagaaagccctgttaactggcagagcagtgttcacccctggatctatgagtagatttcaaattaagc

SEQ ID NO: 3454 - DNA, 374 bp, Gossypium hirsutum
  Clone ID: uC-gsronu33B124d07b1
tttcctcccaactagaaatccacctccagcctctccctttctaacatcaaactgatctctgcgagcgaagtcacctccagcctctccctcctcaaaacacgcttttaagtttctctcttccgccaccgtcttcttcatcatcttcccctctttctttattttttttaatttcaacacctaacatacatgtttcatttcgcagaagccatctttatctgtttctcatgtgactctgaagcctcattctttccttcaacgtacccaagacaatactgctgatgttttggaatttaagttgaaggagctctcagccgtccattcgaaatcgccttccgttcatcaattctctgtcgccttcaccaagacactgaccc

SEQ ID NO: 3455 - DNA, 406 bp, Gossypium hirsutum
  Clone ID: uC-gsronu33B124d08b1
tttcacgtgacaacaaaaagaacaggatcaacccgaggcacgtgctactagcagtgaggaacgacgaagagttgggtaagcttcttcaaggagtgaccattgctagtgggggtgttcttccaaacattaacccagtgttattacccaagaaaactgctgctgctgcatctgattctgaaaaagctaaatccaaatcccctaaaaaggcatagacattggatttgatgcaaacaatgtacaactctttttgcttctgtggtattctagtggtttagggatctcgccatttttttgtattatcttagaaatggtggatgataattggtattttggctttaaaactttgtactctgattccgcattttgtaaagtgctccaagcaaatggattgctttttttatttaat

SEQ ID NO: 3456 - DNA, 494 bp, Gossypium hirsutum
  Clone ID: uC-gsronu33B124d09b1
tttacgcgtccgatcgaactgtgaaggatcacgaacaagcgccagttgccgtgaaagaagccataactgttccaggagaagccattgagaagcctgaagcaagagatttgcaacctgaaaaagctgaggttgataatggagaagagaaaacagataattcaggtgttgaaataaaattggaacctgcatccacaggtagtggtaatttatcattttccgatctactccaacaatctacagaaaagaaagtggagatggctgaacgtgtgattgaagagagggaacttacagtaagcaaggaagcagcaacggtggaagctgcaggaactattcaagccaaagaattaaaaactgatgaagtacctgaaggagaggaacagaataagaccgactccggctcggatgctccagtgatggtggaagcaccgagagaagctgaaactaaaccacccaagaaatctcaaaacatactatcaagtgttggatccaaagtc

SEQ ID NO: 3457 - DNA, 494 bp, Gossypium hirsutum
  Clone ID: uC-gsronu33B124d10b1
ttttgtggttctaaggtatcaaccaagattggagtgattgaatcactcttggccaaggttgatattctcatactgggtggaggaatgatgtttaccttctacaaggcccaaggatatgcggttggatcttcacttgtggaagaagacaaacttgatctagcaacatcactccttgagaaggccaaggcaaaaggagtctctctcttgctccccactgatgtggttgttgctgacaagtttgctgctgatgctaacagcaaggtggtgccagcgtcagggatcccagatggttggatgggcttggatattggacctgactccatcaaaacctttagtgagtctttggacactacccagaccattatctggaatggaccaatgggtgtgtttgagtttgagaagtttgctgccggcactgaggcggttgccaagaagcttgcggaactcagtgggaagggagtgacaacaattatcggaggaggtgactctgttgc

SEQ ID NO: 3458 - DNA, 379 bp, Gossypium hirsutum
  Clone ID: uC-gsronu33B124d12b1
gtaatgaaggattttagatatccaaatgggactgtgtactggttttggggtcaaatctaaaattttgtttggtcgatcattatatatgttggcttatgaacccatttcatttattggtatcatatatgaacagaatattagttgctgattatcatgataatgggtcgattttaaacagatactatcaacatatatatgttacgatgtatggccccaagaatgccgttggtaccatcaagatggacatgaactttattaccttccaaatgctgactgccaaaaagctatctaggaagtaacactacacttaaatcctttttgctccttgtacggttatgggacacaatcatggattttcgattgtgatgatacactcatt

SEQ ID NO: 3459 - DNA, 459 bp, Gossypium hirsutum
  Clone ID: uC-gsronu33B124e02b1
gtttgttgctgcacttcacctcggcaagctcggagctaagctcactaagctcactaaagatcaagctgattacattagtgtgcctgttgaaggtccttacaagcctcctcattacaggtactgagagaagagttgatgagtttttatcaagaaagaaaaaacatccggatggtttgattgtttcttgttttactgaaatttcatgatggttaggtttttgttttatttttagagttttttttgtgtttgggtgatgggaaagtgcctgggggtgggaaaatgatgtgggatttggtatcttcttgtatgaagatgaccaaatgggtttgaaataaaaatgttagggatgtgtggaagattatataggatttgccattaatgcagtcttgtttttctgcattgcttttttttaaagcaattttattttatatacttcaataccaacatgggatattcact

SEQ ID NO: 3460 - DNA, 499 bp, Gossypium hirsutum
  Clone ID: uC-gsronu33B124e03b1
ctttcctatttttcattttctgccctcaacttcatcttctcctacatttctttcttttccaaattgcagagattgaatgcaaaggaaccgatgggagaagaaaacaagaagattatgaaagaagaggtaattgcaaagctcaaggacgatggtgacttcgacaagctccgtctcaaaatcgtccgcaagcttaaggacaacgaacaaagtgatgggcaagatttcagatagtctctgggaaataataagattggaaggtagcacgagaattgaaattatagaaacagttgtttcccacagaaataataattagagtaaacttgcaagttgtttcccatagccattgtgatggtaatgctgcactataaatggattagtcgtgacccactgggacggtatacctctttctctgctctaatggcctttcctttctgttttcaattggggagggagccttttatctgctaattgtaataacccggtttcatattcctttttg

SEQ ID NO: 3461 - DNA, 193 bp, Gossypium hirsutum
  Clone ID: uC-gsronu33B124e04b1
cttttatccaaagaagcaaacaaaattatcaccacagtgcctgtgttaagaacaacctatctccctagtccctacttttctttattatggctatgtttgcaatgcaagaataagcaaacattgtaatgtcaataaagtttgcacttttgtagactggatggatgttatcaatgaagtacctagtttatacgtt

SEQ ID NO: 3462 - DNA, 409 bp, Gossypium hirsutum
  Clone ID: uC-gsronu33B124e07b1
ttctcaccctattcgacttggactggcactcaatttctctgttttctactatgagattctcaattctcccgatcgcgcttgcaatctcgccaaacaggcatttgatgaagcgatagctgagttggatactctaggcgaggaatcgtacaaagacagcaccctcatcatgcaactcctccgtgacaatctcactctctggacctccgacatgcaggatgacggggctgatgatattaaagaagcaccgaagcgtgacgagcaggagcaacaacaaaagccagagcagtagtgagggtcagccgggctcttactttcaattatataatttgccaatttagggtttcaattcaaaacgaaacttctaccgatttgatgtgtttttgatagaagaagaattggtgcctcctaa

SEQ ID NO: 3463 - DNA, 493 bp, Gossypium hirsutum
  Clone ID: uC-gsronu33B124e08b1
tttttactcgaataccaaaaaggaaaggtttgctttagtttctttgatcaatgagcttaccagggttcttcagtatctgtatgctccaatccatagtcgctattacttgtggagctttaatgatgttttacactaaggaagtcacagttttgggtcacggtcatgaaatagcaagcaaactgcaaggttcaacgcctcatgatcaactcttgatccaaacctcagaatccttttctgggttgcttttgttcactattggttttgtgttgttcatggtggcattcgttaaagatggagagttccaaagcttctttgctaaagggtgtgtgtcggttcatgtttctatggctatttggagagtttgttttgaaggaaaacttctgggttttggtcatgaatggcttagacaagctcttggggatattgctttggcactttcttgggttttccttctggtgtgttcatggagggaaaaatatgattagtttgattg

SEQ ID NO: 3464 - DNA, 457 bp, Gossypium hirsutum
  Clone ID: uC-gsronu33B124e09b1
tttacgcgtccgcccacgcgtccgcggacgcgtgggctccggtgacggaacagaaaccacaacagcaacagcaacaacaacaacaaccgactcggtgcacggtttgcaggaaacgggtcgggttgaccggattcaagtgcaagtgcgggattacgttttgcgggtcacacaggtacccggaaaatcatggatgcacgttcgatttcaagaagattgggcgagaggagattgcacgtgccaatcccgtggtcaaagcagagaagatcgtgaggatttgagaagaagaagatggaaagccgatcgatcctttgacttttaatgagtaaaagaaaaagagaaatagaaattgtcaaactcgttaagattgcgacacgtgtttcggtgttggtccccatacctttaaaaattgggcttggataaaaatattttatcttataaaataagtcttctattttta

SEQ ID NO: 3465 - DNA, 419 bp, Gossypium hirsutum
  Clone ID: uC-gsronu33B124e10b1
tgttcatgcgcaggattctgaggaaaatggcatccagacagttagatgaacttggagacataagcacgcttgcagaaccaggtgtagttgatcagcttattgcacttgcggatagctgaaacaattacaagtgtagcagaagtggggttcctctatgtttgtctttggaggttgttgtactttaaaccatagtgcgggtttatacatcatgtgatgcaatgcgatgcgaggtaggtagtacttgtagaccaatgtacaattctacactgaaaacaataatcactatcacaataggcataataattgtacttctttttcttcccatctttgttaagtatccttctatcctatggggtaaaagtatgatggtagttattgtattatgggttttttatcgaagaaatagataaattggtatc

SEQ ID NO: 3466 - DNA, 320 bp, Gossypium hirsutum
  Clone ID: uC-gsronu33B124e12b1
tgtcgtccgaattgtagtctggagaagcgtcctgagcgtctgaccgggcccaggggccctggaaaggggcgccggagagggtgagagccccgtcgtgcccggaccctgtcgcaccaagaggcgctgtctacgagtcgggttgtttgggtttagtagttagtaattttaagtttctctattactgtttggtttgggttctctcttttttgatcgatgttgttactgttctcttaaaatcataaaaatggaatgaagtatcttcttttcaaaataataaaataaaaaaaaaaaaattataaaaaaaataaaatattataaaa

SEQ ID NO: 3467 - DNA, 250 bp, Gossypium hirsutum
  Clone ID: uC-gsronu33B124f02b1
tcccacttgtttcgccacacggtcgggaactaatgaatggctatgacaacgtagtataataaggagcgtatagtgatgaaattggagttggtcttgtatctacttgaacagtcatcctagatacaatgacaagcagctggtgctgccgttatctaaatcgtgtatatacgacactagtaggtatggatctctaaaggatccaatctaaaatgattcacggattcaattagaatctttcttactgtggaaa

SEQ ID NO: 3468 - DNA, 503 bp, Gossypium hirsutum
  Clone ID: uC-gsronu33B124f03b1
ctatcttagctgttcgcagattcctcagagctccgattacgatggctgctgttaccggatccaatgtcgtctctctaaaacccgccgtgaggcttgctgatcctactgaccgaaaatgtgttcagattcggcaatggtctccgatttccgccggattcggatcggttcaggctcggccctgcatcggtctccagtgccaatcgaaacgatcatttgcgtcccccggtgtaaaagctcaagttgccactgttgaacaagccagcattgaagcagctcaaaacgtagaagctcccgtagccatagttactggagcttctagaggcatcggtaaagcagttgcgttggctttaggtaaagcaggttgcaaggtcctagtgaattatgccagatcatcaaaggaggctgaagaagtctcaaaagagattgagtcgtatggtggtcaggctgttacttttggtggagatgtttaaaagaagctgatgtagaaggaatgataaagactg

SEQ ID NO: 3469 - DNA, 496 bp, Gossypium hirsutum
  Clone ID: uC-gsronu33B124f04b1
attcttgaaatggacacatacaggtatcatggccagtccatgtctgatcctggaagcacctatcgaacacgtgatgagattagtggtgttagacaggagcgtgatccaattgaaagaatcaggaagctgatattgtctcatgatctagctactgaaaaagagttgaaggatgttgaaaaggaagtgagaaaagaagtagatgatgcaattgctcaagctaaggaaagtccaatgcctgaaccttctgaactcttcacaaacgtgtatgcgaaaggtttgggtgttgagtcatttggagcagataggaaagaagtaagagctacacttccatagtttgagacttctctggagtgagttcattaatttttaactcgttgcccaccaatcaatcttgcaagactgaaaagaaataaagcagctagggaaggtgatctgatttcccggctatcaatttgattttgcacttctatttgtatttgtatagagtactttattt

SEQ ID NO: 3470 - DNA, 496 bp, Gossypium hirsutum
  Clone ID: uC-gsronu33B124f05b1
aagattcaaaaaaacatggccaaagttctgttggtcattgctctatgtgtgcttccagctttggttagtgctacacgcattctgaataaccaattggtggttgaaggctatgtgtactgtgatacttgccgggctggttctgatacccacaacactagaaggctagctgatgccatggctaagctggtatgctccgacaggaagaccgactgagttgttttcctgaaggagggatataccgacaaaaccggaaaataccagattcgtgtatccgaggatcacttggatcagatctgtgatgcacttcttgtgaagagcccccagcttggatgtgccacaatgtcccccggtcgtgaacgtgcccgtgttatcttgaccaactccaatggcatttcatccaccacccgttatgccaatagcatgggcttcatggttgacaaggctgaaggtggctttgctgagatgatgaagatgtatcgggaggatgaggaggatg

SEQ ID NO: 3471 - DNA, 399 bp, Gossypium hirsutum
  Clone ID: uC-gsronu33B124f06b1
aaatgattggaagcattatcggtgtgtacaatggggagacattcaaccaagttgaaatcaagcctgaaatgattagccattaccttgctgagttttctatttcgtacaagccagtcaagcatggtagaccaggtattggtgctacccattcttctaggttcattcctctaaaatgaagtcttatccttgcaactttggatgctttatttgatgtttgtatgaagagatattttatgttgatcaaattttgattgatgcactatgacaatttttatatcgctccgaatgttatattagataatgcaacttgttttgcttttggagttgaaaaaaaaaaaaaaaaagaaaattaaaaaaaaaacttatagaaaaattaataattaaaatataattacttag

SEQ ID NO: 3472 - DNA, 500 bp, Gossypium hirsutum
  Clone ID: uC-gsronu33B124f07b1
gctttggttgcagcaccgtgattgatccttttgtttccagtgccattctagatgagttttgctcattgaaagatgctgattttcaaaacccttcagattgtttggtcgggaactttggttcttgtcaggatgttcagtctcagattacctctgctagccttgcagattctcaagctttctctcgacaagacttgcctgacagctccggtggcaatatcgattttgatgacagtggtcttctgcaaaacaattcctggaagcaaacagctccacgcgttagaacatatacaaaggttcagaaggcaggatctgtaggaaggtcgattgatgtcacaagttttaagaattatgatgaactaatctctgcaatagaatgcatgtttggactcaagggtctgctggatgatcccagaggttcaggctggaaattggtgtatgtggattatgagaatgatgttcttctcgttggagacgatccttggaggaatttgtcgggtgtg

SEQ ID NO: 3473 - DNA, 491 bp, Gossypium hirsutum
  Clone ID: uC-gsronu33B124f08b1
atttcattcgccccacggttgggaactaatgattggctctatatacaaagattttggatttgctcataatgatcaaattatatctggtcttgtttctacttttccagtcattctagatacaatttttaaatattggatctttcgttatttaaatcgtgtatctccgtcacttgtagttatttatcattcaatgaatgactgaaaaatgattcacggattcaattagaatctttcttactttcgagataagcaaagcatgcaaagtcgtacttactttactctttctacccatcaggagaatacaatttctcctctgtttcagtcattttttttttttttcagttttcagtaaaagtaaatagcagaatcgtggctagggaactatactagtgacctacctaattttattgtagaaattttcgggatcaatgattggaccatgcaaactagaaatactttttcttggataaaggaggagattactcgatcca

SEQ ID NO: 3474 - DNA, 503 bp, Gossypium hirsutum
  Clone ID: uC-gsronu33B124f09b1
tttcactatccggcacttcctttcttccgtaatcttactttcagatttcagtctcagtaaagctgtttttgcaccagccaaaatgggttcagttatatactctttctcagagtaagggcttttgttccaagtggtttactgcttcagccttcagcttcagggttggtgggtttttgtactgagttaaagaaatgcctctatatgattgtgtgcttttattgaagccccatgtgaagaaggaggggctcatcgatttggtagcacgtgtaggtagacatgtttatagcagaaatggggttctcactgagctcaaatcatttggcaccgttcaattaggttatggtatcaggaagctctccggaagatactaccagggtcaactcatgcagatgacaatgatggccacacccaatatcaacaaggagctgcagtacttgaacaaggaagacagactgttgcgttggcttttagttaagcatcgtgacacgaaatatgggctggaa

SEQ ID NO: 3475 - DNA, 492 bp, Gossypium hirsutum
  Clone ID: uC-gsronu33B124f10b1
attaaaaaaatcaaagatggcggaaaaagaagatctgggtttgagtctgagcttgagtttccctcagaatcaccactctttacagcgaaatcttaggccttcgcttgttccttcctctgctaattcttgctcttctctttctactttaacccttaacaaacactcatggaatgattcttctcctccttcagatcataactcggaatcattccgggcggagatggggtcaatttttagaggaatcgacatgaacatattgccatcgactgtagattgtgaagaagaagctggggtttcatctccgaacagcacgatatcgagcgtgagtggaaaaaggagcgaaagagaaggcaacggagacgagcttgagatcgaaaaatcctcatctcgtggaatcagcgacgaagaagatggcgacacttcgagaaaaaagcttagactttctaaagatcagtctgctattctcgaggaaaactttaaagaacacaacac

SEQ ID NO: 3476 - DNA, 497 bp, Gossypium hirsutum
  Clone ID: uC-gsronu33B124f11b1
tgttacgcgtccgcccacgcgtccgaaatttagatccgaatctaattctacgattttctttagagtgttaaatttgatctttctcttccaaaatcaattccaaaaagagagaaaatcccaccaaaaaaatggcgaattctaatgacaacaacaacgacgagcaccatgaatcgagtcctcttttgagcaaacaagtggcagaccaagatttgaaggaaaaacctagtggtaaaaaggcaaaagaagctgccgccgaggtgccagctcatccggtagttgctaccggagatgggtttgggtggacggctgatgggttgccgttggtccaccggagtgtcgtcggagaacccttgggtcgatctcaatggaactcatctctccttgcttgtcttggccgtaacgatgaattttgcagcagcgacattgaagtctgtctccttggaagcttggtcccttgtgtgctatatggaaccaatgtcgaaagacttggatctgat

SEQ ID NO: 3477 - DNA, 494 bp, Gossypium hirsutum
  Clone ID: uC-gsronu33B124f12b1
tgtttacgggatgataagcgtgatcggacacgagattgctgaactggcaactagcccgttggtgaacgcttggtatgccggccaagacccagtggcaccggtggaaatagcggatttatgtgagggtatttatggaactggaggtggtggatcttacacgggacaactatttaacgataaagatggtgccacgtttaacatgaacgggatcagacggaggtacttggttcagtgggtttggaatcatatcctcaattactgtactgggcctaatgcacttgatcagtaatttttattttgaaattaaaatattttagggttcctttattttggcattttgaggcttattaaatatggacttttgtaatatttataattcatatattattccttatatgaggatttgaaagatttggatggtggtgataacaggggttgaaattaaacgaattttcaatattttaattgctaattgaattaaatttaaagaaaaa

SEQ ID NO: 3478 - DNA, 506 bp, Gossypium hirsutum
  Clone ID: uC-gsronu33B124g01b1
aattgtttgagcctaccctccgtgaactacaagcaaagatgagagaagctgagaatgatcctcacgatggtaagcgaaaatgtgagacgttgtggcctattttcaaaattgcacatcagaggagccgctacatttttgacctataccatcggaggaaggaaatatcaaaggaattgtatgagttctgcttggaccaaggctatgctgaccgcaaccttattgctaaatggaagaagccgggttacgagcgtttgtgctgcttgagatgtatgcagccacgggatcacaactttgctacaacttgtgtctgccgagtgcccaagcacttaagggaggaaaaggttattgaatgtgtccattgtggatgcaagggctgtgcaagcggagattagattcaccttgttcttttccctagttttctaagtcaatgagagacggttaaactgtacttgctgccacactgctcattaacttttgtagttttatttgcactgctgtagtttctg

SEQ ID NO: 3479 - DNA, 433 bp, Gossypium hirsutum
  Clone ID: uC-gsronu33B124g02b1
agtttgttttcattgacactgttttgcaacctttaattcaaaggcttccaagactaaaggttgtgatggaacatatcaccactatggatgctgttagatttgctgagtccggtgaagaaggatttttggctgcaactgtcacaccacaacatcttattctcaatagaaatgctctcttccaagggggattgcagccgcataattactgcctttcagtactcaaaagagaaacccacagacaggctattgtttcagctgtgactagtggaagcaaaagatttttccttggaactgacagtgctccccatgagaaacaaagaaaagaatgttcttgtggttgtgctggaattttcaacgcccctgttgcattatcactatatgccaaggtcttcgaggaggcgggtgcgcttgataaataaaagcatttacaagc

SEQ ID NO: 3480 - DNA, 509 bp, Gossypium hirsutum
  Clone ID: uC-gsronu33B124g03b1
gtggtttgagattacatattcacgtctttattcagagagaatgcttacaacttagaagttcccttttagattccaacacttctgatgctgtacaacagacatgtggtgggacttttatttttgttggtgacatgatatcgatggtgcattcagttcagttgactgaatatcaacctcggtggggggtttttctcagcaaatatcttccaaataaactggaaaagagcttaatatgcacattccacatttctttagcattagctcttctcaatagtttgcccgtatatttcctagatggggaatcgattttggaggtggcgttgtcccacttcacatcattgagctcaagaaaaacaagaaaaatccatcaagtatgtgttgtgggagggagtttggtttcagttctggccttcttgaggatgacgtttatcaatttcttctagtatggatgtctttcaggaggtcagaagttaaaagggaaaaaaagaaaggatggagcatcgcttgta

SEQ ID NO: 3481 - DNA, 487 bp, Gossypium hirsutum
  Clone ID: uC-gsronu33B124g04b1
ttcttttgttaagatctctactgatgcttcaatgagggaattgatcccacctggtgcccttgttatgctcacaccccttgttgttgggatcttttttggcgtggaaactctctctggtgtcctcgctggatctcttgtctctggtgtccagattgctatctctgcatccaacacaggaggtgcttgggataatgccaagaagtatatcgtggctggtgcttctgagcatgcaaaaactgttggtcccaaaggttcagatccacataaggctgccgttattggtgacaccattggtgaccctttaaaggatacatctgggccatcactgaacatcctcatcaagctaatggctgttgaatctcttgtctttgctcccttctttgctacacatggtgggctgctttttaagatattttaagtgaagacaaacatcggctactagtctaccatttccgattcctgtctgttattctcttataattttcat

SEQ ID NO: 3482 - DNA, 496 bp, Gossypium hirsutum
  Clone ID: uC-gsronu33B124g05b1
gcttttgagaaataaaaacagtttcatttccattctaagtttgtgttttttatttgccttttgtgggttttttttaaaaaaaattcagcaaaaatgtttattgagagttttaaggtagagagccccaatgtgaagtacacggagaatgaaattcagtctgtttacaactatgaaactacagagcttgttcatgagaacaaaaatggaacctatcaatgggttgttaaacccaaaactgtcaaatatgaattcaagactgatatccatgtccctaaattgggggtgatgcttgtgggatggggaggaaacaatggttcaaccctcaccggaggtgttatagctaacaaagagggtatctcttgggctactaaggacaaggtacaacaggctaattactttggttcattgactcaagcatcaacgatccgagttgggtcctacaatggagaagagatttatgctccatttaagagtcttcttcctatggtgaacccaa

SEQ ID NO: 3483 - DNA, 512 bp, Gossypium hirsutum
  Clone ID: uC-gsronu33B124g07b1
tctttcattgtttttcagtagtgaagagctaaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggaatgatctttgctcttgtttactgcactgctgggatctcaggtggtcatatcaatccagcggtgacatttgggctgttcttgggaaggaaattgtcgttgacaagggcaatatactacatggtgatgcagtgcttgtgagccatatgtggggctggtgtggttaaagggt

SEQ ID NO: 3484 - DNA, 505 bp, Gossypium hirsutum
  Clone ID: uC-gsronu33B124g08b1
tgctaatcattttttttcttctcatctcagttctcgcccaccgccgtctccgctgatttttttcggatctgacctgtattccgtgtcggatcgtgttgacataggtattgcaccccaaattgccgagtcaaggtaacgaagcttaccatcccctcttctctctctcgtatttacaaatcaggtttcttcattctcttctcatctcagttctcgcccaccgcctctgctagtttttgtcggatctgacccgtataccgtgtcagtgatcactgttccaccgtttggtcgcttgcttattactaatagtggaatttaaccaatctgatatttgtttgcgaaagagattaattatgaattttcttccatttttgttactttgaatttggtatgagctttttcttttttctttcttaatcagttttctttaaaagggtctgctcgaacgagttagtgttttatctaaaattagaagacattttcttttttgtattaaatgtttctttta

SEQ ID NO: 3485 - DNA, 475 bp, Gossypium hirsutum
  Clone ID: uC-gsronu33B124g09b1
tcttagcttttcagacaaagcatcatcgccccaaatcctattcacctgtctcctgtctcaacacccaaatctgaaggcaaagtcatgtcggacgacgaaggcactggagaagactaccttttcaagattgtaataatcggggactcagccgttggcaaatccaacctcctttcccgctatgcccgaaacgaattcaacccacattccaaagccaccattggagtcgagttccagacccaaaccatggaaatcaatggaaaagaggttaaagctcagatttgggacactgctggtcaagaaaggttccgtgccgtcacttctgcttattacagaggcgctgctggtgctcttattgtttatgatattagccgccgcaccacctttgacagtgtcggccggtggctcgatgaactcaagactcattctgatgcgactgtagcaaggatattgggtcgcaataaatgtgacttggaaa

SEQ ID NO: 3486 - DNA, 492 bp, Gossypium hirsutum
  Clone ID: uC-gsronu33B124g11b1
ttcacgcgtccgggtttttgagagctgaggaaacatgggaggttgcgctaccaaacctaaggttttaaagggtgatgagatgccttctccggttgcaccatctcctgagccggcgaaacaacatgttcaggtcgctgatgatgagggaaagaaggtggaagctgagattgttaaggccaaggatgttgacgagacaaaggaggttgttattgttaatgatgcgaagcttgatgatcaagccaacgatcctcaatctggtagtaacttattgaatgagaatgaaaagaagggggtagctgagactgagagtgatagcaacacaccatcagagccaacgaaaaccgaatcagtagaggcagtgaaacaagaatcaatggagaccgagcctccgtctattggaggcaaagcagcaacagtggctgtcggtgagacacaaaatagggaaacagcagcagcagctgaaggtgaggaaaggaagactgaagtacaaag

SEQ ID NO: 3487 - DNA, 477 bp, Gossypium hirsutum
  Clone ID: uC-gsronu33B124g12b1
tgtctaaatggctatgatcccgagtttatttgggggccgaaggagcagcgtcttggatcctttcgctcttgatgtatgggatcctttcaaggacttccctttcccttcttcactgacgacaggttccccagaaacctcggcttttgtcaatgcccgcatggactggaaggaaacccctgaagctcacgtctttaaggctgatcttccagggcttaagaaagaagaagttaaagtggaggttgaagatgacagggtgcttcaaatcagtggggagaggaaaatagaaaaggaagacaagaacgacacctggcaccgtgtggagcggagtagtgggaagttttcgaggaggtttaggttgcccgagaatgtgaagatggatcaagtcaaggcttcaatggaaaatggagttcttacggttaccgttcctaaggtggaagtgaagaaacctgacgtcaaagccattgagatatctggtta

SEQ ID NO: 3488 - DNA, 466 bp, Gossypium hirsutum
  Clone ID: uC-gsronu33B124h01b1
cattcataaaatccaaagcatccccctctctctgatggttcatttccattttttcttttggattctacaatcatcaaatttctctcaggcttttcatcgagcaggagctatgatacggctgttcaaagtaaaggaaaagcagagagaacttgctaaaaacgcaaatggcggatcacctatcaaaaagcaatctgcaggggagttgcgtttacacaaagacatttctgagctgaaccttcctaaatcatgttccatatcatttccaaatggaaaggatgacctgatgaatttcgaggtttcaattcgacctgatgaaggatattatttcggtggcacgtttttgttctccttccaagtttctcccatctatccgcatgaggcaccaaaagttaaatgcaagaccaaggtctaccatccaaatattgacttggaaggaaatgtttgcttaaacatcttgcgtgaagac

SEQ ID NO: 3489 - DNA, 343 bp, Gossypium hirsutum
  Clone ID: uC-gsronu33B124h03b1
ctcttttttcactcctctgtttcagaatcaaaaggcggtctttctcgtcaatatggcagcaaatggcgttgtttctgacaagagcttgatcgtcagcttcggtgagacgctgatcgattttgtccccactgtctccggtgtttctctagccgaagctcccggcttcctcaaagcccctggcggggctgctgctaacgtggccattgctggtgctagactcggaggcaaagcgtgatttgtcggaaaacttggggacgacgagctcggtcatatgctggccgatattctcaagcaaaacagtgtctccggtgacgggatctttgtcgaccaaggcgctagaact

SEQ ID NO: 3490 - DNA, 494 bp, Gossypium hirsutum
  unsure (1)..(494): unsure at all n locations
  Clone ID: uC-gsronu33B124h04b1
cctattcatcatcctccaaagccacctaagcctgccgtggttaacccaccatatcaccctaaaccaccgaagccaccggtggtgaagccaccgtatcaccctaaaccacctaagcctgcgatggtgaaacccccatatcaccctaaaccaccaaaacatccaccgtatcctcccaagccacctgttgtcaagcctccctatgtacctaagccacctattgtaaagcctccaccgtatacacccaaaccgccggttgtgaagcctccgccatatacacccaaaccgccggttgtgaagcctccgccatatacacccaaaccgccggttgtgaagcctccgccatatacacccaaaccgccggttgtgaagcctccgccatatgcacccaaactgccggttgtgaagcctccgccatatacacccaagccaccttactatccaataccgncggtcatctcaccaccaacactgcctccaaagccaccagtctaccc

SEQ ID NO: 3491 - DNA, 188 bp, Gossypium hirsutum
  Clone ID: uC-gsronu33B124h05b1
gtttattttagaaggaagggaaaactgtaatttgaacattgtaatgaacctgttattgaatggtaggctagggttaggatttcaccattgttgtcattcaggaaactgttaattatgttctgtcttgggatttcattaagccccattcatttactctcaaattagagcaattggttggatcttgagtc

SEQ ID NO: 3492 - DNA, 415 bp, Gossypium hirsutum
  Clone ID: uC-gsronu33B124h07b1
tcctcctctttggttgagtgtagagatgaggaaaatcatgggtgccatagatcttttctggttttctttgctttccttttcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgactgagaaggagacagacaggagctttggccctaggaatttcatgtacattgagaccatcaaagaagctgtaaaaagggaatgtccctgaattgtttcttgtgctgatatc

SEQ ID NO: 3493 - DNA, 296 bp, Gossypium hirsutum
  Clone ID: uC-gsronu33B124h08b1
tggttgctacagacccgagaactgtgccaacgagatcgacgtggcggagctcagagccaccctcttgaagaagcagtaaaaaaaaaaacaaacaaacaaacaaacaaactagtctctatatttttagctcaacaaagctaacctgcttgcttgctcctccgtcctttgtgtaatacttaatgcttgatttctcatatgcgaatcaaggaatttgtactaggagtttcaattgatcttaatcaaatgcttgtttttacttgcattttcttaataattatttgtggtgttgctatgtt

SEQ ID NO: 3494 - DNA, 512 bp, Gossypium hirsutum
  unsure (1)..(512): unsure at all n locations
  Clone ID: uC-gsronu33B124h09b1
tccctcgcgtccgcccacgcgtccggccaaccccaaaaaagaaaaaaagagaaaaaaaaaactcttaagtccatcaattatcactacaatctctttccccttattttctctccaaagaagccctaaattttctcagcctttcttgctctttccctcgctttctcgggaaaaaaaatggcaaacgcggcttcaggaatggctgtgcatgatgattgcaagctgaagtttttagaactgaaggctaaaaggacttaccgcttcatagttttcaagattgaagaaaaacaaaagcaagttgttgtggaaaaggttggtgaacctactgatagctatgaggctttcactgctagccttccagccgatgagtgtcgatacgctgtgtatgactttgattttgtgaccgatgagaactgccagaagagcagaatttttttcattgcctggtctcctgatacatcaaaagtaagatgcangatgatctatgcgagctcaaaagacaggttcaaaaggga

SEQ ID NO: 3495 - DNA, 396 bp, Gossypium hirsutum
  Clone ID: uC-gsronu33B124h10b1
ttcttgttggggcccattgtcatcttggttcagccatttccaaggtggatatattcagggacgctgctgttctcatggtcaactacattgatgaaatccgtgcccaaggtttcgaggtagattatttaaacattggaggtggtttggggatagattactaccatagtggtgccgtccttcccacaccgagagatctcattgacactgtcagagaattggtcctctcaagaaaccttaaccttgtcattgaaccagggagatcactcattgcaaacacttgctgcttagtgaatcgtgtcactggagtcaaaactaatggaacaaaaaatttcattgtcattgatggcagtatggctgaacttatccgtcctaatctttatgacgcttaccaacaca

SEQ ID NO: 3496 - DNA, 491 bp, Gossypium hirsutum
  Clone ID: uC-gsronu33B124h11b1
tttctcgcgtccgcccacgcgtccgcccacgcggccgcttcttgatatgtccaccgatgagcttgtcaagctcttccccgcacgtgctcgtagaaggttccaaaggggtctcaagagaaagcccatggcattaattaagaaactccgcaaggcgaaaagggaggccccaccgggagagaaaccagaaccagtcagaacccacctgcggaatatgattattgtacccgaaatgattggaagcattatcggtgtgtacaatggcaagacattcaaccaggttgaaatcaagcctgaaatgatcagccattaccttgccgagttttccatttcgtacaagcccgttaagcatggtagacctggcattggtgccacccattcttctaggttcattcctctgaaatgaagtccatttctgcatctttacttggaagagacattttggttgctgcacctctagtatttttatttaatgacagtgtcatatgctttaa

SEQ ID NO: 3497 - DNA, 492 bp, Gossypium hirsutum
  Clone ID: uC-gsronu33B124h12b1
tgtcctggagttgtttcttgtgctgatatccggggtctgtctgctagagaaggcatcgtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagctcacagtgtcggcagaactcactgtgtgaagctggtgcatcggttgtacccagaggttgaccctgccctcagccccgaccatgttccacacatgctccataaatgccctgatcaaatcccagaccccaaggccgtccagtatgtgagaaacgatcgtgggacacccatggttttggacaacaactactacaggaacatactggacaacaagggtttgctgattgtggatcaccaactggcttacgacaaaaggaccaga

SEQ ID NO: 3498 - DNA, 502 bp, Gossypium hirsutum
  Clone ID: uC-gsronu33B125a02b1
ctccgtttttttaaaaaaaaaaaaaagggagagaaaaacaggcgctcctttaaccgatctgcgacagaaagagcatagcaaagaagctaaagagtgaagcgaagaagacccaaaccggaccccaatgactcacctcttgggcattggctatgtttggctacatgttgggttgtttgctttttggtagaaaagtgtgatttaggctttgaaggatattttggtttcaagttggtgatttaggatgaataacactaacataccaaagagctttggggctccatcccagtttgggaatcccgggacggtgccaaaatcgcaatctattcccatgaacaatcaaccacagacacaaggtgggcctcagtttccgggccacttccaattgtctgagcctcaagcacaggtgcttgcgcgtgcacaatatgtgcaggctcaggctcctgctcattcccaattcccggcttaggtgcagtcacaaagcggtagtaatagtaatgctaca

SEQ ID NO: 3499 - DNA, 368 bp, Gossypium hirsutum
  Clone ID: uC-gsronu33B125a03b1
cgtactcgtgggcctgaccttaacattgtctccaatgctagctgtaccaccaactgtcttgctccattggctaaggtgatcaacgataaatttggcattgttgagggtcttatgaccactgttcattctattactgctacacaaaagactgttgatggtccttccatgaaggactggagaggtggtagagctgcttccttcaatatcattcctagcagcactggagctgccaaggccgtcggcaaagttttgccagcactgaatggcaagctgactggaatggctttccgtgttcccactgttgatgtctctgtggttgacctcactgtgagacttgagaagaaggctacatatgatgaaattaaggt

SEQ ID NO: 3500 - DNA, 145 bp, Gossypium hirsutum
  Clone ID: uC-gsronu33B125a05b1
gtgactggtcgtctaagcttgagaagcaccgggtggaacagcaaaggcttctcgagcgagttcgggagctagcggcgcacaatgtttcactttagagagaagggtcttccttaaatgaaaaggacacagaaaacgaaagcatgat

SEQ ID NO: 3501 - DNA, 83 bp, Gossypium hirsutum
  Clone ID: uC-gsronu33B125a06b1
ctctttctattctctttggcttatctatcgttggggtttcttatacttgctgtgcactcaatggcaaatctatggttgaggcc

SEQ ID NO: 3502 - DNA, 429 bp, Gossypium hirsutum
  Clone ID: uC-gsronu33B125a11b1
acgcgcgctgtttgtaggtgtagggtgagaggaagcaggggcgcacaaggagctatgctgtgccgagcagaaagcattcaacccaaccccagctccacctgctgccagtgcttcctgatctttggttcagccaatttcattgttaaaatgcagttgtcaatgaagggtaatttaataagagagctgggcaattaggttgttgtaaaatcatggtctatgtcggtgtgagaaaagggcccatcaatttcatgatattatatatagttgtatacgtttgatttgctgctgttaggtggtctttataatttgcttttttgtgtgtgtgtagattatgatatatttgatgcttgttgtgctgtccacattcatataaaattgtatgtattgaaccaccatttttattcaatttgtctcctaaaattatttgct

SEQ ID NO: 3503 - DNA, 416 bp, Gossypium hirsutum
  Clone ID: uC-gsronu33B125a12b1
gcgtttacgcgtccgtctgtatattgaaattttggggctcgattttctctttagccgggaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcggcctccgtttgcgcggtgggatgcaaatcttcgtgaaaaccttgaccggcaagacaatcactctcgaggtcgagagcttcgacacgatcgacaacgttaaagcgaagatcccagacatggaaagcatccccccagaccagcaacg

SEQ ID NO: 3504 - DNA, 397 bp, Gossypium hirsutum
  Clone ID: uC-gsronu33B125b04b1
cccactcgtccgcccacgcgtccgtttggttttcagtatttgctcccatcaagaagaaatgggtttctggggaattgtaagaaaacctgcaaaaccacacccttatcattctgacaatgttcggggaaagcttaacattactcaggcaactttaggccttggatcatttaaagagaggtctgtacttcagtgatctgtcggacacaagagttcgatcatcctgtgttccttgttaccaactcagaatgagacttgcgccttatatcttaaatttgatgaagacgatgatttagctgatttctcagtacttggccctcaaagcatccacctctctggatactttgaggctggtcaccgagatcacctacgagatgaatgagcatgactcttatgggga

SEQ ID NO: 3505 - DNA, 556 bp, Gossypium hirsutum
  Clone ID: uC-gsronu33B125b07b1
cctacgcgtccgcccacgcgtccgcttggttgtactataattatactaacatgaaatctgttgcctgaacgtgcagtcaagcgacgaggaagaaggtgaaggagaagagaagaagaagaagaaaaagaaggagaagaagggactggaagaaaagattgaagagaaattagaaggggaaaagaaagaagaggacacctcagttccagtagagaagtgcgatgagccagtagtccagccagagacgccagagaagaaaggtttcctcgagaagatcaaggagaaactccctggacaacacaagaaagctgaagaggccagtagcccggctccagccccagcagctgagccccatcacgaagaggagtcaaaggaaaagaagggaattttggagaaaatcaaggagaagcttcctggttaccactccaaatcagatgaagaaaaagaaaaggcttgagattcaagttcacataaaaatactgatgggattgtgtgtttcttaaattgttcaaaaattatctgcttctgttttgagggtgtatttgttgatatttcatat

SEQ ID NO: 3506 - DNA, 527 bp, Gossypium hirsutum
  unsure (1)..(527): unsure at all n locations
  Clone ID: uC-gsronu33B125b08b1
tctcttacgcgttcgaaaaaaattcatgaactgaacccaatatgtaatgaatccttaatttttttcatttcttttttaccctttttcaaaagaaaaatggattgttgttctttttcatcgtcattaagcttaagtataagcttaatgttgaaacctcgtccgccattaatgaccattaactataatggtaactctcactggagtaaaaggaagaagaaaaggcattgtttgcttcaagtctctgcaatttcttaccagaacttcattcatttttcttttaatgaaactaaacgacatacccttttgcttccttctcctctacaggaaaagtatggttctatgatcgcaatggatgaacaaacatggcttgaaatgttatcattcgaaactcccaaaatcagactacttagaagtatgagcattgaaggtgaagctatgcaggtattagattttgctgtctttccgaaaccagaattngatctacccatattgtgtggcaacttcttcactactgctaacatgaacat

SEQ ID NO: 3507 - DNA, 489 bp, Gossypium hirsutum
  Clone ID: uC-gsronu33B125b09b1
ctgtggttctattggagtaaactacggaagaatcgccaacaaccttccttcagctaccaaagtagtggaactacttaaatcccaagctttaaaccgtgtcaaagtctacgacactgacccggctgttctccatgcattatctggatccggaattaaggtcaccgtcgacctcccaaacgagcaactcttcgccgctgctaaaagcacttcctttgctaactcttgggtccagcgaaacgtcgccgcttactaccctcacactgaaatagaagccattgccgtcggtaacgaagtcttcgtggacccccacaatacgactaagttcctcgtacccgccatgaaaaatatccaccaagctttggttaagtccaaccttcactcggatattaaaatctcttcccccattgcccttgtcgctctccaaaactcttacccgtcttctgccggatctttccgacccgaacttattgaacccgtttttaacccatg

SEQ ID NO: 3508 - DNA, 387 bp, Gossypium hirsutum
  Clone ID: uC-gsronu33B125c02b1
catgatcttcccaatgcaatgaatgctgccgaaataactgataagcttggtcttcattctctccgtcagcgccactggtatatccagagtacgtgtgcaacttctggggaaggcctctatgagggccttgattggctttccagcaacattgctagtaaggcatgataaaggatcagtgtattggttgttagttagacttgtcgaaactctggcaactcttgaagaggatatagcttcctgtttatccagcaacgtttgtaatgacagaatatttagctttgtttaatctttttacttggaattttcattttctttaatgtatttgtgttaaatattcggacttgttatggtttatatcggaaaaaaaaaatagtaacattgcatgtc

SEQ ID NO: 3509 - DNA, 296 bp, Gossypium hirsutum
  Clone ID: uC-gsronu33B125c04b1
cccactcgtccggtaattcttcatacagttacgatttaatcgaaggtgggcctttgggggataagctcgaaaaaattagctatgagaacaggtttgcggcatctgcaggtggagggagtatttgcaagagctaaatgaaattctacactataggcgatcatgttattactgtagaccaaatcaagggtgttattaaagggagtgagggagactacaagcctggtgaagcttacctcttgggtaatgccgaagcctgcaactaggatataaactggttaatttgaagtattatgctt

SEQ ID NO: 3510 - DNA, 422 bp, Gossypium hirsutum
  Clone ID: uC-gsronu33B125c05b1
cccacgtgttcgcccacgcgttcggcctgcacatttgatgtacgacggggaagacccaaggctgtttgagcacttctcggcggtggcgcagcggttgggagtgtacacggcggatgattatgcagatatattggaggcgttgataaaacggtgggggttggagaaaatggaggggttgacaggggaaggtaggagagcccacgattttgtatgtgggttagcgccgtggattaggaagttgcaggagagagctgaagacagggcttagaagaatggaccctaaggggtcaagtatacgttgatgtttaatagggagactatgttgtggctgttcatgtaccaaacatgtgcctggattgtttgattccccaaaccaacaggttatctttttttttttttggaaaattggaaatggtataccc

SEQ ID NO: 3511 - DNA, 558 bp, Gossypium hirsutum
  unsure (1)..(558): unsure at all n locations
  Clone ID: uC-gsronu33B125c08b1
cttgagtccagtattctaaggtgcatttttccatctactttccgtcactttcccgagaaaatgagagaaatcgttcacgttcaaggtggtcaatgcggcaaccaaattggagccaagttttgggaagttatctgcaccgaacatggaatcgactcaacgggtcgatacaacggcgactcggagcttcagctggagcgtatcaacgtttactataacgaaacaagttccggccgctttgttccacgcgccatcttaatggatctggaacccggtactatggacggcgtaagatccggtccgtttggacaaattttccgacccgataacttcgttttcgggcaatccggagctggaaataattgggctaagggtcattacaccgaaggagccgagcttattgattccgttctagacgtagtcagaaaagaagctgagaattgtgattgcttacaagggtttcaggtatgccattctttgggaggaggaactggatctggaatgggaacatngctgatatccaagatcagggaagagtacctcgatcgaacgatgcttacc

SEQ ID NO: 3512 - DNA, 548 bp, Gossypium hirsutum
  Clone ID: uC-gsronu33B125c09b1
ctcatgccgagtgtagcattccgtttaagatcgatacatctgccgatgatgaagatacctgcctgagagacggtgtgtattccgtggacggggacgagacagtacctgttttaagtgcaggtttcatgtgcgctaaaggctggcgtggtaaaacccgatttaatccctccggaattcgaacatacattagggaatacaatcatttgcctccggccaacctattggaaggccgtggcacccttagcggtgcccatgtagatatcatgggaaactttgcattgatcgaagatgttataaggattgctgctggggcttccggtgaagaactaggaggggatcaagtttattcaaagatctttaactggtccgagaatatcaacttgcaactggacgaggagattccggtacatttgtccagttgatcggatgaaacagctttgtattgcttggtgtttctcgaacaaatgatgaacataatgatcaaatattatatggaattggagaagtgattgtttgataatgtttacaccagggattgattactggtt

SEQ ID NO: 3513 - DNA, 477 bp, Gossypium hirsutum
  Clone ID: uC-gsronu33B125c11b1
actctacgcgtccggattggtacaagggtccatacggtccttgaggctcttgaccagatcaccgagcccacgcggccctcagataagccacttcgtcttgcacttcaggatgtctacatgattggtggtattggaactgtccctgttggccgtgttgaaactggagtcctcaaacccggtatggttgttactttaggacctactggtctgaccactgaagttaagtctgctgagatgcaccatgaatccctgccggaagctttccctggtgacaatgttgggttcaacgttaagaacgttgctgttaggatcttaaccggggtttggtggttcaaactccaaagatgatcccggcaaggaagctgccaactttacctcacaagttatcatcatgaaccaccctggccaaatcggaaatggttatgccccagtcctcgactggcccaccttttacattgctgtcaaattttctgagct

SEQ ID NO: 3514 - DNA, 365 bp, Gossypium hirsutum
  Clone ID: uC-gsronu33B125c12b1
gattaaaatcacagtaaatggggattttgcaagcgtcccaagtgccttttgcatcgacttgttcatcttcgtcttcttggccccctgctgcacctaaaacctttatccgcatgcaaatcatgggctgtgaatgtcaagttgagcaacgtatgcagttcgacgagtctgcgactgcgtaagatcggtggtggagttgttggggtcggtaaggaaggcgtacaaccagtgcgcattggtgaggatgataatggtcatgatacttctttatcagcaaccgcccaaccggaggaagatgaggacctccaatgcgttcgccaaatccaaagagttctacaacttctcaggaaaaaccgagacatgttatt

SEQ ID NO: 3515 - DNA, 452 bp, Gossypium hirsutum
  Clone ID: uC-gsronu33B125d09b1
cccacgcgtccgcccacgcgtccggcccctaaccttcctattcctactcctcctcaccgcctccgttctcgaatcttcgacttcttttgaacccaatatccgcctcccgacaacggcaacgatcgttcctcgatccgacattgatgacgacctttactgtgccagctggcagttagccgtcgagaccagtaacgcaggaagttgggccgcaatcccctcccgctgcgttcccttcgtcagagattatatgaccggtcaacgctacgcttccgactgcgaggtcgtcgctaattactccctcgcttacgcttccaccgtcaagatcgcatccgacggcaaagacgcctgggtcttcgacgtcgacgagactttgttgaccaatttaccctactatcgagatcacgggttcggatcagaaatttttaacgagagctgttgggatgaatgggtgg

SEQ ID NO: 3516 - DNA, 366 bp, Gossypium hirsutum
  Clone ID: uC-gsronu33B125d12b1
cccacgcgtccgattatggggaaaagcatgagaagaagaagaagaactaatagatgactcaaacaccattaatggaagagtccctttgctacaaagccaacaaagttgaacaatgtagctgttttaccatggttcgatgcttcctcattcattgccatactaaaaaaagtttattgtgattctctaatcaaattcgatcaactttattcgataaactcatgtttaggctattaatatttatttcgggttttaaaaattattttgaagttacaaattaaacaaaatgccttaagttcaaaggattgattaaaaaaaaaaaatatttaaaaaaaaaaaaaaaaaaataaaatattttatatttttttt

SEQ ID NO: 3517 - DNA, 407 bp, Gossypium hirsutum
  Clone ID: uC-gsronu33B125e01b1
gctagtaaagaccctaagcctaacctaacctaacctaacctaacctgcagactgctcgcaaaatcattaggtagcaatgggtacagttacagtgaagttggttgttgtgattatgataacggtgggtttaatggtggtagggtcaagagcaataagcttgtgtgacatgaacgatgagggtctggaagcctgcaagccatcagtgacccaaccggatcctgtcgacccaacacctcaatgctgcgaggctcttaaaggagctaacctcacatgcttgtgttcttataagaattcaatgttgctgccttctcttgggatcgatccaacactcgccatgggtttaccagcaaagtgcagtctcgatatgccttctgattgttgattaaagtattttcggaggaaaatga

SEQ ID NO: 3518 - DNA, 361 bp, Gossypium hirsutum
  Clone ID: uC-gsronu33B125e02b1
cctacgcgtacggatccatcagattgttattgtttgcgacattgggctgaaatggaacccgaatccaatacattccgaaggaaattggtatttacatggatgaccagagtgggaattaaagcatgaatcttttgtggttaaaccagcaagggggatatatgctttaatctcccattaaagaacctataagcaaaaatcaataaacattcatggggctgagctgatatttagtagatttagggatattttgtcttttctcatgtctggttatctttatttattgtttttattcagctttgtttgtaaggttcagctctcatggctttcttgaaaggtacaataatgtatagttttgtttctt

SEQ ID NO: 3519 - DNA, 234 bp, Gossypium hirsutum
  Clone ID: uC-gsronu33B125e03b1
ttctacgcgttcgcgattcaatatataatgccgggttttcgcattgcagttggatctgcacctgaggctggccaagctgatgccctcaaagcagctttagctgagtttatttcaacgctcatttttgtttttgctggtgaaggctcgggcatggcttttaacaagctcactgacaatggctctacaacaccggctggtcttgtagctgcatcggaggcccatgctttctctctg

SEQ ID NO: 3520 - DNA, 215 bp, Gossypium hirsutum
  Clone ID: uC-gsronu33B125e04b1
cccacgcgttcgtggacgcgtgggtcgcatggttggagtgtacggaggagaacactggtggggatgacgtggaggaggctcagaagctctgcggaagttgctggtgtctgttgcaggccaagagttgattcaattgcagcattcgagacctattctttatttctatattgatcagcttccccacttgccttagtagcctttactcccattcccca

SEQ ID NO: 3521 - DNA, 400 bp, Gossypium hirsutum
  Clone ID: uC-gsronu33B125e05b1
tctattactgcttatccaattgagagggttactgtgaatgggacaatataccacaagagctgcttcaagtgtacccatggagggtgtaccattagcccatcaaactatatagcacatgaaggtaaactctactgcaaacatcaccatatccaactcttcaaggagaaaggaaactacagccaactcgagaccgaacgagagaaacaagccgccaccgccgccaataaggttcctgcccctgctgcaacatcaaccacaaccacaaccacggagattgcagctgagtcgtaatgatctcagtgtgcatcactgctgctgcaatgaaaaaaaactttgtaaaacgatccaatgtcattgctgtgttgattttctgcaatggggtttttttaatttttttttt

SEQ ID NO: 3522 - DNA, 361 bp, Gossypium hirsutum
  Clone ID: uC-gsronu33B125e07b1
tccacgcgtccggatccatcagattgttattgtttgcgacattgggctgaaatggaacccgaatccaatacattccgaaggaaattggtatttacatggatgaccagagtgggaattaaagcatgaatcttttgtggttaaaccagcaagggggatatatgctttaatctcccattaaagaacctataagcaaaaatcaataaacattcatggggctgagctgatatttagtagatttagggatattttgtcttttctcatgtctggctatctttatttattgtttttattcagctttgtttgtaaggttcagctctcatggttttcttgaaaggtacaataatgtatagttttgtttctt

SEQ ID NO: 3523 - DNA, 153 bp, Gossypium hirsutum
  Clone ID: uC-gsronu33B125e11b1
aatatcttgcctttccaagacttggggtagggtataaatgttgtttgaatgggtttcttttgtttggtttggatgctaaagataaaaggaaaaaaacacctttactagtttcttgttgtgccatggttaactgattttatcttttcaaggcct

SEQ ID NO: 3524 - DNA, 362 bp, Gossypium hirsutum
  Clone ID: uC-gsronu33B125e12b1
ttagtcacgttgtcgaacaacccaggacactgtcaaaatatatgagtactatcttccttatattggcgacaccgagggcaataatcgtccacagccactttcttatgcttgagggtaataagagtaggaataaaactccatgagattgcttataccggaattggaacttttgagggaatgggaaaattaccctagtttctggggaaatttttgggttcaggctggtaaaataattactaggacaccaaggtaggctcctgggatagtttataggggactctttactaaaaaatcaccagactattttctttcttccaaaaaaaaaaaatatgtttttagaaaactcaagggatttatttaaa

SEQ ID NO: 3525 - DNA, 493 bp, Gossypium hirsutum
  Clone ID: uC-gsronu33B125f02b1
cccactcgtccgaaaaatgggaccactactgctggaaattctagtcaagtgagtgatggtgctggagctgttctgcttatgaaaagaagtgttgcgatgcgcaaaggactgccaattcttggtgttttcaggacttttgctgctgttggtgtggatcctgctatcatgggtgttggcccagctgtggcaattccagcagcagttaaatctgctggtctggaacttgatgatgttgatctttttgagataaatgaggcatttgcatcccagttcgcatattggcaaaagaagttggagcttgatccacaaaagattaatgtaaatggaggcgcaatggcaattggacatccattgggtgtaacaggtgctcgttgtgttgctacacttctgcatgaaatgaagcgccgaggcaaagactgccgattcggaatggtctcgatgtgcataggcacaagaatggtggcggcagtggtcttccaaaggcgtgattgtg

SEQ ID NO: 3526 - DNA, 449 bp, Gossypium hirsutum
  Clone ID: uC-gsronu33B125f04b1
gcgtgcgccgccctttccacgcgttctttagatcgcgagcggtctttatttttgggggaaacttgcgattttgtcttgcattttgttttcccttttttttccccacacctttttttaaacccatttgctaaaaatgcactgggttcttccagtgttgcttgccgttatcggagttactgcactgctcgttgtaactccggtaagtgggtaccgtccatggccgtacttaaaacccaacagcttcgacttaatgttcggaggctctaagaaatttgagggctcatcggagtttatccatatgagatatcatatgggtccagtccttactgctaatatcaccatccacccaatctggtacggccggtggcagaaatcccagaagaaaatcatccgtgagttcatcaactcgatctccgccgttgattccaaacacccttcggtggctgggt

SEQ ID NO: 3527 - DNA, 299 bp, Gossypium hirsutum
  Clone ID: uC-gsronu33B125f07b1
taatggaatgcttgataagtgtcaccattgtatgaaaatgaatgataatgaagacgtgtaattcatgccattgaaatgtgattataatgaaaacatgatcttttttgtatcttgtatgacataatgcatgtgcatggggtgggattgtggatgatggaggagtttcgtggagttatggtggcaggttaagactgcattaaaggtttctgcttcaatattcagttgtatttctttttggatttgaagaaatgtactttatggacaggttttccgatatatgagaagaaaatttttgttgg

SEQ ID NO: 3528 - DNA, 542 bp, Gossypium hirsutum
  Clone ID: uC-gsronu33B125f08b1
ctacgattttgaagaaacaaagaatcaaacatgtcgaaggaagtgagtgaagaaggggtgagccgaaaggactatgtggatcctccaccggcaccgctcatcgacgtggctgagatcaagctttggtctttttacagagctctcatcgccgaattcatcgctactctcctcttcctatacgtcaccatagccaccgtcatcggccacaagaaacaacacgatgcatgcgatggtgttggtcttttgggcattgcttgggcttttggtggcatgattttcattcttgtttactgcaccgccggtatctcaggtggtcacattaacccggcggtgacatttgggttgtttttggctaggaaggtgtcgataataagggcggtggcttacatggcagctcaatgtttgggtgctatttgtggagttgggttagttaaggcattcatgatgagtgaatacaactcccttggcggcggtgttaacacggaggcgactggttatacatagggactgctttgggagctgagattattgggacattcgtg

SEQ ID NO: 3529 - DNA, 285 bp, Gossypium hirsutum
  Clone ID: uC-gsronu33B125f09b1
gcttgtaaaactcctccactggcgccaaacgagccagggtttgacagcataactggctgaatgcactatagagagccttggctggagtgcggcgaggccatctcatcatctgtagacatgggtctagaaaaccttgactgctacgcccaaaaccatgctggcgggtactacgccaactgagactacaaatcggctcgcgaaacagaggaagactgcgaactatgctactactgtatcaaaaagcacaaactgcacaagttactataggaagaagggctggacaag

SEQ ID NO: 3530 - DNA, 510 bp, Gossypium hirsutum
  Clone ID: uC-gsronu33B125f11b1
cccacgcgtccgcaaaaacagaacaatagcagcaaccggaaaacaaagaagaaaaacttaatcatggctcggttgacgttcgtgacctccatcatccttctgctatgctccgttgccgctggatcaactttcgacgactccaaccccatccagatggtatccgatggcctcaccggcttcgaatcctccgttcttcgtgtcatcggtcacactcgccatgctctctccttcgcccgttttgcatacaagcatgggaagaggtatgaaaacgtggaggagatgaagctacggtttcagattttcgaagacaacttggatttaatcagatccactaacaagaagggactgccttatactcttgctgtcaatcagtttactgattggagctgggaagagttccagaaacacagattgggggctgctcaaaactgctctgctaccacaaagggcaatcaccagctcactgatgtcgtccttcctgattcgaaagactggaggcgagtgggcata

SEQ ID NO: 3531 - DNA, 362 bp, Gossypium hirsutum
  Clone ID: uC-gsronu33B125g02b1
ccctttcgtccggaatacttaatttgtatgtatagagggtctagcatacttttcttggaaatagtattgataaggattttatttatgtggaacagctaagagaatcattttccttatgtaggattgtattttccagccttttaagcttcagatgctgttagtatctgcagttctgtgaaccactctggtatacaatgatagttctcaggtctttgtgttagctgatatttagtagatttagggatattttgtcttttctcatgtctggttatctttatttattgtttttattcacctttgtttgtaaggttcagctttcatggttttcttggggggggcaattatgtatagtttatgttttt

SEQ ID NO: 3532 - DNA, 328 bp, Gossypium hirsutum
  Clone ID: uC-gsronu33B125g03b1
caaatgtataactgaagagagatttttcaatggaggatgtcaagcttctacgaattacttattgagatgatatgcgtaaatgcttttattttggatttatgttcaaatcatgttcatattcaagctgtttcataattgggccttttgaatgggagatcactttgagttagatcttttagggtttggaccgagctttcttttagattttgtgaaaaaaatataatccattccacatgtgtttcgggtttgagttatttggatttaggtttctgatttctttcaaaaaaaaataaaaaagaaataaaaaaaattggatacccttaatttg

SEQ ID NO: 3533 - DNA, 273 bp, Gossypium hirsutum
  Clone ID: uC-gsronu33B125g04b1
cccactcgttcgtggtcttttaggcttttttcgtttagtcattttcgtgaactgagatgtgggactttaggaaagaaagaacagatcgttgtctggttttttttttggggggttcaaggtttggaccttttatggtctggtaggggatactcggttctggtttaatcaaaaaaatgggggttggaatgagatgtgattaaaagaatctgtgaatgtgttactctatggggcatgaggttgtgacacaatttcatgataacagaaggcgaaatc

SEQ ID NO: 3534 - DNA, 317 bp, Gossypium hirsutum
  unsure (1)..(317): unsure at all n locations
  Clone ID: uC-gsronu33B125g05b1
ctattgaatatgctaagaagcataatgtgcctgggccagtgacaaagaaatcaatatacagcagagacaggaacttatggcacttgagccacgagggagatatcttggaggatccagcaaatgaaccgaaggaagatatgtacatgatgagtgttgacccgaaagatgctcccgataaacctcaatacgtgaaaattggaattgaatcacgcatccctgtttcacttgatggaaaaacttattcgccggctgaacttgttgctacactcaatgaaatnggggggaaacatgggatgggtcgtattgacatggttgaa

SEQ ID NO: 3535 - DNA, 518 bp, Gossypium hirsutum
  unsure (1)..(518): unsure at all n locations
  Clone ID: uC-gsronu33B125g06b1
ccttatgcgacggcggttaacagttatggtacggaatcggtaatctcgttgcctgatcgggtatcgaatccggaatggacccggtttaaatattcgagctccagatatgcggttcgggacgcccgaatcattttggatagttataatttgaagttgcccaatgtgagatggtctgtgttgggtgacgacgatacagtgtttttcactcataacttagtttccgtcttagcgaggtatgatcatcgtgaaatgtggtatattggcggaatatcagagagcgtataacaaaacggaatgcatgcatacgacatggcgtttggcggtggcggtatagcggtgagttacccattggcggagaaattagtcaaagcattggacggttgtttgaacaggtacttttatttctacggttctgatcaacgaatttgggcttgtatctatgagatcggngttccactcactaaagaaccaggctttaatcagtttgatattagaggggatccatatggactacttgc

SEQ ID NO: 3536 - DNA, 361 bp, Gossypium hirsutum
  Clone ID: uC-gsronu33B125g07b1
tctttgcgtccggatccatcagattgttattgggggctacattgggctgaaatggaacccgaatccaatacattccgaaggaaattggtatttacatggatgaccagagtgggaattaaagcatgaatcttttgtggttaaaccagcaagggggatatatgctttaatctcccattaaagaacctataagcaaaaatcaataaacattcatggggctgagctgatatttagtagatttagggatattttgtcttttctcatgtctggttatctttatttattgtttttattcagctttgtttgtaaggttcagctctcatggttttcttgaaaggtacaataatgtatagttttgtttctt

SEQ ID NO: 3537 - DNA, 467 bp, Gossypium hirsutum
  Clone ID: uC-gsronu33B125g09b1
cccacgcgtccgctcaatttccccatctctctcgtctctgggtctcgtaagttggtgaatagtgttgtaattagtgccaatggctcggattgggacctctgcagctcacattgtgttggcaatatttgctgtggccatgtttgttgtgtccgggaccatggcacaggatattgctccttctcctgcaatggctaccggagcaggctctgctttgccggtttccgctgtcttcttatgctcttccatgttggtctctttaattgctctcttggtgcattgaattcaaagcttttcaagactttatgacattggctacccttaatttcactctcactggtgatgaggggagtagcctctaatcttctccgagataatatttgggtgttatcaattttcaatatctctaaagttttaaatatctctatatatatcatgttacattagagacataaatttgattttgtaat

SEQ ID NO: 3538 - DNA, 465 bp, Gossypium hirsutum
  Clone ID: uC-gsronu33B125g10b1
tttatttcttcatttttccctaattagggggtttttttttttgttaatttatgaactttttagggactttatttcaataaatttaccaagtttctcaattacttagatcgaaactcgaacgagagagaaaaaaaagtagcgttcttttctcaacagaaggaaaaagaatggagtcaaattcatggaggtttcgattttccaattcttcttcgtcttcctcaaggcgtcatcaatctcgatctgatccgtttctgggtggaggatatgaagaatttgatggagaccaggatttcaaggcggagtttttatgtccgttttgcgctgaggatttcgatattgttgggctttgttgtcacatcgatgaggaacatcctgttgaagtaaaaaatggggtttgaccggtttgcgtgaagagggtcgggatggatatagttagccacattaccatgcagcatgggaattttt

SEQ ID NO: 3539 - DNA, 466 bp, Gossypium hirsutum
  unsure (1)..(466): unsure at all n locations
  Clone ID: uC-gsronu33B125g11b1
gttcactagggttttaagagaagaccaaaatggcttcaaaaagatcagcttccatggccctctttttagcactcaacattcttttcttttccctagtcagtgctacttgtcgatcttgctcttcttccggctctaatcccatccccacccccactccatctgcacgaggtaggtgtcccagggatgctcttaaattaggtgtatgtgccaaagtgcttagcttagtcaatgtcactgttggttcacccccagtgatgccatgttgttcccttctcaatggtctcgttgaccttgaagctgccgcttgcctttgcaccgctatcagagctaacgtcttaggcctcaaccttaatgtcccagtttcccttagcttgcttctcaacgtttgctcaaggaatgttcctactggcttccaatgctaattctagtcatcactctccctacattctntntcatctttctattt

SEQ ID NO: 3540 - DNA, 331 bp, Gossypium hirsutum
  Clone ID: uC-gsronu33B125g12b1
tactatgcatgcgatggtgttggtcttttgggtattgcttgggcttttggtggcatgattttcattcttgtttactgcaccgccggtatctcaggtggtcacattaacccggcggtgacatttgggttgtttttggctaggaaggtgtcgcttataagggcggtggcttacatggtagctcaatgtttgggtgctatttgtggtgttgggttagttaaggcattcatgaagagggaatacacctccttgggcggcggtgctaacacggtggcgactggtaataccaaaggaactgttttggaagctaaaattatggggacattcgtgcttg

SEQ ID NO: 3541 - DNA, 393 bp, Gossypium hirsutum
  Clone ID: uC-gsronu33B125h01b1
cctactcgtccgcccacgcgtccggtgaaagtgggtctgagcggctgcttaaactggaccgatgaggtcgttttgcacttgaccaagctacatggcgcaaccctcgagttgcttaatctcaacggttgcaggaggattactgatgcaagtttggcagcagctgcagaaaattgtgttttcctcagcgacttggatgtgtcaagttgtgcaatcaccgatgtaggtattgcagccttgtctcacgcagagcaactcaacttgcaagtcctttcgttttcaggttgttcaggagtatcaaacaaaagcatgaccttcctaaaaaaattgggcaagaccctggtggggttgaatctcagcactgcaattcaatcagcacccaaaccattgagctgc

SEQ ID NO: 3542 - DNA, 516 bp, Gossypium hirsutum
  Clone ID: uC-gsronu33B125h03b1
gcgtttttggcaagctcaaccgtcttgttataccggggcaacatgccgagaagtgctggccactcgactcttcctcgatcgaaaaagggttgctattgaatttcgaagatcggaacggcaagacatggcggttccggcactcgtattggaatactagccagagttatgtgatgactcatgggtggagccgtttcctaaaggaaaaaaagctcggccacggcgatacggtatcgtttcaacgcggagtcggggagctggttaaagcacggttgtacatcgattggaaactacggcctaatgcgctcgatccgttaccgctcgcacatatggagctccgaaatcagttcaacttgcttcaaccgctccggagggaacccatatgtatgtcacgaaattatgaacctttacatgggttgaattacagcattgaccgttacaatcaccgtcatgaccatcactgtcaacaccagcaccagcagcaggcagttacttacagcagcttgtcacaccattatc

SEQ ID NO: 3543 - DNA, 261 bp, Gossypium hirsutum
  Clone ID: uC-gsronu33B125h04b1
ctcagccgtcgaacccgccacgctattcaccaaagactcgaacgctccgcttgaggccgccagtgacggcggagaagctatggccaggaaagaaggtttctctacatcaaggagccgcagctggaggtactgtcccggtaaggtatgtgaggccgcgaggtccggagagcttgacacgtcgatgctgatgtggaagagggactcggcggctgtctcgattgatgagatcggtgttggggtccagacggttctagatcgcga

SEQ ID NO: 3544 - DNA, 218 bp, Gossypium hirsutum
  Clone ID: uC-gsronu33B125h05b1
cccacgcgtccgcttctcaagtatctcaccggaggatggaacactccggttcacacattagcaagtggaatggggttccttcaaggtgttatatgggagattattctcacattcgcattgctgttcacagtgtatgccaccatagtagacccccaagaagggtccatcgatggggctaggttcaatgctcactggctttcgtcgtgggggccaacatc

SEQ ID NO: 3545 - DNA, 403 bp, Gossypium hirsutum
  Clone ID: uC-gsronu33B125h06b1
tccagaaagctcttactgagcatcgcaatcctgacacgttgaagaaactaaatgatgctgaaaaagccaagaaagaactagagcagcaagaatattttgatccaaagatagctgatgaggaccgtgagaaagggaatgaaagtttcaaacagcagaagtatccagaggctgtgaagcattataccgagtcattgagacgaaaccccaaagatccaaaggcatacaggaatagagcaggatgctacacgaaattgggcgctttgcctgaaggattgaaagatgctgagaagtgcattgagctagatccaacattttcaaagggttacacaagaaaggagctgttcagttctttatgaaggagtatgacaaagctctagaaacataccaagaaggttgaagcatg

SEQ ID NO: 3546 - DNA, 527 bp, Gossypium hirsutum
  Clone ID: uC-gsronu33B125h07b1
tttataagcctcccacaagctttcatcgaacgggggaccctcattttatcttgagggccgtctctctctctctctctctcagttctgctctctcgatcgagttatagttgtatatgtattctatggtgacggtctagcatgtccaacgatctggtatctcagcagttgtcgatgcctggtaaccaaatggctcggctagaatcaatttccaactaagatcaggcttgagctgaattggacagctcagcttactgatctccaggaaagtttacagattgcatggcgatggcaaaaggcacatcgtgatggatacgcagcagcctcttaggtgatggttacctctctagagtctactcacaactattttatttgttatggcaattggcatattgaagactacccctaggtggcttcaattttaagctgtttatggaggggagggaaaatggagatgaaaattcactttttcagtacttggctagtgatctatctctattttagagagcgagagagagagagagagagag

SEQ ID NO: 3547 - DNA, 472 bp, Gossypium hirsutum
  Clone ID: uC-gsronu33B125h08b1
gtgaatttgcaaccgaaaaccgaatcaagaggggcgcaatctcatcgagctgcggaaaagaaaaatggatctcagaatcatgggtttcgattctccgctcttgaatactctccaacacatgatggatctttctgacgatacggagaagatcccgaacgcaccatcaaaggtttacatgcgggatgccaaagccatggctgcaacaccagcggacattaaggagtaccccaagtcttacgtgttcatcgtcgacatgccggggctgaaatcaggggacatcaaggtccaagtggaggacgacaatatgctcttgatcagcggagaaaggaaacgagaggaagagaaagaaggagccaagtacgtgagaatggagaggcgggtcggcaagtttatgaagaaatttgcgttgcctgagaatgctaacgctgatgccatctctgcaatctgtcaagacggggtcttaacctgtact

SEQ ID NO: 3548 - DNA, 506 bp, Gossypium hirsutum
  unsure (1)..(506): unsure at all n locations
  Clone ID: uC-gsronu33B125h10b1
tcttacgcgtccggttcactgagaaagggtggagggccaaggaaaaccagaggggcaacaactattacaatggtaacaatgaggccttgttcactgagaaagggtggagtactaaggaaaaccagaatcgcaacaactattacaatggtaacaatgaggccatgttcactgagaaaggatggagtactaaggaaaaccagaacaacaacaactattacaatggtaacaatgagtacaacaatgttgagaagcaaggtatgagtgatactaggttcttggagaatgggaagtactaccatgatgtgagttctgagaacaactactacccgaaccggttcgagaactcgaggggagtcggttcgaggaacgagttcaacgagaaccgttacaataacatgggaaaatataatcagaatcaagaggagttcgaagaagagttcgagccatgaaaccacacgtatatgctaattaattagcanaaagagagtaaggaagaagggtttatt

SEQ ID NO: 3549 - DNA, 506 bp, Gossypium hirsutum
  Clone ID: uC-gsronu33B125h11b1
ctcgaatcttaattattaccagacttctccctggtgccgttggaacaacttgtggtcaacgagtcgagaaggtatacggaacggaatactcagacatcctccgagtaccctttagaacagagaagggaattgtacgtagatggatctcgagattcgaagtctggccctacttggaaacttacactgaggatgttgctcacgaaatttccaaagagttgcaaggcaagcccgatctcatcatcggaaactatagtgacggtaacattgttgcctcgttgctggctcataaattgggagtcacacagtgtaccattgcccatgctttggagaaaacaaagtacccagattccgatatttactggaagaagctcgaggataaataccatttctcctgccaatttacagctgatcttattgcaatgaaccatacagatttcatcatcactagtactttccaagaaattgcaggaagcaagggacactgtggtcaatatgagagtcacact

SEQ ID NO: 3550 - DNA, 353 bp, Gossypium hirsutum
  Clone ID: uC-gsronu33B125h12b1
gcgcaccaaggcacactgacaacataaaacagaccactgaatttatttcttgtaaaaagcagttaacaggaaaagaaaagaaaaaaggaccaggaagagaaggaaaaagctttttattgtaatatgtggtgcaacgaaaagagcatcagcacataagcttctcaacagatgtaacttacctgaagttcaaagatcaagggtaaccatcatgtgccctaacgttgcatcacaatttaaattacagacttcaataatctcccctatcgcaaccacctaaaataaaattaaaactggccccaaataaccatgacaaaaaaagaatgtattactggtacacacacacacatgggtag

SEQ ID NO: 3551 - DNA, 536 bp, Gossypium hirsutum
  unsure (1)..(536): unsure at all n locations
  Clone ID: uC-gsronu33B126a01b1
ctctttatgagagatccaggcatgcttcagatggggcggtgttgagtgatgaccgacttaaattttaatctgagaattgaaccttttttctctacgtaaagatttatgattttgctttatcagatgagctagggagctaaaaggcctcagccaagaccggagaggcccagtaccatacatggggtattggaaaagctcataaaccatacatggggtattggaaaagctcatacaccatacatgaatggtgtgactacttgatgctattgagctgtgtttgattgcagtcacagaaaaggtccaagcctccatgtgataatccaaaatcatcagaaaaaaaagttggctaccctgtatttatatcaaagagagcttgttagtgccgattataattgtgagcttcaacgctggtacgtcagtgcagactttacatgcgagaatcaagccaagtaaagattggttcaatacaatcaaaggtctcttaaaagaagattngatctttaaggaatttgatgacaaggagacgttttagtggg

SEQ ID NO: 3552 - DNA, 129 bp, Gossypium hirsutum
  Clone ID: uC-gsronu33B126a05b1
ttcacgtactgaacatattggcgatcaatagagtcacctaactttaatgactggccgttaatttacaacggggagattggaaaaaccccagacttccctaatttaatcagcttgcaaccatcccccttt

SEQ ID NO: 3553 - DNA, 492 bp, Gossypium hirsutum
  Clone ID: uC-gsronu33B126a07b1
tttttgcgtccgccagccaggtaatgttctgggggcttttttaaagcttctatggctaccaaatgggcaaaaatattatcagttctcagaatataacaaaaacagatactattaaaattggttttaatctcttgaatatctttgatgattgctctgatgaccgatctgtcttgttctgaactttgacactttttgataatcgttttcgaatctcccattatttgtaaatctttaagccccatagatcttcctaactctaaggcttgtaaccctgcatgtgcttctaccgcgaatggagttgtaatgttggtatggattactgactttgagaccaaaatctccccaccctggcctcgaacaatcagtcctgaagcagaacttgcattttgctgatcaaaggccgcatcaaagtagactgaaattctcgtacatctctcaacagttcgcaggacaccatttttctgccaaatgatccaaagcccgaaacagaaa

SEQ ID NO: 3554 - DNA, 534 bp, Gossypium hirsutum
  Clone ID: uC-gsronu33B126a09b1
gtttgctggggaactggtcttaagctcggaaggggatccttaggcatcacatgggccactcacagaaatattggaattgcccttttcgttcttgctactgtgcagatttttgccttgtttataaggcccaagaaagatcacaagtatagattctactggaacgtttaccaccacagctttggatacgccatccttgtccttggcatcttcaatgtattcaagggtatcaatatcttgaaacctgaagacaaatggaaaacagcttatatgattgtgattattgccttgggtggtatttcattgctgtttgaagccattacttgggttgtcgttttgaagagaaaatctagaaagtccaccaaaccttgcgacggatacaacaatggccaaagttgatggcatcagcaagcctccaattgcagattttgtaacacccttgtgctttctcatccttggtgggatgttctatttcctattttcagggtcttggataattgcttggttccaaatgttggtttttttagcactcgatcc

SEQ ID NO: 3555 - DNA, 70 bp, Gossypium hirsutum
  unsure (1)..(70): unsure at all n locations
  Clone ID: uC-gsronu33B126a10b1
ttttaaaaaaaaaaaaaaaaaaaagggcaaanggggaaatttaaaaaaaaaagggggtccaaaaaatacg

SEQ ID NO: 3556 - DNA, 312 bp, Gossypium hirsutum
  Clone ID: uC-gsronu33B126a11b1
ctttctcaatctgatcccaccattcattcaaaacaccaaatttgttactatcaaggggatcaattttctttttctagttgatccagatcccagtcaaaactctcacgaagaagaaacatgagtggtgacgagaaaaacccggctgtagttgtagatcaccagcatcatcaatatgggactttccaaggagtatccaactaccctcctccacctcctcctcagcaccatggcccggctattgggtttcctcagcctgttccgccgcctggcctccatgagccctctgctccttctcctcagtattacccccaa

SEQ ID NO: 3557 - DNA, 303 bp, Gossypium hirsutum
  Clone ID: uC-gsronu33B126b02b1
gcgccctttcgtccggagaaataaacggggagactgggaggagaaataatatcagatcctccttctaaactctccacaaagaaaagggaaaaaaaaagagggagatggggttgtcttttacaaagcttttcagccggcttttcgccaagaaggagatgcgtattttaatggtgggtcttgatgcagctggtaaaactactattttatacaagctcaagctcggtgaaatagtcaccactatcccaaccatcgggttcaatgtcgagacagtggaatacaagaacatcaagtttactggttggg

SEQ ID NO: 3558 - DNA, 243 bp, Gossypium hirsutum
  Clone ID: uC-gsronu33B126b04b1
tcggcctcgcgttcgccgtgatcggtaagggcgcacggaacaagcagggcagtcatgacgtgcatggcgcgccgctgggcgccgagaaagcgaggagaaataaaatagagaaaaaaagaatgacaagataaaaaaaaaaaaaaagaacgcctagaaaaatagatattaaagagggcagcacgaacaataggaataacactaacatacctggacactcaagcttacatgaattcaattttgata

SEQ ID NO: 3559 - DNA, 366 bp, Gossypium hirsutum
  Clone ID: uC-gsronu33B126b05b1
tctacgcgttcggaaagcaacttttagatggggggatgtttgtcatatgatcgtatggtattagtgctttcaactttcaatgtggcaacaattgcagcaattaaattagttagattgacgagcttaacacgatgaatcggatcgcctcggagttggctcttgaggagttcagcaggaacactatgagtaccaccaccatccctgcaccctctgccttccctgatttcgctcttcatccgcccatcgcccatctttctaattctttccacttcactgaattttccggagatgcagctgagcttagccctcaaacacatgtattattgtcacagacgcttacctcacaccttgattttcaatcatcct

SEQ ID NO: 3560 - DNA, 218 bp, Gossypium hirsutum
  Clone ID: uC-gsronu33B126b08b1
attgcaagggttgagccacttgtaaacatggggcagattacacgtgtcacagttccaatgaatctttcccttgctgtggttgcagagcttgacgatcttacagtaggtggtctcatcaatggctacgggattgaaggaagctcacacatctatggcctgttttctgatactgttgtagcttatgagatagttttggctgatggccgcgttgttagagc

SEQ ID NO: 3561 - DNA, 548 bp, Gossypium hirsutum
  Clone ID: uC-gsronu33B126b10b1
tttacgcgtccggaaagcaacttttagatgggggcatggcagtcatatgatcgtatggttgcagtgctttcaactttcaatgtggcaacaattgcagcaattaaattagttagattgacgagctaaacacgatgaagcggagcgcctcggagttggctcttgaggagttcagcaggaacactatgagtaccaccaccatccctgcaccctctgccttccctgatttcgctcttcatccgcccatcgcccatctttctaattctttccacttcactgaattttccggagatgcagctgagcttagccctcaaacacatgtattattgtcacagacgcttacctcacaccttgattctcaatcatccttctgcggaaatgagtcgtggggaagtacagtgtgtgaagggaataactcaaactataggagtagggagaatgaagttagaggagctacaactctttccttcgatcatgatccgtccgatgatgatgacgacgatgtagaagaagaagatgatgatgatgatgatgatgatgaagaaggagga

SEQ ID NO: 3562 - DNA, 422 bp, Gossypium hirsutum
  Clone ID: uC-gsronu33B126c02b1
gattaagtggttgccgaatgtgaaggggacgtatggaaatgtgtacaaataatatttgtatggataattggtttaaaggggtcggcattatacattgttgatatggtgttattaatgtagaacactttagtatagacgtatatacatatggtcacttagaacgtattgagatggccgaataagactaacgatgagtatgctttgattttctataatacttagtaatttgtttaaggtgattaaagatgtgtacgattattttatattgtactaaagagcgtattaatgcatgtttggtacttgagatgaatgtatgctgctgatctctttgtcatattagagtaatgttattttggtgtctttatgagaaggaaaagctacagtctgtaataatatatttggcaaatgagaatggttaataa

SEQ ID NO: 3563 - DNA, 427 bp, Gossypium hirsutum
  Clone ID: uC-gsronu33B126c03b1
aaattcttaaaactaagagtagcaccagccgggggccaccacaccagccccttcccgacgttcaccctctaccggagggcctccgacgtccaccacgtcattcatccgccacccgctccccgacgcctgttgtgttatggatccagaagctgcacgaactgcccgagaatctctagatctggcatttcacatgtcaaatattctcgatacgggtcttgatcggcatactctttcggtcctcgttgctctctgtgatttgggtttaaaccctgaggctttggctgctgttgtcaaggaacttcaaagagaacctccaccatcaaccccggtttcatcttcttcatcacaagtaccttaacttcggagttcggtattttctaagtaacttacgaggaatgccttaaaagttgagttttaatttggtttg

SEQ ID NO: 3564 - DNA, 260 bp, Gossypium hirsutum
  unsure (1)..(260): unsure at all n locations
  Clone ID: uC-gsronu33B126c05b1
cgtttacaatggagatcaaacaagacgctcgtgggggactgtgtgaatgcagccgtggtggatatcacaggttatggatcaaacaatcgtatgaacgagatgtcattgcgcaggtctcatatgagggacatggagagtgcatcgcccacattggttgaccatgtgtgtgcccaaattaaggaatgggcttccggtgacggtaatcatgtggtggacaatgatnatnaccgtggacagtgacagcctgntggtggaaaagg

SEQ ID NO: 3565 - DNA, 534 bp, Gossypium hirsutum
  unsure (1)..(534): unsure at all n locations
  Clone ID: uC-gsronu33B126c06b1
gcttatctggaatggctttccgtgttcccactggggatgtctctgtggttgacctcactgtgagacttgagaagaaggctacatatgatgaaattaaggctgctatcaaggcggaatctgaaggcaacttgaagggaattcttggttatgtggacgaagatttagtctcaactgacttcatcggagacaacaggtcaagcatttttgatgccaaggctggaattgctttgaatgacaactttgttaagcttgtgacttggtatgacaacgaatggggttacagttcccgtgttatcgacttgatccgacacatgtctaaggcttaagtgagtgagtgattgtgctttgtgtatccaagctttagcaattttaatttagaagagatgttatgagagaataaacgaattgtacggagcatatttttgtgtgaagagggttgtttcagttttattacccacgtactcgaatgtttcaggtttcattgcagatggttctctactctatgcatatgtngtgattatggtttctctactt

SEQ ID NO: 3566 - DNA, 494 bp, Gossypium hirsutum
  Clone ID: uC-gsronu33B126c07b1
tttgatgatcccgccgaagataatcagtccgaggatgagactgattcacagtctgggaacaaggaaaccgaatctgcttcggacagtgaaaattttgcttcctctatggactataatgcagtagacaagggaaataaaatggtggtatcggattctgctatcgagaaaaatactgaatcccgtgaagatggtgatatagatatggatgctgtagatgcagtcgacaatgttgaagaaactctatcaggggacaagctagctgaatcatctgtcggagaatctgatgaacataacagtcagagtgatacgacgagtaagggtgttaatcaagttgataacgtagctgtttccgatgaacttggagttcgagtctcagttaaggaaaacacacttgccggttccgagtctggggagaagttagcaatgtcggcttcccccgagaggctttaatctttggtacgcgtacaaattgtgatgcaatagagatggaaact

SEQ ID NO: 3567 - DNA, 461 bp, Gossypium hirsutum
  unsure (1)..(461): unsure at all n locations
  Clone ID: uC-gsronu33B126c08b1
gtataagcgaagagaggaagtttgcagccaaagaaaaaattgcgattgaatcgacggcagagcacagcaacaacagcagaacatccggccatgttaagccatcccttaatcagccattacttcatcactccaccgaaaatgtgtgactccaaaagccctttttaactttttaacaacaaatgggccaggcactaccattatgtcaccaagtttgtgtgtttatgaatgtgtttcttttttgttaatggctgctttctttctccaagtagtagagagggcttaaaggagaagcttttctgaagtgatgatgatgatcccatatgcttttttgtatgtcgatttcttggtttgattttgagattttccttcttttaaatgcaaatgtatggagttaatggtgaaaatcattatgatgtatgatggcaaaagacatgctctctttttttctctattaaaanaaa

SEQ ID NO: 3568 - DNA, 448 bp, Gossypium hirsutum
  Clone ID: uC-gsronu33B126c09b1
tttacgcgtccgcccacgcgtccgtgacttcaaacgctgatgaagttcaaaagaaagtccttgaggagattctttcacgcaatgctcatgttgagtacttccaaagaaatggccttaatggtcacactgatagagaaactttcaaaacaatcatgcctgtcatcacctatgaggatatccaaccttatgttgaccgtattgccaatggtgatacctctcccatactttcttcccaccccatttctgagtttttgacaagctctgggacatcaggtggggagaggaagctgatgcccacaattgaagaagaattagggaggagggcactggtctatagcctggtgatgcctggtatgaggcaatttggccctggtctagacaaaggcaaaggaatgtactttttgtttataaaatccgaggccaagacacctagtggcctggtggcacg

SEQ ID NO: 3569 - DNA, 515 bp, Gossypium hirsutum
  unsure (1)..(515): unsure at all n locations
  Clone ID: uC-gsronu33B126c10b1
tgtgtcgcgtgggcacaaacacccccaaagtatatcacttttctttctttacaatcttcatttgttcagatttttgaagttctcataccatgggtgannggtgagattcattgtctgtgacaactttgagtccttcgggaaagctagttcagatcgagcacgccttgacggttgtcggttcgggtcaaacatctcttgnnntcaaagctgctaatggggttgtaattgctaccgagaagaagtnnncttcaatcttggttgatgaaacatctgttcagaaaatacagtgtctgactccaaatattggagttgtttacagtggcatgggtcctgattttcgagttttggttcggaaaagtaggaagcaagcagaacaataccataggttggataaggaaccaattccagtaacacaacttgtaagggaaactgcagctgttatgcaagagttcactcagtctggtggtggtagggctttggtgtatctctactaggtgctggatatgacgacaatg

SEQ ID NO: 3570 - DNA, 532 bp, Gossypium hirsutum
  Clone ID: uC-gsronu33B126c11b1
tttaagttagggttttcgctccttacgattatcgagatcgtccttttgaattgaagtatgggaaagaggaaatcaagagcaaagcctgctcctaagaagcggatggataagcttgacactgtgttcagctgccccttttgtaaccatggaaccagtgttgagtgccgccttgatatgaagaacttgattggcgaagcctcttgcagaatatgccaggaaagctttagcactgttataacagctttgactgaaccaatagacatatacagtgaatggattgatgaatgtgaacgtgttaacaaccttgaagaagaggacgatggggatcaggatgaaggttatgtgcctagaaaacgggtttcgacatctgaatgggactagcagtagcgatggatgttttagtacttaccaaggctgtaattatgttagttttctgtggggagtagttgtgtgcaagtatgcatatcttacagcatcttatggtatgaatagcctaaatgatccattgtatgctaagcaagagcttcgtcaa

SEQ ID NO: 3571 - DNA, 470 bp, Gossypium hirsutum
  Clone ID: uC-gsronu33B126c12b1
tttatacagcagctgaatttggaggaaaatgggggacgctttgtttgagcttgagcagaatctaagatcccgaaaggaacaattaacccgacaagaagaaaacatttttcaaaggtgtaagtcctcggcgcttaatcatttcacggctggtgtaattgctggtggtggtcttgtttgggcagcaacatggaagctgaataggttacttcgggtaaacctctctggtggagctgccataatacttggattttggaaatttgggaattccctagattcgagtgttgaccatattcttgcgttagacggaactcggatgcaaagtgaattagcaaatataatagtgaagaaatatcggcatgatccttggaagatgagacttatctctaaacatttctatttagaggaagtacttgatgattcaacttcagggccaaatttaaggtggcgttatcgaaatttctttggtgata

SEQ ID NO: 3572 - DNA, 333 bp, Gossypium hirsutum
  Clone ID: uC-gsronu33B126d01b1
ttcagaccaataatggcacgtcaacatcgggaggatgtttggaaaataaagcttttcggacttgatagggaagcatttctttttaccaaatgcaaaatttttgttgtatcgcttgtactggtgagtggttttggaactttatatatccgctggttttttctgattggagtttgcacaagtggtgttggtgaatagcagttttggtattggtttttgggttactatgtaggaagaaatggggtgtattcgggggttcacttgtgcccttgttagaagacttttgcagtggttatttgcgtgtaggatctggatgtactctttcactcttttctg

SEQ ID NO: 3573 - DNA, 261 bp, Gossypium hirsutum
  unsure (1)..(261): unsure at all n locations
  Clone ID: uC-gsronu33B126d02b1
atacaaaccaaaaaaggcacggcaacatangggagattttaagaaaattagggttttcccaccccaaagggaagcatttcttatcaccaaacgcataattaattgatgccacgctagtcctggtgagtgggtccggaactctacatatccgcctgggttcttcatggaaggagtttgcaccctctcgggctggcgaatagcctttatgaccccggtctttggattaccatcaacgaaaaaaggggaaggaccttggggttc

SEQ ID NO: 3574 - DNA, 436 bp, Gossypium hirsutum
  Clone ID: uC-gsronu33B126d04b1
ttttcttgaaattcgaaagtaccaagaagagtagcggagcatttttatacaggaaatgggggtttttagacgcttgttcgtgaaattgcccaggacttcaagactgatttgcgtttacagagccatgctgttctagctctccaggaagctgcagaggcataccttgtgggtctttttgaagacaccaacctttgtgcgatccacgcccagcgtgtcacaattatgcccaaggacatccagttggctcgtatgatcagaggagagcgtgctataatttcatgtgtgtggatcagtcgcttagaaagaagaaactattgtttatttttaggcaaatgtattggttttttgctttttctaatcatattttaagccatgatggtagtggtaggctcaatgtgaagtgatgatgaagtggggcgtttgatatgttaatgga

SEQ ID NO: 3575 - DNA, 546 bp, Gossypium hirsutum
  Clone ID: uC-gsronu33B126d05b1
gttggatcataacagggcactaggtcaaatctgagagaaactaaatgtccaagtttctgatgttaagaatgtgattatttggggtaatcattcatcaactcaatatcctgatgtcaatcacgcaactgttatgactccatctggagaaaagccggttcgcgagcttgttaaggatgatgcatggttgaatggagaattcataaccactgtccaacaacgtggtgctgcaatcatcaaagctaggaaactctcaagtgcactatctgctgctagtgctgcttgtgatcacattcgtgattgggtccttggaactcccgagggcacatgggtttccatgggggtttactctgatggttcatacaatgcaccagctggggtcatctattccttccctgtaacttgtaagaatggagaatggacaattgtccaagggctggcaattgatgaattctcgaggaagaagttggacttgaccggagtggagctgacccaggagaaggaattggcatactcgtgcctctcatgaatgcattcattatttccata

SEQ ID NO: 3576 - DNA, 549 bp, Gossypium hirsutum
  Clone ID: uC-gsronu33B126d06b1
atttcatagcaatggagagttacgaagaaaaacgggaagttgaggatgaagaacaagaagaggctttgtcactctgtgatttgcctgtgaatttgattgaagaaaaggaactgaaaaatgaagaaaatggtgaaccatcacaagaagaagatttcaacttcggttcatggcctggccatggtggttcgtttaggtccgaaccagaaatgtgtgtagctgatgaagtgtttttcaaaggccaaatcttacctttgcgtcactcagtgagttccgacaccgggttccgccgtcatgacagccacaacatgtcccggtccttgtcgaggtcagaatccatggaccatggttcattaagtaggttcacaagtgtgagtagcagtagcactaggagcagtagccattactcaacgagtagtactaactcgaaacccggtatgaaaatccgaaacaacttcaacacacacccgagcccaaaaccttaaatccgatcaacccgaaccgccgtcacagtcgaatccaacgatcatcgtcgatgtgggatttttttaa

SEQ ID NO: 3577 - DNA, 442 bp, Gossypium hirsutum
  unsure (1)..(442): unsure at all n locations
  Clone ID: uC-gsronu33B126d07b1
atacagaccaataatggcacgtcaacatcgtgatgatgataggaaaataaagcttctcggacttgatagggaagcatttcttttcaccaaatgcaaaatttttgttgtatcgcttgtactggtgagtggttttggaactttatatatccgctggttttttctgattggagtttgcacaagtggtgttggtgaatagcagttttggtattggtttttgggttactatgtaggaagaaatggggtgtagtnggggggttcagttgggcctttgctagaagactatgcagtggtttttgtgtgaaggagctggatgaaccccgtcactcttttatgttccactttgttatggtgcgtaaatgtctttgggatttgatcatttattatgaaggatccagctgatatattttttttatcttactaatgatataaaaaatttaatatt

SEQ ID NO: 3578 - DNA, 576 bp, Gossypium hirsutum
  unsure (1)..(576): unsure at all n locations
  Clone ID: uC-gsronu33B126d08b1
gtggtagcactatttggtctggctttataccatgggaaccgtcaaagggtcattgatgctggcactatcccgttgctcctccatattatagcgtcttcgaataaagacgagctcattgtggattcgttagcgcttttggcaacgttagccgagtgtctcgacggaacgttagcgatcctccaggcctcctcgtttcctttaataacccgaatcttgcaatctacaacatctcaagcggggaaagagcattgtgtttcaatcttcttgtcttgttgcactaatggcggtgacgaggccgttgccgtattggctaaggatacttcggtgatgagctcgttgtactcggttacgacggacggtacggctcaggcaagtaaaaaggctcggtcgttgataaagatgcttcataaattccatgaaacaagctcgtctggacagggtgtcaagcatttacgaatgaacaatcagttcatgtttggtagtatagtaaaatttatttgctgcatgtaaatatatatacttaantaagattngaatttcgagacattagctcagttttggaggagctaatgacta

SEQ ID NO: 3579 - DNA, 445 bp, Gossypium hirsutum
  unsure (1)..(445): unsure at all n locations
  Clone ID: uC-gsronu33B126d09b1
cattgaccttgtgtcgcatgaatgatcagggacttgaggcgtgcaagccatcggtgacacagccgaacccggtcgacccatcacccgagtgttgcaaggctctgaaaggggctgacttgacatgcttgtgttcttataagaattcggtgtggctaggtactttggggattgatccaaaacttgccttggatttgcctccaaagtgcaagctccaaatgcctagtgtttgctaaggtttccagaagagcatgaagctgctttctcatgtttgttggactttcacaagtttctttgtattgttttgatgtgaaaatctttgcaaatcttgtatctgtttcgtgttaaattattatttggttattgaagtttgtacggacaagtgagtggaattggccgccttctgctctttttaattntcattactctttttatgtntttggtgttc

SEQ ID NO: 3580 - DNA, 517 bp, Gossypium hirsutum
  Clone ID: uC-gsronu33B126d11b1
ttctaccaaagaggattgcctgtctttggaggggtcaaaattagagttgtattggacaaatccaaagaagaaaaaaaatggagagattgccttctgatatttgtcttaagattttctgtttcttggatcatcagaaccttgcttctgccctacaagtttgcaggaaatggaaattgttgggttcggataacaagctatggtgtaacctattcagagaaagatggggagtggatgaagctgcattttttgcccctgaacccttagaatccacatcttggaaacatgtttacgagacacaagaccgatgtgatcgggttggattggggctgaagataatcaaagaagggggagattactttcttgtacatcaaggtaaaatccaacgctacctgggttcaaggattaaaaggaaaggggtgaaagagtgtgagttcagcacaacatcgaatcatgtggaggaaccctgtcgagggattctggataaaatactcttcttcttgggcgaccttgaagctgc

SEQ ID NO: 3581 - DNA, 579 bp, Gossypium hirsutum
  unsure (1)..(579): unsure at all n locations
  Clone ID: uC-gsronu33B126e01b1
ccctcgcgtccgcccacgcgtccgcccacgcgggcgcccacgcgtccgctgagctctgttctctgagtaagcttcagaattatgtcctctcagagctcaaattcacagctgagaaaaacaagatgagaggttttgagtatatcaaaggagtgattttggaagcccgggctttcgacatggagcgagatctagtgactgcaacattgaagaaaaaaagaaacaatctgctcaaatattatcaggctgaaatagatgcactctaccataacttgactacaaaaaaatgaaaagccgaagtagtatgcttgtgccatacccccacggtttatcgtcatcctataggtgaaaatggtgttgaatgcctatgcttaatgcataatataagtaataattgtcgttaactggtnttcaatatagaattcagaaggcacaagttgcatttcagtggggaaagggagaagatttatggtgatattagcacaacaaaaggtgaaatttatcagacgcgtgggtgttcaccttcttattatttgattatcacctatcctttgagtagaatatgattttatatatttcatt

SEQ ID NO: 3582 - DNA, 210 bp, Gossypium hirsutum
  Clone ID: uC-gsronu33B126e02b1
cttttgcgtccgcagcagccgaggccaatatgtggggtgatccagatgctgcagatattgtgttcacaagtggagcagatgttttggctgtagggataaatgtaactcatcaagtaattttgacagattctgaccgagaaacattgttataatttttcagttttccttattcctggatttgatttcatttgattaacccagactttcctt

SEQ ID NO: 3583 - DNA, 542 bp, Gossypium hirsutum
  Clone ID: uC-gsronu33B126e03b1
cctttgcgtccggtcactgaaaatcatgaagggggtgaaattttcttacatggaggtgacagtgctgcagtatttcataatgcaagcactcgattttgtgatggagcccgatttggacttggtgctgaggttggaataagtactagcaggatccacgcccgaggcccagtcggggttgaaggactgttaacaactcgatggatcttgagggggagtgggcaggtggtggatggtgacaaaggggttatttacacccacagggatcttactcagtaaacttaactatagtctgcttcaagagatgcaaagaaatttgtctttttattgtctttttcatgcttattattattagagtctatcttgtaatatagcactgcagatctgcttaggtaactgcgtatggcgttactcttttttttccccagatgttttcacccttactatcatattatgtccttggataaagatttttaagatacatctaggatttctggcaagctgttaggtgaaaaagactgatatggcaggttgaaatttttatt

SEQ ID NO: 3584 - DNA, 496 bp, Gossypium hirsutum
  unsure (1)..(496): unsure at all n locations
  Clone ID: uC-gsronu33B126e04b1
cattagcaatggatttcctcgtagaattgttcgggaacttacttgcacatccagattggactatgaccgaatcttgtacagactcctatggcaaaaccctgaaaaagttccatggctggattgctagttccgctttcacggttgcattgaagttggctccagataggaagaagttcatggaagtgatagctggcaccggagatgttaatgctgacatggagaaattttgttcgactttccccccatttcttgaggagaatcacaaatatctggccaagtttggcttggatgatatgaaggcatgatggaacaagtttaatgagtagaggagagactacctacctatatttttactcccgtgttcgaacttccagtatcttgcttacggcttaaaccttcgttgttacttgaaaaaattaatgacttttaaacacatactcttgaatgcttangttttagtaatttttggttaaatgtcttgacccttgaataatgt

SEQ ID NO: 3585 - DNA, 226 bp, Gossypium hirsutum
  Clone ID: uC-gsronu33B126e05b1
ggttttaccgacgagaaaattttcgtcaccttgggttatttttctcatattatcaattttcttagttgcgccatcgttttccggcaccgatactttcgttttcggaggctgttcgcagctgaaattcacttcgggctcacagtacgagtacaacgtcaactcgatactcacttccctagtcaactcagccatgttcacttcttacaacaacttcaccatgtcagct

SEQ ID NO: 3586 - DNA, 321 bp, Gossypium hirsutum
  Clone ID: uC-gsronu33B126e06b1
cctatcgcgtccggtcattattgggcaatgcaggccgttgtctaagaccgtgaggtttaatgttttgaaagtgattccagcaggatcttctggtggtgggaagaaagctttcaccggaatgtaagcttttctatggtagtccatggttataggaaccaatagagaagataatcaaagaaattaagttcttaaactgcatttagctttgaggatattttactgttagaattgttttcttttttgggttattttcttgttttgattttgtcgaattacgaaatacggaattttgaagatatctttatttaagtttggctttgg

SEQ ID NO: 3587 - DNA, 476 bp, Gossypium hirsutum
  Clone ID: uC-gsronu33B126e08b1
tttcactctttaggtttattgcattaaataaaggatgaaatctttccttcctttctttgcattcctctcacttctcctgtttgtagacaccattgcagcagctaggaaagatgctggagagtactggggagctgtaatgaaagatcagcctatgcctgaggcactccaagagcttgttcggattgaggctgccgttgccaaccccgatgagaaaaccaagtgccatacatcaggtaacattgagcttaaggaagagaagattattgttaatgaggagttcgaaccaaggccaaacatttcagcttacggtgatgacgctaatctaaaaggagataaatcatcatcttttgcagaagattttgaaccgagacctaacatttcggcttacgggggcgatgatgctggtcttaaaggacagaaagaatcattcactaaagatttcgatccacagcccaatatcttcgcttcaataacta

SEQ ID NO: 3588 - DNA, 213 bp, Gossypium hirsutum
  Clone ID: uC-gsronu33B126e09b1
tttactgcctgcaaatgttgcggatttgatctgattgagtcagcattttcatacacaagagcaaaggttgctttagtaaaaaaaagaaagaaagattgtctgtttgttttgtgagtgaaaaggttaaagtgttcatcgccctaggtatggtctgggtttgagtcatgttaatctcattgttattaggactttatcctattcttgtaactcagc

SEQ ID NO: 3589 - DNA, 490 bp, Gossypium hirsutum
  unsure (1)..(490): unsure at all n locations
  Clone ID: uC-gsronu33B126e10b1
ttgcaatccattttccccgagtaaaacgccagagaaaacaaaaaatatgagagaaatcttgcacatccaaggtggtcaatgtgggaaccagatcggggctaagttctgggaagtcatatgcgacgagcatggagttgacaacactggaaaatataacggtgactccgaccttcagttggagcgcatcaatgtctactacaatgaagccagtggtggaaggtatgtcccacgcgctgttctcatggatctggagccgggcactatggattccgtcagatctggtccttttggacaaatctttcgccccgataacttcgtcttcggacagtctggtgctggcaacaactgggccaagggtcattacacggagggagctgagctcattgattctgttcttgatgttgtcaggaaagaggctgagaattgtgattgctcngcaggatttcaagtttgccattctttgggtggtggtactggatctggaatggga

SEQ ID NO: 3590 - DNA, 530 bp, Gossypium hirsutum
  Clone ID: uC-gsronu33B126f01b1
tgtgtgtagagatgaggaaaatcatgggtgccggggttctcttcttctttgcttggctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagagaaggcatcgtttcgttgggaggcccttacattcctctcaaaactggaagaagagacggtagaaggagcagagcagatgttgtggaggagtatctttcggaccacaatgag

SEQ ID NO: 3591 - DNA, 539 bp, Gossypium hirsutum
  Clone ID: uC-gsronu33B126f03b1
cccatcgcgtccgcccacgcgtccggagagagaaaagcaagaccaacgccatggcttgcactattgacttccgccgccttgatgaaggcttcggcggcaaaacgtacaaacgaaagcgacaagaatctcagatcgttgccaatgacgacgaggctgcccccgccgccgcttccatggacgtggatgattcttgccccccacccgcaaagcgttcagccgtgccttcctcggacgaccccaataaacccaccttcggtcaacccacctacgacggcgtgattgcgggtaaggtgtctggtaggaactggaagcagccaagaaagcagcgtgcgtcagcgaagcacgtgagcataaggaggacgagcttggaggagagggagaggcaaaaggagatcaagagagcttatagagagaggattaacgagttgaaggaagagatacggcaaaataaggtggagaagagaaagaagagagaggagagagagtagaagaagatagagaacatattgtggtctggaactaaggttcagaagattact

SEQ ID NO: 3592 - DNA, 479 bp, Gossypium hirsutum
  Clone ID: uC-gsronu33B126f04b1
cccttgcgtccgggaaacaggcaagtagttgttggagcattgcaattcgcttgcaccgacgatgtgcccaccaatctcgccactgccgaaaggctggttagggctgctcatgcaaagggagcaaatatcattcttattcaggaactgtttgagggttattacttttgtcaagcacaaagggaggatttctttcggcgtgctaagccttataatgatcaccctaccattaaaaggatgcaggaacttgcaaaagagttgggtgtggtgctgccagttagtttctttgaagaggcaaacagtgcccattataattctgtagctatcattgatgctgatgggactgatcttggactgtacaggaaatctcatatacctgatggaccaggataccaggaaaagttctactttaatccgggagatacgggctttaaggtttttcagaccaaatttggaaagaatggagttgcaatatgttggga

SEQ ID NO: 3593 - DNA, 453 bp, Gossypium hirsutum
  Clone ID: uC-gsronu33B126f05b1
ggttgtcagaactcccttctcactttgtcctcaggttgaggtggacattcaaaccgctgcatcagattggatctccggtgcacttcaggtggagcaatagaaccctgggaaggccaacaaaaaaaatcttaaatcaatcaatttgtatacatccgcaggaggcattacatttagtcatcaattgagttgtgcttctattaatttccattgaaatgcttgttctgtattttccctgttcattttttcttctaggggttcccaaaatatcaataactcgggtgtttgtcttttgttctagctgtttgttgatacaaggaaatagcatggtctaaattaaatatgaccatggtctttctgcaaattcttcatgttgttgttgtgggggcttttcatgtaatatggtcttttgatttgtttaaatttatgtgaatgtttctaggcctaaaaaataaa

SEQ ID NO: 3594 - DNA, 528 bp, Gossypium hirsutum
  Clone ID: uC-gsronu33B126f08b1
ttcacgcgtccggaagcaggatgcttcccaggggccaaataacttgggttgtctgcaatcacttttcttattagatacagaaggcaaagctgataacgaatctcttattccagaagtcatctcaaggtctaaacatttgagggtgttaggtttggctgagtgtaatttagagcaattgccaagcaacataagttatttaaagcagttgagatgtttgagcctagcctacaatggaaatattaaaagatttccaaattccatttgcaatttgcagagtttgcgaacacttgacttttctggatgcgggggaattgaagagttaccaaaagacataaggtacctgattagccttagagaattgacggtaacaacaaaacagacgcgtttgcaagagaatggaatatcgtgcctcacttgtcttcgaaggctgatcttttctgaatgtgaaaatttagaaaaattggttggaagacattcaaaacctaacagctctccgagaattgtacatatatgaatgccacaacttgg

SEQ ID NO: 3595 - DNA, 69 bp, Gossypium hirsutum
  Clone ID: uC-gsronu33B126f09b1
tttacgcgtccgaaaaaaaaaaaaaaaaaagggagatatttaaaaaaaaaaaggggaattttcccatac

SEQ ID NO: 3596 - DNA, 399 bp, Gossypium hirsutum
  Clone ID: uC-gsronu33B126f10b1
cttccaggctttgcacctgttgtccctcaagagtgtagtgactgtgggaagaaatttaacatgggcggacctatatggtctgctcccatccatgatcaggattgggtaactagcatactagcagatgtaaaatcaatgaagaattgttatccggcctatgaacgcatctctgctgtattgactacaatttcggaggagttgcctgatgttcctctctttttgagtctgcacaacctctgtgctacactaaaatgcacttccccgtctgcagttattttccgctccgctgtcatcaatgcaggatatcaaatttgtggaactcatgtaaatccattgggactaaaatcagatgctcccatggatgtcatttgggacataatgcgctgctgggttaaaaat

SEQ ID NO: 3597 - DNA, 510 bp, Gossypium hirsutum
  Clone ID: uC-gsronu33B126f11b1
ttttcgcgttcgcccacgcgttcgagatttgggattttctgatactttttaggggtttttcccaatttttttgtatttctaaaacaaaacaaataggtgtctcaatggcagaagagagcggtgcccctgtaagttgtgctgatttgcccgttaaaaggcccagagaagacgaagaaaacggggtctcttctgctgctgctgttgttgccatggaaatggaagctgataccaataacacttccaaggaagttgatgggatctcctctgttattcctggatggttctctgagattagcccaatgtggtctgtagaggcgcattccttaaaggttgaaaaggttttgtttcaagggaagtctgattaccagaatgttatggtctttcagtcatccacatatgggaaggttcttgttttggatggtgtgatctagctcacagagagagatgaatgtgcatatcaagagatgatcactcatgttccactttgctccattgcaaattcttagaggg

SEQ ID NO: 3598 - DNA, 114 bp, Gossypium hirsutum
  unsure (1)..(114): unsure at all n locations
  Clone ID: uC-gsronu33B126f12b1
tatatccatgtatttccacataaaaatatgngggttttttttaaacacatttggggttttctaacacccaatattatacatacacctatggcaaaaccctgtaaaagttccatg

SEQ ID NO: 3599 - DNA, 539 bp, Gossypium hirsutum
  Clone ID: uC-gsronu33B126g02b1
ccttttcgtacgcccacgcgttcgcggacgcgtgggaacattttctcctttttatctttaaaacacgcacccaaaaaataaaaccctttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatctatgatgaaccaatgacaccccgccaatgcaacatgatcgttgagaggctctgcgattatctccttcgacaggggttatgattctcttcagggggtgtcttatttgaagga

SEQ ID NO: 3600 - DNA, 568 bp, Gossypium hirsutum
  unsure (1)..(568): unsure at all n locations
  Clone ID: uC-gsronu33B126g04b1
ggttgcgatttacatgaaggtgaatgggggaaggtcggtaccattgtccattggagttatgtgcatgatggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgacttcctttctcatgtattttgatctgaatatgtatgtttagatcaatatgcagtcaaggggagggagctttgtattttcttgcatgtttgtctttttaattctgtatgaattcaatgtatcctatgcttttattgngttctatgaatataataag

SEQ ID NO: 3601 - DNA, 66 bp, Gossypium hirsutum
  Clone ID: uC-gsronu33B126g05b1
gaatatgtcagtactggctgtggctgtggctggggctgtggactgactatattagcttctttctct

SEQ ID NO: 3602 - DNA, 334 bp, Gossypium hirsutum
  Clone ID: uC-gsronu33B126g07b1
gtttggcacgcgcacttggtgatattgcggggggggagataaggacatgttactggataacaacctgttacgtccactacaatggttgcgttcaatatgggctcggtggggctggatatgcaccacgtaagactggaaggtggctacattggtggcaatgatctgtgcatggagaggtgggtcaggtcaacgcgataagagagtgggtacaactgagtcgagccggaaatgcccttatgctcttctaaggggagacagcctcgctactgtgagcgtgtgaagagcttatgtgcgaactacgtgaggttgccaggctatgtgtagatgggaaggg

SEQ ID NO: 3603 - DNA, 539 bp, Gossypium hirsutum
  Clone ID: uC-gsronu33B126g08b1
cttccctagatcgtctccaagagagagatctccttacagctaccgtacacattcacacacacattcactgaatgggtcgagtcatccgagctcaacgtaagggtgctggttccgtcttcaaggcccacacccaccaccgcaagggtcctgctcgtttccgcagcctcgacttcggtgaacgaaatggctacctcaagggtgttgtcaccgatgtcatccacgaccctggccgtggcgctcctttggcccgtgtcgtcttccgtcaccctttccgttacaagaagcagaaggagcttttcgttgccgccgagggtatgtacactggacagttcgtctattgtggtaagaaggctactcttgtggtcggaaatgtattgcctcttagatctatccctgaaggagctgtcgtttgcaacgtcgagcatcatgtcggtgatcgtggggttttcgctagggcttctggtgattacgctattgttattagtcacaaccctgataacgacaccaccaggatcaagctttcatctggttcgaagaag

SEQ ID NO: 3604 - DNA, 324 bp, Gossypium hirsutum
  Clone ID: uC-gsronu33B126g10b1
ttttcacgtacgccttatcttgagagttttaggtgatattactatcatgggtgtccatgctctgaattagctgccagtcattgaagtaccatcatctgctgtgacgcgagaaaccgattgatggctgcaatagagctaaaaggctgaagttgctcgtgagaacgccggttgatttgaggagcttgatgttacgatatactctaacgtgcgtgactatagtttcgggttgactaactaagtgtttgacgatcctgtgcttaggaatcaaacgatcactgatgccatgccttatcaagggtgagttgtcccatgcgagcaactttt

SEQ ID NO: 3605 - DNA, 334 bp, Gossypium hirsutum
  Clone ID: uC-gsronu33B126g11b1
tcttcgcgttcgtttaaagcttagagacatagggtatagtaacattagattcgtgggtgttgcgagttatgagtttgaggtaacctacccaattgctacagtcaggcgttttaacggcttgtgttcttgaggctgccaaaatttgtgccacggatgaccctcatgcagtcaagagtgttgagctcgtaggtgattctagttctggaagtcatggaaagatcacctgagtcgaaggcctcttatacgaatatatgaagcatcagattggaggtcacgacgaaaacaacttttattacacctacagtatgattgaaggtggaccttttgtggacaa

SEQ ID NO: 3606 - DNA, 445 bp, Gossypium hirsutum
  Clone ID: uC-gsronu33B126g12b1
tttacgcgtccgctttgagtttagagctttggggggctttatcacgggattgggggtcgagaagaagcggggactgaccttacttggaactctggtttctcttgttaccgctatggccgacctatctataactacctaaaatactctcacggagatattccttgggttcaagcgtattgatggcttcaaagcggattttgaaagaacttaaggattcgctgcaggatacaccaacttcctgtattgcaggtactggcgcgagagacatgcttcattggccagcaacaattatgagaccgtccgatagctttatcgcaggatgtgtgttttctgttgatattcattttcctccggaatatccattcaagacacctaaggttgcattttggaccgaggtgttccattcaaacacgagcagacatgggtgcatgggttttgagatcct

SEQ ID NO: 3607 - DNA, 430 bp, Gossypium hirsutum
  Clone ID: uC-gsronu33B126h01b1
gatctcctccatttctctctgccaccagcggcacggaaagatgcaaatcttcgtcaaaaccctaacggggaagaccataaccctagaggttgagtcttccgacaccatcgacaatgtcaaagccaagatccaagacaaggaaggcatcccacccgaccaacagcgcctcatctttgccggaaagcagctcgaggacggccgcaccttagccgactacaacatccagaaggaatccaccctccatctcgtgctccgtcttaggggaggtgctaagaagagaaagaagaagacctacaccaagcccaagaagatcaagcacaagaagaagaggtcaagctcgctgtgctacagttctacaaggtggatgaatcgggtaaggttcataggctgaggaaagagtgttctaatgctgagtgtggggcttgaactt

SEQ ID NO: 3608 - DNA, 473 bp, Gossypium hirsutum
  Clone ID: uC-gsronu33B126h02b1
cctattcgtccggctctttgttctctgtttcgggggggctcttaaaactctacagtggctaaaacctttgcttgctttgtcctattagctttcatagttagttgcgcacttggtcaggctcctagctcggccccaaccaattcaccgccgtcttctaaccctactccggctcccaagggttctccaaccatgtgtccaaccgctacaccaaccgcatctccgccgtcaacatccactcccccgtcttcagcccctgaatcttcaccaacttcctctcccactacttctcccccagctcctctcgctggttctcccgctggctctccccctaccgctgattctcccacgaactccatcagcgagacaccaggcagctctcccacttctcctacgagtgcagccgcttggaacagagtcaccgtcgctggatctgcccgtgcagtcgtttttgctgctttggtgatttagatctg

SEQ ID NO: 3609 - DNA, 525 bp, Gossypium hirsutum
  Clone ID: uC-gsronu33B126h05b1
cgcgctttatcagtatcttcttcaaagctttcccttgggggcttgtttacgttcttgtgggcttccactttagctcggaattccccttcaccaacaacaaaaatcctcgatggcttagcttctttgaaacaaactcaacatattctttcctttgatcctcaaatttctaatggcttttccaaaagccagcccctttgcttcaactcttcttcttcatcgggttctgctttttcgattccacttcattcacggggctcattgcgcaaaacccatcatgttgattataaaaacctgggccgaacccgactcgaccgtgactcagcccgagttaactcgctcaccaccgaggtactactcgctgtcaatgggattcgcaaaactgagctgaagcctgttgttaccgagttagaaccagaggcgctttccacccctgttatttccgggatgagccaagggagtggggagtattttacccgggtcgggttgggaacccagctaaacattttacatgggtcttggtaccgg

SEQ ID NO: 3610 - DNA, 531 bp, Gossypium hirsutum
  Clone ID: uC-gsronu33B126h06b1
ccttcgcgtccggcatcgattactttttatttggggcagagcctacttcaccaacctccgctctgttcagcccgtgatcttttgatctttctccatggctaccatttccaagctcgctaaccccaacccagtcgcttctctttcattatctttcaaacccagatcttcttcatcgcttaaatgcttcgttgggttccctaccaggcctgctttcagctctaagctggtttcatcttctagcttgtcctcgataaacacccaccctttcaggggctccttggttgtcaggtgttctcttgctgatggaaacggtagttcagtgaagacgactactttgcatgatctgtatgaaaaagaagggcagagtccatggtatgacaacctttgcaggccagtgaccgatttgctgccactgattgcaagtggtgttagaggtgtaactagcaacccagcgattttccagaaagctatatcttcatcaaatgctcaccatgatccattcagggaacttgtgcaatcaggaaaagatat

SEQ ID NO: 3611 - DNA, 439 bp, Gossypium hirsutum
  Clone ID: uC-gsronu33B126h08b1
gtttatgttaaggttaaaagtgtctttggagcgggaatgtttgctcttggaggggatgtcaaaattcctgtccctaaacaaacagcaaagacaagtttccaagtgacatcaggtcgagcaaagtacaatgcggctattgattgcttggtatggaagataagaaaattccccggacaaacagagccaaccttgagtgcagaagttgagttaatttccaccatggcagaaaagaagtcttggacaaagccaccaattcagatggaatttcaggttccgatgtttacagcctctggtttacgggtccggtttcttaaagtgtgggagaagagtgggtataacacagtcgagtgggttcgctatattaccaaggctggctcatatgagatcaggtgctagaaacacaggattccccgttggctcgtatcagcaaacttgaata

SEQ ID NO: 3612 - DNA, 338 bp, Gossypium hirsutum
  Clone ID: uC-gsronu33B126h09b1
gttagcggtctgcatgatcttcaactcaacgggggatactgaagtgtaggaggggattgatcataaatttgatctcatgaatgccaaacgagcatttgtgcactgacatgacgttgagggcatgcaggaaggagagtattccgatgcacgtgaagaactcggtgccctggaaaacagatcatgacgaacgtggcgctcagtctggtgaaagagacgaacgggacgaggaggagtattgagggatggaccgctatccagatggtactgcaatgtatcatgttgtcgagcttggatgtgacggttcagggctcggataccggggataatgaactagtata

SEQ ID NO: 3613 - DNA, 313 bp, Gossypium hirsutum
  Clone ID: uC-gsronu33B126h11b1
tctacgcgtccggttaaagaccagggttcctggggatcgtgttagtcgttcagggcgactgatgctttggagggagcccattatttggcgacaggagagcttgaaagcttgagtgagcttcatcttgatgattgtgatcactagtgtgatccacaacagtatggtgcgtgtgactcacgaggttatggtggtctaaatgacctgtgctttgtggtacaccctgaagggtggaggacttgagatgagagaaggattacccttacactgggaatgaccgtggtccctgcaaatttgacaagaacaaaatcattga

SEQ ID NO: 3614 - DNA, 408 bp, Gossypium hirsutum
  Clone ID: uC-gsronu33B127a02b1
gttatttagatgttggaaagggtccttctggtggggggcactatgacagtgctcgtggctttcatactgagattgatcccatcttagcccttcaggctcttatggaaggacttcaggtcttgacacctagaagacgttgactccgaggctgatatattcgttaccacaaccggtcacacggacatcatcatggttgatcacatgaggaagatgaagaacaatgccatcgtttgcaacattggacactctgacaatgacattgatatgctcggccttgagacctatcctggagttaaacgcatcaccattaagccttataccgattggtgggcctttcctgaaaccaacactggcatcattgtgctggctgtaggacctatgatgaacctcggatgtgccactggacac

SEQ ID NO: 3615 - DNA, 478 bp, Gossypium hirsutum
  Clone ID: uC-gsronu33B127a03b1
cttatttcgccgaggaaaacaagatgtcaggggggggagattaagataagaagccgggccatcagtccgcggctcacatcatcctcaaagtcaaaggccatgacgggaatgaagttttcttcaggatcaaatgaagcacacaattgaagaagctcatgaatgcatattgcgaccgacaatctgtggatttcaactcgattgccttcttgttcgatggtcgccgcctgcgagcttgagatggaggatggtgatgagatcgatgctatgcttcaccaaaccggtggtactgtgtgaagcgagtactactttgccacatttagtatttgatgagttagttatggcctgattatgcagatgtttccaatgtttttatatacgatcttattgccatgttatgaagacttgtggaccttgttttgagtcatcttgctcttatagaagagctcgagtttctagtgtttacaaagagagatggaac

SEQ ID NO: 3616 - DNA, 555 bp, Gossypium hirsutum
  Clone ID: uC-gsronu33B127a07b1
tctttttacgcgtccgcacaatttaattttcaggggagccctaactctgaatgtgggtgttatctaattttcttccttgcccatctctttgttttcccaaaaacacagtagtttttctccctttttttatttctgagttttcctgcaattttcccaaggagtttgattggtaactcaagagacatggttcaactcaaggaatttcgcattgtcatgcctatgtctttggaagagtatcaggtagctcaaatgtacatggcaatgaagatgcagcagcagagtacaaatggggatgaaggtgttgaagtcttggagaacaagcgttttcaagatgatgtatttggtaaaggtcaattcacatctaaagtatatcgtttacaaagcaaagcacctgcttggcttacaactattgcaccgaaagatgctcttgtaatgcaagatgaagcatggaatgcatacccaagatgtaaaacagtgatcaagtgcccatactttaccaagttctctctcacaattgagactgtccatagggcagacaatggcacatcggaaaat

SEQ ID NO: 3617 - DNA, 417 bp, Gossypium hirsutum
  Clone ID: uC-gsronu33B127a08b1
tcttccacgcgtccggttccttccttcgccgggtagtgcacttgtgacatcgatggggagtgaatcagaatgggtaaggaaaagagtcacattaacattgtggtcattggccacgtcgattccggaaaatcgaccaccactggccacctgatctacaagcttggtggtattgacaagcgtgtgattgaaagggttgagaaagaagctgcggagatgaacaagaggtcattcaagtatgcttgggtgcttgacaagctcaaggctgaacgtgagcgtgggatcaccattgatattgccttggggaaatttgagacgaccaaatactactgcactgtgattgatgcgcctggacaccgtgactttatcaagaacatgattactgggacctcgcaggctgattgggcctgtttgattatt

SEQ ID NO: 3618 - DNA, 476 bp, Gossypium hirsutum
  Clone ID: uC-gsronu33B127a12b1
cctacgcgtccgagataagaaccattgagctgggtggcaaacggataaagctggaaatttgggatacagctgggcaggagcggttcaggacaatcacaactgcttactatcgtggagccatgggcatcttgctggtctatgatgtcacggatgaatcctccttcaacaatattaggaattggattcgcaacattgaacagcatgcatcagataatgttaacaagatattggtcggaaacaaggcagacatggatgaaagcaaaagggccgtgccaacctcaaagggacaagctcttgcggacgagtatggaatcaaatttttcgaaacaagtgcaaagactaacctaaatgtggaggaagttttcttttcaatagcaagggacataaagcaaagactcgtcgatactgactcaaaggctgagccttcaacaattaagatcaataaacctgaccaggcagctgggggtggtcaagct

SEQ ID NO: 3619 - DNA, 377 bp, Gossypium hirsutum
  Clone ID: uC-gsronu33B127b01b1
tttattctaaacgtcacaacaaaacgaataaagtgggggtctataaagggaaaggacggaggctgtcctcttaatcatcagttcaaactatgggatgttggcaaggggttcgatttgctgttcggcaaatgcaaactgatatgaatggccaacaccagacctgactcacgtcatgccgtgatctccacctactggtatctctacttgtcctatttacaaataccttgttacggatttgccgttgcaaagtcaaggctggacaatcatacttgtgtcacacccggtaggggctcatgtacaagaggtcccatgctggcgactcaaaatgatccagatgctattgggggcaccatacctccagcgtatcggactatgcc

SEQ ID NO: 3620 - DNA, 459 bp, Gossypium hirsutum
  unsure (1)..(459): unsure at all n locations
  Clone ID: uC-gsronu33B127b02b1
cccactcgtccgcccacgcgtccgctttttgtgtgtgtgtgtgtgtgtgtttcttctgctgttttatttatagtcgctggcggctaaaaaatgttgcaaagggctttgatattctcttcttcaaatccaatctgttctcaattgccaacgacagctccgcctgacaacaccgtgttccccaaacgaaacggcggctggatcatccctttctcatcctaccagctaccggcatttcgtttgcgaaattacaggcgtacccttcttcctccactctgctcagcgagtgactcagctgcaaatcgaccaaatatggcgtctcaagatgaacaagaccctcggatttccaacatttcttctgcgattcgtgtcatccctgacttcccaaaacctgngataatctttcaagacataacaactttgcttcttgataccaaagcatttcgtgatactattgatttg

SEQ ID NO: 3621 - DNA, 414 bp, Gossypium hirsutum
  Clone ID: uC-gsronu33B127b03b1
gacgcttccatttgtctctgtactacgatcaaggccaaacttttgaatatcaatattataatccccatagctcttcaggtcctcatcgactgtggcaaaactccacctccagggttccaatgtccagcacaatgatgaaaaacataaaaaccccctgttttttttctttcgaaataacaaatattttcatgtcttattatatgtttcttttaataatttatggtgttttgctggttgatgaagatcataaagacgtgtctgaggttagatcgttttaatagatgttgatgaatccacgaacggatcaatgtagtacgatgttgtgattttagttagttcataggatcatattaattgtgtgtgtgtgtgttatctttcttatttcaaagctaagcttgttttggagtgaacatt

SEQ ID NO: 3622 - DNA, 82 bp, Gossypium hirsutum
  Clone ID: uC-gsronu33B127b07b1
tcgatttttttggtacaaaaaacgcttttatgggtttcttttactgtaccgcctaatgatggacgtatatgatgtacagaac

SEQ ID NO: 3623 - DNA, 541 bp, Gossypium hirsutum
  Clone ID: uC-gsronu33B127b08b1
cccacgcgtccgtctttgctaccttttattgcgaacagagagacttttcattttttcaatccggtggtctttgccaaagtctctcctctccaaggtttctcttctccagcgcattccggaccatttctgggattcccctctccaggtaaaagctttctccactatcgagagcctccgttgcaatagtataagcgtagatgttattaacttttggaataaaagaaaactcaaccttctggtatctgcgtttcttgctctgaatatctctgattattgctcctatgaccgatctatcaataatagaattttggcacttcttgataaccgtttttgaatctcccataacttcaagtatgttgactcccagactaatacctagttttactgcttgtaatcctgcatatgcctctgctgtaaatgggtcttctatgttggagtgatgaactgcctatgacgctaggatttctccctccccatttcatgctattagtcccgatgccgatctgaacgtctgacggtcaaaagctgcgtcgagatgaac

SEQ ID NO: 3624 - DNA, 425 bp, Gossypium hirsutum
  Clone ID: uC-gsronu33B127b10b1
tttgtattcaactcgacgagttgcctattcgatcggggcgtgccagtcctttgcctgcttacctcacccgaaagggaggctttgattaggctacccgtcaaggttgtttagtttacgtatgtatctttctttctttctctcttggtgtaagctacgtgttgcgtttctattggtggttatggttgagatcgacggtctcaggtgacgaactcgttttgctaaaaaaacccgttttaaaagaaaaaattgctcttctctataaattagtgaggtaattctgcgtctagaattttctttttattttttacttgaatgtatttgtacaaaggtttaggaaaaaaatggaaaattgcattgtagaactttgaataatataatgtttacttttatttggtggtaacaaaacaacaccattttaatccaca

SEQ ID NO: 3625 - DNA, 385 bp, Gossypium hirsutum
  Clone ID: uC-gsronu33B127c02b1
attagacccaaatacaccaaacatgaacaacagcgtctcttttgctctgcttcactttgcattttgcttcactttagtttcattcactcctatttctgccctggaattgcatggaactggtgccaacatggtcgaaacaacttgccaaaagacacccttttacaatctatgtgtctcggctcttaaatccgaccctcgaagttccggtgcaaacgtagcggggctagcgcatatcggaacagataaactgaaggccaaagccaccgcaacgctgcggcagatcacagcgctgcttaaagtggccaaagatccgaagctgaaaatggccttgcgtgactgtgccgattattacaacgcccattgtaaatacgatatccccgtagct

SEQ ID NO: 3626 - DNA, 486 bp, Gossypium hirsutum
  Clone ID: uC-gsronu33B127c04b1
gttaattcaactcgaagacggccgtaccttggccgactacaacatccagaaggagtcaactctccaccttgtccttcgtttgcgcggcgggatgcaaatcttcgttaagacgcttaccggaaagacgatcactctcgaggtcgagagctctgacacgatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatcttcgtcaagactttgacccggaagaccattactttagaagtggagagctcggatacgattgataacgtgaaagcgaagattcaggacaaagaaggaattccaccagatcagcaaaggttgatttttgctgggaaacagctggaagatgaaggactttg

SEQ ID NO: 3627 - DNA, 431 bp, Gossypium hirsutum
  Clone ID: uC-gsronu33B127d03b1
tttcattcgtccgcccacgcgtccgggagtatgtatgtatgtatgtatgtatgatatttgattcctgtttgactcaagttgagacggtcatgtaagagagacagagagcaagtgtagttttccaatctttcttgaggcatagagattgaggaagaacctgcctattgaaaaaaaaacaaaaaaaaaatttgataatataaaaaaaaaaaaaaataaaaataaataaaaaataaacaaaaactagccaataaaatagactagtttgtgcaagcttaaataaaaaaaaaataatggggggggcctttttaggggttcaaagttaattgccggggaaatgcagcctattattttttttttagtgcccataatattactgaccttggggtttttttataactttattgcggggaaaaacctgggggttccccaat

SEQ ID NO: 3628 - DNA, 559 bp, Gossypium hirsutum
  Clone ID: uC-gsronu33B127d05b1
atttttctctctttctctcttccatttctctctctctatttagtggtgttgggttcttctgttcttcagaaaggaagcgtctcttcttgttcagaacaaaaaaagaaaagccaaagaaaagagggagagtatagagactcaagtacaaaagagcaaaaaaaaaaaaaaaaacccaagaaaccaaataaataaaaggaagggtgggggcaaatagacaacgtacaaacactcttactttttagtgttttttttctttctttcttgttgttatgaggtttcctttgggaagataagtttcatttcctttcttgggggttttctttaaaaccttttgtttttgcttttccttcttggagttcttttccagtctggtttgttcggccatggccggtagcaatgaagtcaacctcaatgaatccaagagggttgttccattgaatacatgggtcctcatttccaatttcaagctagcttacaatctacaacgccgtcctgatggaaccttcaccgagatttatctgagttccttgaccgtagagttcctgccaatataaaccct

SEQ ID NO: 3629 - DNA, 329 bp, Gossypium hirsutum
  Clone ID: uC-gsronu33B127d06b1
gtcactgaaatctttggctagaactcatgggttccgtcgaagaatgagaaccactagtggaagagctgtattgaaacgtcgccgtgctaagggtcggaaggtcctttgcaccaaatctaatccaaacagtgggaagcgctaaactatttcttttgtttcagtttgcagaattctgttaatctgatttcttttatgatgtctaaaggataatttaggcaaaacttaaccaatccagcttttgttggttcaattcggcattatttgtttaagtgtttttgtatttgatgaacctctttgcaaaattatatgctttgggccgtttttcttgc

SEQ ID NO: 3630 - DNA, 489 bp, Gossypium hirsutum
  Clone ID: uC-gsronu33B127d07b1
aaacatggagaaatctgcattagctatactaatgaaccttggactgattgaagagtccaaaatttctaggtctttaccttggagacgccctgcaaatgtcttccgtgttaaggaagatgttcgcccaatattttgggctaaccgtccaaagagttacttatctaggactattggttgggatcagtacccacaggggcgatggggtgattctcgaaatccatcgtatggtgcactatccgactatcagttcatgaggccccgtgcacgtgacaagaaacttcaggaagaatgggctactcctttgaaaagcattgatgacattcaagagaaatttaaaaaccattgtctgggtaagttgagaagtagcccttggtccgagttggatggtcttcagccagagacaaagatcatacatgagcaactaggaaagatcaatttgaagggctttcttaccattaatagccaaccagccgtcaatggggagcgctc

SEQ ID NO: 3631 - DNA, 531 bp, Gossypium hirsutum
  unsure (1)..(531): unsure at all n locations
  Clone ID: uC-gsronu33B127d08b1
gtctgcaggcacttatattggcaatggtaatggttatggcgatcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattggtatcttatagtcgtgtgatttctcaccaataatcatatattagtattggttccaccacgcactacgttgcttcaataatttttttaataaaatatgttctacattnt

SEQ ID NO: 3632 - DNA, 518 bp, Gossypium hirsutum
  unsure (1)..(518): unsure at all n locations
  Clone ID: uC-gsronu33B127d09b1
ttcacgcgtccggttcttggatactgttcagtacaaagctaatagcatacttcgttatgagcgtacctttggtgaaggatttgtgagcactggaggaatagaaacaacgaaagaatttgtggcgaagttggatctaaagcctggccaaaaggttctagatgttggctgtggcataggtggaggtgacttttatatggcaaaagaatttggagtctatgttgtgggcatcgatctgtccataaatatgatatcttttgctcttgaaagagccaatggactcaattgctctgtggaatttgaagttgctgattgcactacaaagacttatccagataacagctttgatgttatctacagccgtgacacgattctacacattcaagacaagcctgcactatttagatatttctacaaatggttgaagccagngngcaaagttcttataagtgattactgcaaaagcgcangagcttcatcngctgaatttgcagagtacatcaagcagagagactatgatc

SEQ ID NO: 3633 - DNA, 596 bp, Gossypium hirsutum
  unsure (1)..(596): unsure at all n locations
  Clone ID: uC-gsronu33B127d10b1
tcgatcgagcagaatggtgatggggattctataacatttacggaatcagtgatttcaaaccttcagctccagtttgagaaggttgccgcagaagtgggtttgaatagcgatgttgcaactgcctgtgatttaccaaaagttaatggtgctgtctccaagaagagaaagagagcaaagggtgcgagtggccgaaaacctcagaatggggagctaactggtgaagctgatggtgaaggagatggaactgcgaaaacttgcgagaatagcacaaagagggtaagattttcaatgaaaagcaatctggtttggaagccccacagtcctttacctccattaagtttgaggttacctccctctgttactcctagaggaagtgctcttaagcaaggaattcctccaggtcctataaaggaaatggctcctatgactaagaagggaaagaaagctaaatctgtgaagaaggctcggaaagtgataaagagtatgtatcctctagtcaaacgcacaaagaaattgaaatctacttcctcttagcagagtctgctcagggaaatgcctnctatgtataagatggtgaagaaaactaaatctgggaa

SEQ ID NO: 3634 - DNA, 412 bp, Gossypium hirsutum
  Clone ID: uC-gsronu33B127d12b1
cttacgcgtgggcggacgcgtgggcggacgcgtgggctgccttcttcagtgtctggaaacggtatggtttcactccggagggttttaatcttgctacacttagtgttcagcatgggcaaaagagttatcctttgcgtccagagttaatagaaagcacgtattggctctacaaagctaccagaaatcccagatatctggatgccggacgagacatagttgctagcttgcaatatggggcaaggtgtccatgcggttattgtcatatatcggatgtcgagtttcacaagagggaggatcacatggaaagctttttcctggcggaaacagtgaaatatttgtggctccttttcgatttggctgtgggtccggacaacctttgtgaaaatggaccatacaagtacatatttagcac

SEQ ID NO: 3635 - DNA, 494 bp, Gossypium hirsutum
  Clone ID: uC-gsronu33B127e01b1
cttactcgtccgcccacgcgtccggcctgcaaccactttaattccctttaattcctatggtattttatctgtatatttttgctagtgcattaccgaactctgtacttgtaggagaatgccatatgcaggttgaggcatgtatttttgtgtgtattgctttttgtagttctttaggcccttgcatgggcttcttttttagatggattgaaggttgggacttcactagcactagatattggaaggtgtaccatgtcaagcatgttggccaatgttaacactggaaatcaaggcctacagggtgaactgtaaatctagctttgccaagtttcaagatttatgtccgaagacatggttagacataagaaggcagggatcaaagctttggagggctcctagtcgggatgatcatctcaaattcacatgcagtagcgggtctattcctggaagatattcattagttgctaatttgaagcaagaagtaaattgttgaatcc

SEQ ID NO: 3636 - DNA, 440 bp, Gossypium hirsutum
  Clone ID: uC-gsronu33B127e02b1
gttgttttcaataacttcttttgattccactgagcgtcaacaaatcttcagaatttcgaattgaatccttttttttcttttataattcaccgaatcgtacggtgaaaaggagagaatatctgcgaaatggaatccactgtaacgaatccattgccgaactcgaattccgaccctgtcagaaggaagaagaaaaagaaaacatcagcagcggcggcgactgcgacgttgaagacgaatcagcagcggcagaaccaaaaccagagctacaatcacaccacatggaaatccgaggcgcagcaacaaatctattcttcgaagctgattcaagctttgagtcaagtcaatctcaacggtaaccattcttctccttcggctccgcgtcgtggacgagccgttcgtgaagctgctgatagagctttggctgtagcggctaaagggag

SEQ ID NO: 3637 - DNA, 460 bp, Gossypium hirsutum
  Clone ID: uC-gsronu33B127e04b1
atcttttgatggcaattgagattcctagagtgaaagggggaactcaaggatttgagggttcaaagctgggatttgggtgcatgagtcttacaggtcacgatcattcagtgtcagatgaagatggcatagccatcattaagcatgcagtcgaaagaggagtcactcacatcgatacagccgacctctatggacccaaaactaacgaaattctggtcggaaaggcattgaagcatctgccacgagagaaggtacagttggctacaaaattcggtgttgaaagcatgggtccagatggtccggctatcaatggcactcctgaatttgttcgttcttcacttgaggctagccttcaacgcctcgatgtggattatattgatctttactatataatcagaagtgaccgcaagactcctatagaagatactatggaagaactgaagaagttggtggaagagggaaa

SEQ ID NO: 3638 - DNA, 319 bp, Gossypium hirsutum
  Clone ID: uC-gsronu33B127e05b1
ctaactctgaaatatactaaccttcttttttttacattttgttcgattagtcttcttctcggtatcgctgtcatggctgggttcgagcagcgaataaaggagagagccaaggagctcaaggttttcttcaagaagggtgtgaagatcgtgggagaatcatgcaagaaaggttggtacaaagtcaagcacatcagaggctgattcttttgccttccatcatcttgttttcttttcgttttccatgtagagatctttgtcagtcatcttgatttggagggttttctttaatttattgaaggattttatcctgttttctgct

SEQ ID NO: 3639 - DNA, 567 bp, Gossypium hirsutum
  unsure (1)..(567): unsure at all n locations
  Clone ID: uC-gsronu33B127e06b1
atttgaccaggataagagtagctatggtgatccaaatatcatggatcctccaagaaatagaggtgttcagtttccatttgctgtaacagatcgggttatcataaaggggaacaagagaaccccacaacgtttcgtaggacgtgaggccgttgtaaccatgcaatgcttgaatggatggtatgtggtgaagacattggataatgcagagagcgttaaattgcagtatcgctcacttgccaaagttgcagataacacagccccaaagccaattacaagcaagatgggaccaaactggttatagacctgtaatttataaaatgggggcaggtgagtgacacttcgttgctggtgtcggtatcagtgtgtgccacggttagttcaatatttaacctaactcgaaatattttattntattttttctaccattgttatagtgtttcatgaaacaagccccttgtaaattaccttgtcacgtattttaagcataaaaattacatgcatagagttgaacgagcatgcttaatcattnntcgtctatataaatatatgtatatgatggtcacatct

SEQ ID NO: 3640 - DNA, 526 bp, Gossypium hirsutum
  unsure (1)..(526): unsure at all n locations
  Clone ID: uC-gsronu33B127e08b1
aatggcttcacaagtttctcaaatgccttcttcatcacccctttcttccaataaggatgaaatgcgtcccaaagccgattttcagcctagcatttggggagatctcttcctcaattgtcccgacaagaatattgatgctgaaactgaaaagcgccaccaacaattgaaagaagaagtgaggaagatgattgtggcaccaatggctaattcaacccaaaagttagccttcattgattcagtccaaagactgggtgtgagttaccatttcaccaaggagatcgaagatgaactagagaatatctaccataacaacaatgatgccgagaacgacctctacaccacatccattcgattccgactactccgagagcatggatacaatgtttcatgcgacgtattcaacaagtttaaagatgagcaagggaatttcaagtcatccgtgacaagcgatgttcgaggattgttggaacttaccaagcttcttatttgagggttcatggggaagatatatnggatgaagcaattt

SEQ ID NO: 3641 - DNA, 360 bp, Gossypium hirsutum
  Clone ID: uC-gsronu33B127e09b1
tctgtcacgcgtccgcccacgcgtccgcccacgcgtccgtattcccggccttgttaaggtcgatccggttgctgttgcggttccccaaatcgggttcggtcgcggtggtggacccggaaggagattttaagtggtgggtatccatggatttgatgggttcttaaatcttaagtttgttatgcttatttttggtagtttttttctctataattttatgttccatttttgaaccattatagttgtttcaaccttaattggtgcccaaacttattaagctttatgtgaacttgtttatgaaggtatttgaagggggtaattttcagttaaaaaaaaaaaaaaccaaaaaaaaaaaaaagacaa

SEQ ID NO: 3642 - DNA, 521 bp, Gossypium hirsutum
  unsure (1)..(521): unsure at all n locations
  Clone ID: uC-gsronu33B127e12b1
atttccatctctgattttctccaatccaaccgggaaaatcagaaaaaaaaaatggcttcttggaattcaattccactggaaatcacgtacgacacttttggttggctagcctttttttcgtggtccattagtttctaccctcaagtcatcttaaattttcgaagaaaaagcgttgttgggttgaactttgatttcgtgctgctgaatttgacaaaacactcctcttatatgatctacaacgtttgcctttacttcagccctgttattcagaggcaatactttgagaaatatggctctggagagatgatcccagtagctgctaatgatgtcgcgttctcaatacatgctgttttgttgacggctattactttgtttcaaattgtgatttttgatcgtgggacgcaaaaggcttctaagatttctgtgggaatcgtcattgctgtgtggttaatcgccgccatttgtttcttcatagcatngcctagccaatcatggctttggtaatctccatctttaactcg

SEQ ID NO: 3643 - DNA, 367 bp, Gossypium hirsutum
  Clone ID: uC-gsronu33B127f01b1
ctttgtgtcagctcattgatcacagatttggagaaggacttttcatgagctgcagccactcttactcctattgaaggaattgagatttttgaaatcaaatgggaaagcttacagccaaatcccactatgaaagtctgaggaatgctcgcattgtagataacccagctctattagcctctctgggagtgcacaaaaccatgttcgacctaaggtccatgctttatttgaaaaacctaaggttcgcacatggcataacaaggatagcgtgctcacgtaccattcccggtatactcgtttcaaggcagccactctttcatcatgtctcggcagcggaggtttgtacagatacaaccggcttatgggaaaa

SEQ ID NO: 3644 - DNA, 467 bp, Gossypium hirsutum
  Clone ID: uC-gsronu33B127f02b1
cccattcgtccggaggaggtgttggtgattgagaagatcgaatttgaccgacatcaagtggtgaaatttgatgtgtacattaacgatgaagatgacacggtgatcggaccagacaacaccgaattcgcggggagtttcgtcaatgtgccgcataaacataagcatgggaagaaaatggcaacatttttgaggttagggttgacggatttgctggaggaattggatgctgaggatgatgatggtgttgtggtcactttggtgcctaaatttggtaagggtttagctaagattggtggcatcaaaattgagtttggtcgagattgatctactagtttcatgtttttttagacaaaattattaattgtctaatgttttgcttgtttattgagaagtactattactatcttttgttttagcaataaaaaacaatgagcattactttaaaaaaaaaaaaaaagggcgggcgg

SEQ ID NO: 3645 - DNA, 574 bp, Gossypium hirsutum
  Clone ID: uC-gsronu33B127f03b1
gtttttggcaataaagcaagctgatgtggtgatatgcgcggtaggttcgatgcagttagcagatcaagttaagatcattgctgccattaaagaagctgggaatgtgaagaggtttttcccatcggaattcggaaatgatgtggaccgggtccatgctgttgagccagctaaaacagcatttgcaaccaaggctcaaatccggcgtgctattgaggctgagggaatcccctacacctatgtgtccagtaactgctttgcaggctattttcttcctgatttgtcacagccaggagccactactcccccaagaaacaaggtggtgatcccaggcgatggagatcctaaagaggctacatttccatacaagtgtggattggcaatcagacattcagtctttgtgaggggtgatcatacccactttgagatcgaaccgtcattccgagttgaggcttctgagctgtaccctgatgtgaaatataccacttgtgaggaatatctgagccgtttgtttgagaaagaaatgatcatatgctcctggtatgaactaatactagcatatcgagaactttaccgc

SEQ ID NO: 3646 - DNA, 488 bp, Gossypium hirsutum
  Clone ID: uC-gsronu33B127f05b1
ttcaagttcggggactaaacgttgccttatccgtaaaattttttttaaacaaaaatgatatttaaactattaattccatctcgttttgtcccaaaacacgttacctgccaataagagtgtgacatcatttttttgggtaaaataagatcaaattaatagtttaagtactattttggattaaaaaaatatattttaggtacctaaataggaaaatcgatatagtttaggggttaaatttgtagtaagactatgtttgttttaatctttttatttcttcatataattgtacattgaagacaatgctaaaagctcaaatctggttgtggtagtgattataggagaaaagattggtaggttttgagggggcaaaaattaaatgtaaagtgtaatttttttaaaaccagaaataattgttcaaagtaggagaaaaaaaataacatttttaatctttgaataactattccatgtggaaaaaacttggtggaatt

SEQ ID NO: 3647 - DNA, 500 bp, Gossypium hirsutum
  Clone ID: uC-gsronu33B127f06b1
tttattcgtccgcccacgcgtccgaaagcagcgtagtgggtgaagaagtgaaggtttttggatactgggcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaacttggaagcataatccctatttgccacaagatccttatgacaaagctaccgctcgattctggatcaagttcatcgacgaaaagtgctttcctaccctttggctagctgcatggagcgccgagaatgagcgagaaaaagtgacgaatgaagctcgcgagtatctgaaaacgcttgaaagtgcgcttaatggaaagaaattctttggtggagaaaccattggaatggtagatatt

SEQ ID NO: 3648 - DNA, 468 bp, Gossypium hirsutum
  Clone ID: uC-gsronu33B127f07b1
tttacgcgtccggtttatacaccaccaaagaaagagaagcctgagcccaaaccaccagtatatgaacccccaaagaaggaaaagcctgaacctaagccaccagtttatacaccaccaaagaaagagaagcctgagcccaaaccaccagtgtatggaccaccaaagaaggagaagccaccggcttataagcctccaaagaagccaccagtgtatgagcctaagccaccaaagccaccggtttacacgccaccaaagaaagagaagcccgaacctaaaccaccagtacatgagtctcccaagaaaccaccgtatggtcactatccaggacaccctccattggggaagcctcaatagagagatcccatcggctagcaatcccaagaaccgagctattatgactagctaaatagataaattagtatccatgcaataagagctgcttaatactcatgttctgctttcttggat

SEQ ID NO: 3649 - DNA, 488 bp, Gossypium hirsutum
  unsure (1)..(488): unsure at all n locations
  Clone ID: uC-gsronu33B127f10b1
gtcaagttcggggactaaacgttgccttatccgtaaaattttttttaaacaaaaatgatatttaaactattaattccatctcgttttgtcccaaaacacgttacctgccaataagagtgtgacatcatttttttgggtaaaataagatcaaattaatagtttaagtactattttggattaaaaaaatatattttaggtacctaaataggaaaatcgatatagtttaggggttaaatttgtagtaagactatgtttgttttaatctttttatttcttcatataattgtacattgaagacaatgctaaaagctcaaatctggttgtggtagtgattataggagaaaagattggtaggctttgagggggcaaaaattaaatgtaaagtgtaatttttttaaaaccagaaataattgttcaaagtaggagaaaaaaaataacatntttaatctttgaataactattccatgtggaaaaaatctggtggaatt

SEQ ID NO: 3650 - DNA, 546 bp, Gossypium hirsutum
  Clone ID: uC-gsronu33B127f12b1
ctctatttcgccagtatcctggaccttggcaggggatgcttaagcaagcagatggttcttatgcttgtgtagctgagagttcaactcgtttcactctaggagaggtatttaccttggctcttggtcgttttgaattacattctttccaatgacttgtatgattcgatttggtctagaccaaggaagaattgctgcgggtcctcggattgcaagaggaacaaggaagtcaactagaatttcttcgtagaggctacaaggtttttatctattctattttctcttttacattaccatgtttcgtttgagattcttaaatcgaatgctcatagcaatatcctccattcctccctgaacaaagttccaacttttttcttccttccggttttacatgttctggccatacgataacatttcagcttggtattctcagaaaacatgttctggccatacgataacatttcagcttggtattctcagaaataggagggcattctgcattggatattctaaatacacataattcatgaaacttaaggaaaaagatga

SEQ ID NO: 3651 - DNA, 443 bp, Gossypium hirsutum
  Clone ID: uC-gsronu33B127g01b1
tctaatgagaacaacaagcttttcttaatactgagaattttaacgctttcctttccttcgtctttcctttgctttcctctgtgtgatttttaataaaagggaaacgagaaggaaaaatgcaggcaatttctcaagtgcaaaatcttaattcgtaccttataattcgccggtcgaagcctcggtttgataagccggctcggttagctgtacctgtacgttgtgtgtatcactctgattcagttccattccccaatggagtccgttcaagccgggtggattggcaaagctcgtgtgctattttgtctagcaaagtcttctctcaggatcaagattccggtgagaaatcgaacacttgctccggcttcgatcacctggcggcggcagttaacggccataaaacttccttggatctgaacttagctccgctagataagaagaacaag

SEQ ID NO: 3652 - DNA, 450 bp, Gossypium hirsutum
  Clone ID: uC-gsronu33B127g02b1
cgtactcgtgggggcaactccggtgaaagtgcatggccccccattgtctactgctgtgtctagggtcttagcttgtctcattgagaaagatgttcaattccagcttattcccgttaacatgtccaagggcgagcacaaaagtcctgatttcctcaagatccagccctttggtcaagtaccggcatttcaagacgaaagcacctccctgtttgagtcacgggcgatttgtaggtatgtatgtgaaaagtatgcagagaaggggaacaagggattgtatgggagcaacccgttggcgaaagcttcaatagatcaatggttggaggcagaagggcagagctttaaccccccaagctcagttctggtattccaacttgcatttgcaccccgaatgaagattaagcaagaccaatccttgatcaaccaaaaccacgataagctggctaaagcgct

SEQ ID NO: 3653 - DNA, 239 bp, Gossypium hirsutum
  Clone ID: uC-gsronu33B127g03b1
cctctatatactcagcaatcatggagttgatagggcgtgggggcttttacaatttgagggccttgaaaccttccaattggatgctccccaccatatctcacaatcattcatggttccgatatggccgattatgaacctttaactaggtgcttaacatggcttaaccaaagcctctatgggatagaacgaacaggttcaaaaaaaggtcagacccatgggatggcggagacgatgaaaga

SEQ ID NO: 3654 - DNA, 433 bp, Gossypium hirsutum
  Clone ID: uC-gsronu33B127g05b1
cttgttttgagtgtagagatgaggaaaaccatgggtgccaaagtgctcttcttctttgctttgctttccttttcagctgtgtcggcatttgcacaggatgaggaagaccaaggtcttgttatgaacttctacaaggattcttgtcctcaggctgcagacattatcaaggagcaagttacgctactgtacaagcgacacacagacactgctttatcttggctgagaaacattatccatgactgtgctgcccagtcatgtgatgcttcactgctgctggactccacaagacggagcttgtctgacaaggagacagacaggagctttggcctaaggaatctcaggtacattgagaccatcaaagaagctggatcaagggaatggtctggagctgcttcttgagctgatatccttgctctgtccgctagagaaggca

SEQ ID NO: 3655 - DNA, 319 bp, Gossypium hirsutum
  Clone ID: uC-gsronu33B127g06b1
tttgatctcaaaaaaatgaaaaatttcacccatgcaggcttttagtttgtgtatttgccatttgacccttttgtttttgtatatgtaagaatgtgtgtaatatatattatttacttcaatggggggagagcctttgtgtcctttttttacttgctttttttttttaagctaaataaaggagagggtgctgatggcaaatattggacccatttgtaatttgtatggctatgatttgtgaaaaaaaacatgtcattttcataaaataaaataaaaacggaaaaatatataaaaccggatttttaaaaattgtcctgggacg

SEQ ID NO: 3656 - DNA, 456 bp, Gossypium hirsutum
  Clone ID: uC-gsronu33B127g07b1
tttattgcatcaaggagaatcgcctagggaggtgaaagagcaggaaggagaaaaacatggaggctccagagcagcacaacaagtccagagttgtgaagattgactctgttgaatcctgggacttctattttaaccaagctacaaatcaaggctgcccagtaagctattcaatcagtcacctccatgtctattttctttctagtggtaatagtttagctttggtccttgtcctccatcattgttccttacaacaatcccatctgtcccctttgctttgtcttataaaagttccatatccacattccacggttcatgtctttatcataaatggtcagtctgttgatctcaaccaaggaattctgctatggtttattttttaatttcagttctttttcttctggatttgttggagattgctgtacactctactgcttcatggggtattccttcagtgac

SEQ ID NO: 3657 - DNA, 405 bp, Gossypium hirsutum
  Clone ID: uC-gsronu33B127g10b1
gttggctggcagtacagtgcatctcttcagcattggtatcactttttcagcactttggcaacctattagtgctcttcaaggggttgggaaggtttttgaaccgtataaagacaataaagtagatcttcttggacctaagttgcttttcattgctcttaatttgggtggtttagcacttggtgtttggaagcttaatacattgggactccttcctacacatgcatccgactgggtgtcatccttgtccccagctcaggaggttgaatattcaggtgggggtattcctctgtaatatcgtcttcgtgcgtctgattctcagacaaatttctggtgccagtgaggggaagttgcaaagataggtagaaagaatttggatgtttatacctatgtcttttggagatgtag

SEQ ID NO: 3658 - DNA, 547 bp, Gossypium hirsutum
  unsure (1)..(547): unsure at all n locations
  Clone ID: uC-gsronu33B127g12b1
ttttacttggctcaaccgtcgcttgcctcttggtcaagttcgctactagtgacatgaccgtaccggctttcggactttcatcgggagtaggtgtgtggaacgccgtcgtttttgagatcgtgatgactttcggattggtctacacggtttacgccacggccatcgatcctaaaaagggagacctaggagtgatcgcaccgttggcgatcggttttattgtgggagccaatatcttggcctgtggtgcctttgatggagcttcgatgaacccggccgtttcgttcggaccggctttggtcagctggtcctgggacaaccactggatctattggctcggaccgcttatcggtggtggtctagctggtctcatttacgagttcgccttcattaaccaaagccatgaacaactccctcccaccgattattgaaaccagtttaatttatcatgaaaacgggtttttcttttcttttcctggngtatgtattttggtgagctcttctttgngtttaacttgtgaccgtgatcatgcttactttatcatgatca

SEQ ID NO: 3659 - DNA, 420 bp, Gossypium hirsutum
  Clone ID: uC-gsronu33B127h01b1
ggtggttttaagtggagcgcatacaattgggtgttctcattgcaaagagtttagctcaaatataagcaacgatacccattataatcctagatttgctcaagcattgaaacaagcttgttcaggttatccaaataacccaacattatcagtttttaatgatattatgacccccaacaagtttgataacttgtattatcaaaatctaccaaagggtttggggcttttggaatcagatcatggattgtatggtgatcccagaacaaaaccatttgtggaattgtatgcaagggatcaaaacaagttctttcaagatttcgctaaagctatgcagaagctaagtgtttatgggatcaaaactgggagaagaggagagattagacacaggtgtgatgctggaaactgagagcttttttaatcttt

SEQ ID NO: 3660 - DNA, 78 bp, Gossypium hirsutum
  Clone ID: uC-gsronu33B127h02b1
atcattagaaaaaaaaaaaaaaaaaggggggtttttttaaaaaaaaagggttgttatttcccctaaacactaactatg

SEQ ID NO: 3661 - DNA, 482 bp, Gossypium hirsutum
  Clone ID: uC-gsronu33B127h03b1
attccttatactatcatgctctgaaagcttcttgtagtttggcagagaaagatggcccctatgagacatatgctggctgtcctgttagtaagggcattcttcagcctgacatgtggggttttactccttcaggtcggtgggattggactgctcttagggacatgatagccaagaatggagtgagaaattcactattgttagcacctatgccaactgcttcaactagtcagattcttgggaataatgaatgctttgagccatatacctccaatatttatagtcgcagagttttgagtggggagtttgtagtggtaaacaagcatcttcttcatgatttaactgagatgggtctttggtctcctgttattaagaacaacataatacacgaggatggttctgttcagaatattccagaagtacctcatgagctgaaagcaatttacaagacttgttgggaaatcaagcaaagacactggttgata

SEQ ID NO: 3662 - DNA, 355 bp, Gossypium hirsutum
  Clone ID: uC-gsronu33B127h05b1
atgcaatcaattttgtaagcaagtatggctagtgacgtttaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgggcttttggtgggatgatctttatccttgattactgcactgctggtatctctggaggacacatcaacccagcagtgacctttg

SEQ ID NO: 3663 - DNA, 84 bp, Gossypium hirsutum
  Clone ID: uC-gsronu33B127h07b1
ttggtaaaaaaaaaaaaaaaaaaaaaaaaaaggggtaattaaaaaaaaaaaaggtaaaaaataaacaaaaaaaacaccaattag

SEQ ID NO: 3664 - DNA, 512 bp, Gossypium hirsutum
  unsure (1)..(512): unsure at all n locations
  Clone ID: uC-gsronu33B127h08b1
ttgctgacgcgtgggaaaaaaaaaaaaaaaagggagtattttttaaaaaaaaaagaataaaaaaaacaaaaaaaaaaaaattaaaaaaaaaaaaaaaaaaattaaaaaagttatatattgagattattatatcatgttatttagatttttttgtttttcttttctttttaatgaaaccctgtttttttcccacccgattttgttagtattttttgttacctccttcaattgactgatttacttggatgttttttccgttggcccatttccctagtagtttcccctttttggcttttttcaccttctctttttttctttttttaccagtttttttttcttttggttaccccctcttctgtttttttttttttgtgttttccctagnaaaattgcttataggttgttcccttttttttttccttcgttggctctttttttttgttagcaacactagggctgtttttttttgttatctttttacttttttcttttttttgctttttttttttttt

SEQ ID NO: 3665 - DNA, 443 bp, Gossypium hirsutum
  Clone ID: uC-gsronu33B127h11b1
ttggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgggcttttggtgggatgatctttatccttgtttactgcactgctggtatctctggaggacacatcaacccagcagtgacctttgggcttttcttggctaggaaggtgtccttagttcgagccatattttatatgactgctcaatgtttgggagccatttgtggatgtgggc

SEQ ID NO: 3666 - DNA, 568 bp, Gossypium hirsutum
  unsure (1)..(568): unsure at all n locations
  Clone ID: uC-gsronu33B129a01b1
cacagtttttatcgacgaaaaccggtattactccgcggattacgaagagttacatcccggaatcgatgcctacgatgtacaatacacgaccaagattagtgaaaccagggagctaataacatcggctaaagaacagattcggaacgagtgcaggccggtccaaaacctgttgttctcagagtgcaagcttgggatcaatgatttgccgaaccatgtttacgaagtggattgggatttaatattgattgatggaccaagaggtgatggaccctactgacctggaagaatgcaacccatcttcacttcgggggtgctagcgagaagcaaaaaagggggcaatccaaagactcacatattcgttcatgattattacagagatgtggagaagatgtctggggatgagtttttgtgcaaggaaaacctgggggaatacaatgacacgcttgcacatttcgtggttgaaagaatggaggaaaacagcntttagtactgtcgcaactctaatcataatattacatccacaaaagcttcctcatcttcctagttaaaactacttatccaacttcat

SEQ ID NO: 3667 - DNA, 547 bp, Gossypium hirsutum
  Clone ID: uC-gsronu33B129a02b1
gaactcaaagtcccagctagtattggaatcatgggtgttgtcacttatgactatgagaatacctccccagtcgcccctgccaggcttttcaaggcctttactgttgaagctccgaaagtttggcccacggctgcacctaatgcagtaaagagccttgaggatgaagctaatcctagctctggaagtatcgtaaaaatcaactttgttgaaggccttccattccaatatatgaagcaccagatcggaggacatgatgaaagtaatttttcatacagttaccatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcattaaagggagtgagggagtttacaagcctgttgaagcttacctcttggctaatcccgaagcctgcaactaggatataagttgcttaatttgaaattttatgcttgctt

SEQ ID NO: 3668 - DNA, 494 bp, Gossypium hirsutum
  Clone ID: uC-gsronu33B129a03b1
cccacgcgttcgctgttacaaaaggtcttcttgcaagaaagaggaaagctggaggttcactcttaccacctagtataaatcaaactaagatccatgaattgcgtgttcaagatgttggtctttctcacaactgaacaagctaaaaccagatggatttgtctgaaatgaaatggtgttaatgtcgatataaattacaagcaaaaagaatgctgtttatgggatgtaatctctcttttttttttggatgcgaaatcttgttctaataataacatatttttggtagctgattaatcatcaaaaaaaaaaaaaagagagaactatggaagataagattgaaaaaattaacaatgagaacatgttagagacagctgttggtggaagttgtatatccaagagcaaaacgaaaatttacactgggtttgaaaatgtgggggctgcttttttaatggatcatttttattatagggggttatgggaattaacaagctttttta

SEQ ID NO: 3669 - DNA, 538 bp, Gossypium hirsutum
  Clone ID: uC-gsronu33B129a04b1
cccactcgttcgttgacactttcaggcttcaggagcggccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggaccttcaatttttcatcggagagagcatgcacgatgatggatgtttggtatttgcttactacaaggatggtgctgttgacccgacatttttgtactttgcgtatgcattgaaggaggtcaagtgctgaggtttgaagcaaagaaaaaaaaagtggttgctgaagaatttagtcctttttattattgcttttgtctcttatcttcagtactctgctaaagacataaattatttatgggttttgatgtttttgatttaaattgttgttgttttatcatggaatggtttctattttattgggtgcctaaccaagaatttaaccttttgttcataactacttattttattggaggaggtttt

SEQ ID NO: 3670 - DNA, 493 bp, Gossypium hirsutum
  Clone ID: uC-gsronu33B129a05b1
aaaaatcttaattccctctagaaaaaatctttgatttgtcaaaattgtcgggccgtgggaaaggaggcaagggattaggaaaaggaggagctaagaggcatcggaaagttctccgagataacattcaaggcatcactaagccggcgattcgtagattagctcgtagaggcggtgtgaagaggatcagtggcctgatctacgaagaaactcgtggagttctcaagatctttctggaaaacgttatacgcgatgctgttacctatacggaacacgctaggcgtaaaactgttaccgctatggacgttgtttatgctctcaagagacaaggaaggactctttatggtttcggtggttgatttagggttttagggtctttcttcttttgttgtaaatctttcgttgcaactgcttgttgtaggcttttttttttttgtttggatcgatgtattttcgtttcgatgaaaatttcgctccgaaagctaattgggtttct

SEQ ID NO: 3671 - DNA, 547 bp, Gossypium hirsutum
  Clone ID: uC-gsronu33B129a06b1
ggtaatgccaggctcatgcccgaatagaaaagaatcacgggcactcaattcaaaaagcgcttctcttttcctcatgaattatttcccaagttacccggttgaaaccgaagcttgcaaagagcattcagcacgactagctgacatgatcggcacctgcttcaaagcagcagggagtatgatgccaaactttttagcagtcaacttctacatgaggagtgatggaggcggtgttttctatgatttggatagcatgaatggccaaagattatgtggatgtaatacaattgctgcttgccaggctggagcaccatttggatcttgcaagaacattacaatgccttcttcaagtccaatgaccaatactgccggaagcttttctggatctgttcaattctcgaaatccgcttcaacaatctattatcctaatcaattcgctatcgggttcttttctattccatggatgttgtttttattgtgactagaaatatagatagtttttcaggatagcatctacacttttactgagggcctataatatttcttagta

SEQ ID NO: 3672 - DNA, 451 bp, Gossypium hirsutum
  Clone ID: uC-gsronu33B129a08b1
atgattttgctcttgttggggccttcaagagggaaagggataaataagccgctttacaggcactgactgctgaaaaccaggcagctatgcagttgatggtatggggacggctgagtggagagccgcaaagagtcctgcttactacaaacgtggggattatgctcctggtttgaatgatacacaggagttgtaactggaattagtgagatggatcctgttagatggtctggttcaaaatggagatgcttgctggtatggttgcagacattgcttatacatttccaaaatatgttcaacatctgagtggactgaaatttgctcttctgtttctcttgtacttttttacatcatggtatgtactagttttattactataggtctgattttgtttaaagattttagttgaattgagcttttttctgttaaaataattaatcgaatcgaaccaact

SEQ ID NO: 3673 - DNA, 456 bp, Gossypium hirsutum
  Clone ID: uC-gsronu33B129a10b1
ttgattttgctcttgttggggccttcaagagggagagggataaagaagccgctttacaagcactgactgctgaaaaccaggcagctatgcagttgatggtatggggacggctgagtggagagccgcaaagagtcctgcttactacaaacgtggggattatgctcctggtttgaatgatacacaggagttgtaactggaattagtgagatggatcctgttagatggtctggttcaaaatggagatgcttgctggtatggttgcagacattgcttatacatttccaaaatatgttcaacatctgagtggactgaaatttgctcttctgtttctcttgtacttttttacatcatggtatgtactagttttattactataggtctgattttgtttaaagattttagttgaattgagcttttttctgttaaaataattaatcgaatcgaaccaacttcaat

SEQ ID NO: 3674 - DNA, 542 bp, Gossypium hirsutum
  unsure (1)..(542): unsure at all n locations
  Clone ID: uC-gsronu33B129a11b1
ttcattcgtccgaaaaattcaaaatagtttcaagggaggttctttacatttctcctggggggtggctgcttttttccccttattttctctccataagaactctttttctcttcattctgccaatatcttcatttgaagcaactatgtcttttagaggaggaaatgcatcgtctggcatgggagtggctgaacacagcaaaagcacgtacctggaactgcagaggaagaaggtgttccgatatgttatcttcaagattgatgagaagaaaaaggaggtcatatttgaaaagattggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaangacaggttccganaggaattgagggcattcattacaaatccaggcaaccgaccgactgaaatggat

SEQ ID NO: 3675 - DNA, 552 bp, Gossypium hirsutum
  Clone ID: uC-gsronu33B129b01b1
gcgagattttggctcttgttcctcttcatgttgggtgctacttgggcatgtaacgcccgacaactagaagttgttgaggtagtaatctcggatccatcagttgtccaggtaaactggaggcaagatgaaaaagtgatagaaacggtagctcggaatgacaacgtgtgcaccttgtgtgaggaatttactactgaggcagttgattacctttcacagaataaaacgcagactgagataattgagattcttcacaaaagttgctcccgtttactagcttttgagccccagtgcattacacttgtggactactatgcacctctcttcttcttggaaatatcttcagtacaacctcaagatttctgtacaaagttcaacctttgtcaaaaagttgcacttatatcttcacaattccgcgaagatagttgtggcatgtgccaccgtgctatttctgaagtactaatgaagttgcaagatcccgatacaaagttggagatactcgagcttcttttgaaaggatgtaattcagtgcagaactatgtgcaaaagtgtaag

SEQ ID NO: 3676 - DNA, 62 bp, Gossypium hirsutum
  Clone ID: uC-gsronu33B129b02b1
aaagactattagactaccatggaaacacaatatgctggttggtatggtatgtgttgctggtt

SEQ ID NO: 3677 - DNA, 558 bp, Gossypium hirsutum
  Clone ID: uC-gsronu33B129b03b1
aggtgatctcgccctctcatcatcacattcactttatgtaggcttcctattttttttctgttttcttttttttgtataagtctcaaagaaacttagaccccttcgtattctccgctcataccccaaatccccataccccttctgttcaacagcaaagatggcaactgtgcgggttacctcctctagtatcgttcaagcttcaatcccgaaccgattcacgagtgccattgtcaaggccccgacttctcttggatcttttaagaacatctccaaatcttttggcttgaaatgttcctccaatcacaaaacattaatggcagcttataagattaagcttgtaggaccgaatggtgaggtgagcgagtttcaagcccctgacgatcaatacattttagatgcagccgaggaagcaggagttgaactgccatactcttgccgagctggagcttgctccacatgtgccgggaagattgtgtcgggttcagttgatcaatcggacggatccttcctgatgaaaaacaaattgccgatggttacgtgctgacttgcgtttcgtac

SEQ ID NO: 3678 - DNA, 462 bp, Gossypium hirsutum
  Clone ID: uC-gsronu33B129b04b1
gcaacttttgtgatcctgaaacctctgcagagttgggggtgcaagaaaaaatgcccctgctcgaatggtttgccaacgagtacaagcgcttcggttgctctcttgaattcgtcacaaacaaatcccaagaaggatcacagttttgcagaggcttctgtggcattggaggtatcctccgctatcagcttgacataagatcattcgatgagctatctgatggagaagtttacgaggattctgaatgataaagcactgcttaaagatggtatgatggcttgagagcctatagagcccagatgtaatgcttcgtctttttacttatttcaccttttgattcaaaagtaactatagacactgttggtttggtttttgctgaattgtgctgtctctgtcaattggattgtgattgcttgtaatcaggaaccgttcattgttttttacttcttcggtgttccatgcaaa

SEQ ID NO: 3679 - DNA, 519 bp, Gossypium hirsutum
  Clone ID: uC-gsronu33B129b05b1
agaggatgcaattgtaaaagatcaagttgcttaaagaaatactgcgagtgttttcaggctggcgttggatgctccctcagttgtagatgtgaaggttgtaaaaatagttttggtcggaaagatggaggttgtgaatctgaatctgatggggacaacttagaggcgtgcgaaaaaaatgcatcagagaaaagctcacacgacactgtaatcagtaaaggtcaagagcatccaaacctttcagtgccttctcctgatatttcaaggctgccatttgcatacactgggaagcttgcagcattttttccccattccattaagtcatctcctcagttgtgcagtactcaagaacaaggttcatcagatacttcgtcatgtaagcccaagttggagtctaatcttgatggaattccagaaaatggaactcctgagattcccaaacataaatgcttcacacttgtttcaaatccaacatctcccaactgtaaaagagttttttcaactccaaatcatgattccact

SEQ ID NO: 3680 - DNA, 568 bp, Gossypium hirsutum
  unsure (1)..(568): unsure at all n locations
  Clone ID: uC-gsronu33B129b06b1
atttattttctcccaattattttcatcgttagggagaacgaaaatagaaatgggaagcgatagcgaagtagagaagacgcagcagaaggagaaggagaggaagaagatgttagctatagctcccatcgcaaagccccttgctggcaaaaagctctccaagaaaacccttaagctcgtccgaaaagcatctgagcacaaatgcttgaagagaggagtaaaggaattggttaaaagtattaggcgtggtcataaaggattatgtgttatagctggaaacatatctcctattgatgtcataactcatgttccgatcctatgtgaagaggctgaaattccatatgtctatgtttcttcaaaagaagatcttgcaacagcaggagctactaagagaccaacatgctgtgttttggtgctaaccaagcccaccaaaggtgaactcgccatcgaggaacaagaaaagatgaaagccgattatagccagatagtatcggatgtatctgagcttacatcatccnttttctaattaactcagaaaaaaaaaaaatgtgtgcttgtcatataagcattg

SEQ ID NO: 3681 - DNA, 454 bp, Gossypium hirsutum
  Clone ID: uC-gsronu33B129b09b1
aaagctggggctggatctgctactttgtcaatggcatatgcagctgtcaagtttgcagatgcatgtctccgaggcttgagaggagatgccggagtcgtggaatgtgcctttgtagctttcgaggttaccgaacttcctttctttgcaaccaaggtacgacttggtcgtactggagctgaggaagtctatcaactagggcctctaaacgaatatgagagggttggtttggagaaagcaaaggaagagttagctggaagcattcaaaagggtattgccttcatcaagaaatgaaattgttgctgctgagctaatcttttaatataaatataatataagcttcttatatctgttaaaagggctttgtatatgttttggcgcttaagaacctctattgagacctaaatgccattgatatactcttctggttaatgcagtcaaattttatgcttgtaaa

SEQ ID NO: 3682 - DNA, 500 bp, Gossypium hirsutum
  Clone ID: uC-gsronu33B129c01b1
agatttcataaaagttgatgctcatgttcatcaattgaagggtatcatttccagcattggtgcacagagagttaaaaatgcttgcattgcttttcgtagcttctgcgaggagcagaacatcgatgcgacactgagatgtcttcaacaagtgaaacaagagtattaccttgtgaagaacaagcttgaaactatgctcaggttagagcagcaaatcgtggcggctggtgggtcgattcccatgattgaactgggtttttgaagaccataaacatgaaggggggaaaagcatgattttgggggtggtttatacaataggaacatatggtgtttaaggtttctcttttttatttaatcttaccagtgagtttgtggttgtttgatgttcatgaaagaagagatttcatactagtttcactccccataacttttaaaaggaacctttctgttgataaatttcctcttaaataatactgtttcttccatgaatgttaactattgtt

SEQ ID NO: 3683 - DNA, 568 bp, Gossypium hirsutum
  Clone ID: uC-gsronu33B129c02b1
cggatagaaaatggaataggtttgagtctttggtgcggtttaatccgaagagagaattccggaatgggacggatttgatatggcaaatacccgattcgcctaaggctgttctttttctagctcatggatgtagttgtagagctgttaatttctgggataagtcacataaatgtcctgaatgcgttggtttgcctgaggataggctgcttgtgcttcatgctcttgctcgtaaatttgccgtgttgactatatcaagcgtaggggaatgctggacatttgggaaggaaaggttgattgttgaagatattataacatggtgggttaacagacagaaacttggaaagcttcctcttgtggctttgggggcttcttctggtgggtattttgtatctgcaattgctaatgatttgaagtttagtagtattacacttatgatcgctgaaggcttatttgatcgcatggacatcaaagaggactatccacgcttaataaacattcaacaccagtctggattggttgttatagatggatggctgaagctgacagcgcctgctcaaactgcagtatt

SEQ ID NO: 3684 - DNA, 562 bp, Gossypium hirsutum
  Clone ID: uC-gsronu33B129c03b1
gcaaaacgtagaccccaaagctcacgtcctatcttccaattccaattcagtccaatgcttgctgttctttgcttcatcgtctctggtttcgttttagtaccccaattttgttaatcgatcaaggatgggctcatccaccgcatttccatcgtctcggttcatcgcatctgaacgcccctcctttcttccacgccgtagcagctgcttctcctccttcacatctccaacttcatttgtctcttatcgcagatcctccaactcccgaattctgcatatctctgcttctcttctgcactcaaacgttgacgtttcctggttccctcccgaccccaattctctacctaacaactatgggggttgggccgttgttcaagctcctctgactcccaaaacaaataaaaaaggattgtcttctatttttgttgggagtcttattgggtcttcacttgccattgcaatttccatttcataacttgtattctacaaaaaagggtttaagtttcagttcaggggttcattgaatactttttacgaggttcttagctggagagaaacacgagat

SEQ ID NO: 3685 - DNA, 169 bp, Gossypium hirsutum
  Clone ID: uC-gsronu33B129c04b1
aaaacaactaatttaacaaaaaagttaaacgtgttaagaagtgaacttaaattttaaaattttaaaaataaagagaataaatttctaaaaatataaagactaactttttaatttttaaaaatataagaactatagacatattttaaatcattaaaaaataatctttaac

SEQ ID NO: 3686 - DNA, 468 bp, Gossypium hirsutum
  Clone ID: uC-gsronu33B129c06b1
cccacgcgttcgctactttagaaactcaaacaaactggttagttctcaactctctcaaattcaccatggctgacaagtgtggcaactgcgattgcgctgacaagagccagtgtgtgaagaaaggaaacagcttggtcattgagactgaggagagctacatcagcaccgtagtggtcgagcctctggcagagaacgatggcaagtgcaagtgcggaactagctgcagctgcacaaactgcacatgtggcagtcactaagcagacatatagaatgatgaagtttgggacctaaaaagaataaaagttgggttgaataatttgtgtcttttgttgtagtttgagtgtgttttcttgtctatctgtccgatgattgtctatgtctctcattttatacaatgatggaatgaccatgtcaatggcctttgtctgattaatgaactattattagtataaatcttctgacttgact

SEQ ID NO: 3687 - DNA, 202 bp, Gossypium hirsutum
  Clone ID: uC-gsronu33B129c07b1
tccacgcgtccgcccacgcgtccgcccacgcgtgcggtgctaaggtcaccaaatctgctgccaagaagaaatgagagattatttgagagagaattatatcagttttcattacagctttggacaattatcttaaatttggacttttaaaatttacttttgtgagagactttttgatttgctttttaaacaaatcctaagtttt

SEQ ID NO: 3688 - DNA, 566 bp, Gossypium hirsutum
  Clone ID: uC-gsronu33B129c09b1
cggatactagcaagtttgaagattttgtcgataaaaatctcaggggagagttttctgaatccatggcatctaagctggggaaaattgcacttaattgcaccaatgaagaacctaatgacagaccaagcatggaaacaattattaaagagctaaatgattacagtgtcagttcttgatgggggcattatcttttaccccaacttgagaaactgacgatgatgatgatggggtcaaagagattgctgaaacttgatttttgttggtggttgtagatctttttgtcgagtactatgatgatttgaagtatgaaaagatgacaatatcgtgtaaagtggagttgcagataggagtttcctcactgatgactagcaaacaaaagaagtacggagaaatattgggagaaataactttctaatcatacaatttgatacatagattttaattcgtacctccacatgcattgagccagcaaaacgagccaagctagttgacattaaggttaatagcatgtctcttggagaacatcatccccttaatgcttttattttctttagtgaggagaaaac

SEQ ID NO: 3689 - DNA, 495 bp, Gossypium hirsutum
  Clone ID: uC-gsronu33B129c10b1
ttcactcgtccgggtgaatttaccatggtcgagcttgctgtgactgttaagtagcttattaaacccgatgtggagataaacatggtggagaacactccggatgatccacggcagagaaaacccgacatcacaaaggccaaagaattgctaggttgggagccgaaagtcaagttgcgggatggtcttccgctcatggaggaagatttccgattgaggcttggaatctctaaagagtgatcaaacctattagcggattatactaatagagatgagattcacttcttgcggggaacaatacatccagccttcggtctttgttctccaatgcctcctattggtctttactatataaaaggaaaaaaaaaaccatagccattgaaagtaggaattttgtgcaactattttaatttccggtccttaaagtggacattgatgatggtcttgatgccatgaattttgtttgctactgctatcaataaaaaaaaatggtgatta

SEQ ID NO: 3690 - DNA, 549 bp, Gossypium hirsutum
  Clone ID: uC-gsronu33B129c12b1
ttttataataggaatgatattaacaggattttgggggctaaagcttcttgcatttgattcaaggattccgcttgtcgttgctttggttatatggtgtctaagaagaagtatattttcaccattgatgatgactgttttgttgctaatgacccatctggtaaagcaatcaatgcacttgagcaacacatcaagaacctattatccccatccacacccttcttcttcaacaccttatacgatcccttcagagacggtgctgattttgttcgtggctaccctttcagtctccgcgagggtgttcccactgccgtctctcatggcctatggctaaacatcccagattacgacgcaccaactcaacttgtcaagcctctcgagaggaacactaggtttgttgacgcagtcttgacaattccaaagggtactttgttccctatgtgcggaatgaacttggcatttgaccgtgagctcattggtcctgcaatgtactttggacttatgggagacggtcaacctaatcggccgttatgatgacatgtgggcttggtt

SEQ ID NO: 3691 - DNA, 507 bp, Gossypium hirsutum
  Clone ID: uC-gsronu33B129d03b1
aaaaaaaataaaaaaaaaaaaaaaaaaaaaaaaaaaaaaaaaaaaaggtggcgcgctctatagggtacaaaagttcacacacgcgcatgcgagacgatatatcttttatatagtgacacaaaaacaaaatacagtgcgcggttttacacaacgttgagtgtgaaaaaaccgtggtgacccaaaaaaaaaatcgttttggaacatatccctttttccaaagtttgtaaaaatagaaaaaggcccccccgtatccctttttaaaaaatgtgcaaaacttaaatggaaaagggaaccccccctttcgcggcatattaagccgcgggggtggggggtttccccccagtgagacctttacttgttagagcgccataaaaccccgcctctttgtatttttccccctctttttttcgccacgttgcggcggtttttccccctcaaaattttaaaaaaagggggcgcctttttgggggcccccatataaaaagttttttggcgccccttctcccc

SEQ ID NO: 3692 - DNA, 540 bp, Gossypium hirsutum
  unsure (1)..(540): unsure at all n locations
  Clone ID: uC-gsronu33B129d04b1
gctggacctatttacaatgattatagctctgttgggtgctgtttgcttcttaagaaagagaaggcgattattgtgcagcctgatcgggtggtcattggtaatgggcctgcatttgggtgtgttttgatgaaagacttcctaagagagcttgccaagaggcttaagcacaataatactgcttatgagaattaccataggatttttgttcctgagggacaacctttgaaggcagcacctaaagaccctttgagggtcaatgttttgttccaacatatacagaagatgctttctagtgactcanccgtgattgctgaaactggggattcttggtttaactgccagaagctgaagttgcccgcaggatgtgggtatgaattccaaatgcagtatggatcaattgggtggtcagttggtgccactcttggatatgcacaggctgttccggagaaacgtgtcatcgcttgcattggtgatggtagtttccaggtgactgcacaagatgtgtccacaatgctgcgatgtgggcagaagaaccgaatc

SEQ ID NO: 3693 - DNA, 569 bp, Gossypium hirsutum
  Clone ID: uC-gsronu33B129d07b1
ataaaaaacaaatcacctttgctttctttgtgaaatctttctgatgtcttattgcaaaaaaatatttggtgtacaatcatccttttctgtgtgtgtgtatctctttatagatcaaagaaaaaggctttataacctcagtctattacatattttggaaagaaatccttgatttctttccatatttgtttaatctgtatattgtgttctttctttccatatttgttctttgtctgtcgcgatttctttcctttgtttgaaggtgagcgcgaggatctcggtggcgagacaagactgaggcgtggtgtgctgatgatggtgacgatctcggcgttgtttgcgcgccggtggtggcgcgacatccagtagctgaggtcaaggagaaagtcgtggcgctggtagagccttgacatgaggccaacagacgctccccgaaagttctggagtttcgtgaaacgaaagggcgcttattggacatgacgtttgaggcgcctgaagcttccagaatcctttgcggcttgaggagaaagagagctagggtttctaaccctatctgaaagtcatttgggccc

SEQ ID NO: 3694 - DNA, 570 bp, Gossypium hirsutum
  unsure (1)..(570): unsure at all n locations
  Clone ID: uC-gsronu33B129d08b1
gcaaatttaggaaaagaaatttatttcttcccaaattaaaaccctccatttgatttcctttttacgaaatgtgtctaaattcccctaaaccacgcgcttatgtcccaaacaaaaagaattagaagatgggcatgccacaaacccaagagcagcaatctgacagtaaccctgaatcaattcaaccgtaattccaaagtaatcgatttcctaagcccccacccaatcgacctacccaaatatttgaaaacataatcataattcctgttatatttccattgttttcttcttcctcctcttctctctgttgcaggagcttcggagacgacagatttcgaagaggatgaagctttctgcgttgcaccagagctacatcagccgtcgaaccaacagcttcagatcatctgggccattggattcgtcttccgacagtgccattaaatcccctgccgccattttctggcttgtcttccatggtctttgttgtttaatcagcttgctccttggctaccgcttttctcgcttggacttcttncttttggtctccacttcttctactaacttctatacgtc

SEQ ID NO: 3695 - DNA, 563 bp, Gossypium hirsutum
  Clone ID: uC-gsronu33B129d10b1
tccattcgtccggaacctcctaagaaggagaagcctgaacctaaaccaccagtatatgaacctccaaagaaggagaaacttgagccaaaatcaccggtttatgcacctccaaagaaagagaaacctgaacccaaaccacccatatatgaacctccaaagaaggagaagcccgagccaaagccaccggtttatacacctccaaagaaagagaaacctgaacccaaaccaccaatgtatgaacctccaaaaaaagcctccaatgtacgaacctaagccaccaaaaccatcggtttatacacctccaaagaaaaagaaacctgaacccaaaccaccaatgtatgaacctccaaaaaaagcctccaatgtacgaacctaagccaccaaaaccaccggtttatacacctccaaagaaagaaaaaccagaacccaagccaccaatgtatcaacctcccaacaacccaccaatatatgagcccaaaccacctaagccaccagtttatgcaccaccaaaggaagaaaagccaaaacctaaaccaccagtttatgagccttcagcatatgag

SEQ ID NO: 3696 - DNA, 568 bp, Gossypium hirsutum
  unsure (1)..(568): unsure at all n locations
  Clone ID: uC-gsronu33B129d12b1
ttctttctacttcctctcaactctcaaacccaggagggtatatgaaaaaaagatgggttgggagatctgtgtcaaggctgctgttggtgcccctaatgttcttggagactgtccattctcccagagagctcttcttactttggaggaaaagaagatttcctacaaaatgcaccttatcaatatcagtgacaaacctcaatggtttttggagataagtccataagggaaagtaccagtggtgaagtttgatgacaaatgggtggctgattctgatgtaattgttggaatccttgaagaaaaataccctcagccttgtctcaaaacccctcctcaatttgcctctgttggatcaaacatatttggaacttttgtcacatttttgaagagcaaagatgctaatgatggatctgagcaggctttgcttaatgaactcaaggcattggatgaacatcttaaggcacatggcccattcattgctggggaaaagataagtgcagttgatttagctttgggacccaaactntaccatcttgaggttgctcttggccatttcaagaaatggactgtt

SEQ ID NO: 3697 - DNA, 541 bp, Gossypium hirsutum
  unsure (1)..(541): unsure at all n locations
  Clone ID: uC-gsronu33B129e01b1
cgttacatgtgctgattttctgcnagcgcctggagttcaaacccctgttatcttgagattttcaactgtcatccatgagcgtggaagccctgaaaccctcagggatcctcgtggttttgcagtgaagttctacacccgagagggtaattttgatcttgtgggaaacaatttcccagtcttctttattcgtgatggaatgaaattccctgatatggtccatgctcttaagcccaaccctaagtcccatattcaggagaattggaggatccttgatttcttctcacaccatcctgagagcttgcatatgtttactttcctctttgatgatttgggtgttccacaagattacagacacatggaaggttctggtgtaaacacatacactctgattaacaaggctggcaaagcacactatgtgaaattccactggaagcccacttgtggggtcaaatgcttgctggaagatgaggcaatcaaggttggaggagctaatcacagccatgccactcaggatctctatgactcaattgctgctggcaac

SEQ ID NO: 3698 - DNA, 552 bp, Gossypium hirsutum
  Clone ID: uC-gsronu33B129e03b1
cccacgcgttcgcccacgcgtccgcggacgcttgggggttagttcttagatagaacatggacataacctttcggcatctctcagtttcttcctctgcattcaatttgcactcatcggagaaaacaaaagatgtcgggcatgggagacgggtacgtcggcacggcccaagatgccgttaggatccgccgtctctagaagcagagagaaaccgaacgccgtaaaatccaagagcttaaaaccaagtccgcctccgctaaaggtcaacccggtcttctccaattcggttcaagtacttctgagattctcgagactgcatttaagaaggaaactgttggtttggttacaagagagcaatatgttgagaagagagttaatatccgaaacaaaatcgaagaggaagagaaggagaaactccagaagcttcaacaagaggaagaagagcttcaattgccaaagcggaagaagaggaaagttaaggggaattcttcgctgtcttttgcagatgatttcgacaacggaagtgaagaggaagatgatgaaaacaaaactttg

SEQ ID NO: 3699 - DNA, 189 bp, Gossypium hirsutum
  Clone ID: uC-gsronu33B129e04b1
caattttatgtcattattttatcatttgttgttatttttgtttgtgccatgttcctgttctgaaataaactccaatgtgtgccttctagaaatggtttctcttagtatttcttggaacttgatctgaattcttgatgagtcttgatctcagctcaatattgtttaatggattcattttgtctctctcct

SEQ ID NO: 3700 - DNA, 540 bp, Gossypium hirsutum
  Clone ID: uC-gsronu33B129e05b1
cccatctttcctctcatacttcactctaacgttccctgtgaggttttaggaaaacagcagagaaattaaggaatggagaccttcctatttacctcggagtctgtgaacgagggacatcccgacaagctgtgtgatcagatctctgatgcagtcctcgatgcctgtttggcacaggatcctgagagcaaggtggcttgcgagacctgcagcaagacaaacatggtgatggtgtttggtgagatcactaccaaagccgacgtagactacgagaagattgtgcgtgacacctgccgtggcatcggtttcacatctgacgatgtgggtctggatgccgacaactgcaaagtgctggttaacatagagcaacaaagccctgatattgcccaaggtgtccatggccatctcagtaagcgtcccgaggaaatcggtgctggtgaccagggccatatgtttggttacgccacagatgaaacccctgaactgatgcctttgacccatgttttggcaaccaggcttggtgctcgcctcactgaagttcgc

SEQ ID NO: 3701 - DNA, 562 bp, Gossypium hirsutum
  Clone ID: uC-gsronu33B129e08b1
ggtattgcttgggctttcggtggcatgatctttattcttgtttactgcatcgctggtatctctggagggcatatcaacccggctgtgacattcggtttgttcgtgggacgcaaggtgtcactcatccgagccctgatgtacatggtggctcagtgcttgggtgccatatgtgggtgtggattggtcaaggctttccagaagacctactacaacaactacgggggtggtgcgaacgagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacatagagaaggcctgggatgaccaatggatcttctgggtcggacccttcattggagctgccgcagctgcatttaccaccaatacat

SEQ ID NO: 3702 - DNA, 499 bp, Gossypium hirsutum
  Clone ID: uC-gsronu33B129e09b1
gttgtatccggtccatccattgtccacaggaagggcttcttatttttgtaattgcttttgatggtgggctacattttgcatttagttggctttttttggtgtgccgggttaagtgaactcaaaagactggtttatgtctgggaagatagggatcattgtacgatggactacttgactaatgtactattattttagcctttcaccgtatcgccaccattaagatgacgggccctatggggctggcggtgggcggacaattggtgcttaattccctacttgcttaccttccatcttttaagcattttgctaaagaggatgtttggagctggagactgtattgtggagcttattattatttattattcaagggttttgagaacattaatgttaatagctattattgtacgagatttttttttgaaaaattagtcagtttgcggccaaacttgtatgggaattataattaatgcctggttttggaatcttgtgaatccttttt

SEQ ID NO: 3703 - DNA, 571 bp, Gossypium hirsutum
  Clone ID: uC-gsronu33B129e10b1
tgcatacttactcttggcaacactccacgtcggcagaccaagattgtatcaactggtcctaatccagagtggggtgaaagttttgcgtggacttttgagagtcctccaaaaggccagaagctgcacatatcttgcaagaacaagagcaaaatggggaagagttcctttggaaaagttacaatccaaattgatcgagttgtaatgcttggatcggtagctggtgagtacacgttattgcctcaaagtaaaagcgggccatcacggaatttggaaatcgaattccagtggtctaacaagtgaagaagatgagagagataattatcaccattattattattattactattattatttttcccggaaatttgatgattgatcaagtagggaacatacgttttggtttttccaattttatatcataatattacagtgtacatagtctaccggagattttgacgtctgtagaaatgttttattgtttcaaaaatagtgatttgtgaaagtattcatttaatttgtaatctgatttttcctttgcatttatttctgtagaggacacaggctatttttg

SEQ ID NO: 3704 - DNA, 495 bp, Gossypium hirsutum
  Clone ID: uC-gsronu33B129e11b1
gatctctgatgagttcactggtgctggagccatgggggaggtttgtcaagtaatcggtgccgtcttcaatgttagattcgatgaaggcttgcctccgattttgactgcgcttgaagtgatggaccactcgatccggcttgtgttggaagtggctcatcacttgggtgaaaacatggttaggaccattgctatggatggaacggagggactcgtcagagggcagccggttctcaacaccggatctcctatcactgtgcctgtcggtagagctactcttggtcgtatcataaatgtcattggagagcctattgacgagaaaggcgaactcaaaaccgaccatttcttgcccatacacagagaagcaccagcctttgtcgatcaagctactgaacaacagatccttgtcactggtattaaggttgtggatctccttgcaccatatcaaagaggagggaagattggactttttggtggtgctggtgtaaggaagacagt

SEQ ID NO: 3705 - DNA, 581 bp, Gossypium hirsutum
  unsure (1)..(581): unsure at all n locations
  Clone ID: uC-gsronu33B129f01b1
cccacgcgtccgagctactcgtttgaaatttatactagtactaccctttacaaagttccctgagaaaagacttgggaccaatttacaagatcattggagaaagacctaaatcaactcacgccctcaaaaactaggacacgtgatctaatacaaagccagttagttcatctataatatacctatagtagccgagcagatggctattgctgtacatctaaggaccactatgcatgtggatcttgcttcttgctttgctaattttggttttacagcactctacttaatagtactcaatcgtcagaagaatcgatactggataagaacaattatgattcaaatatcaaagtcactggcgatccacatcatagaatccacagttcctttttctatttcgcataatattatataactagtgctagaagaagaagaagaaaaaaactccattagtttcctttgtaggagcgtcaaaggaatgcctcgtcttcatgttttaaggtggtagaggagcaacgcttcaagcttcgcangacattagagatgttgggatataaggcttgacgaagtttattgtatttttcgat

SEQ ID NO: 3706 - DNA, 579 bp, Gossypium hirsutum
  Clone ID: uC-gsronu33B129f02b1
caaaattatacctagattttcatttcgcttccaatcacataaaggactttcttggcctgctacttcagataatgaaaatgaggtgtcaactaaggctggtgaaatgccagaaagattgaaggccagtgatcatggaaccttatagcattcaatagctgaggttcttgaagatttcaatggagaagaggaaaaccagttagagattgttcctgctgatgtagaagctcatggtcatggatttattgagcattcaatggctgagcttttagatgaccttcaagataataccagtctgctaagagggaattttaaaatgcatagcagggcaagaggaaaaagggtacaagctgctctcaaaagaagtatatgttcactcggtgatagaaccattgaaagtgaagacctcaatgagcccttcagtggtgggtcatcaagcaatgatgaggctgattaccaaaatctaaaacttgctacccctaagataaagaagccaactatttcagataagtttcaggaagccttgggtgccaccttcttgactgttgaagcatctttattcctagaccaggagcattcact

SEQ ID NO: 3707 - DNA, 356 bp, Gossypium hirsutum
  Clone ID: uC-gsronu33B129f03b1
gtatgtcttaaaaatatagtaacaataaatttttcctcatcagatttttggtcccaaaaccactgttctgactaggccctaaatataatgttacaagtgcaccttctaatggtctcctacacactcacaaagtgcgttagctcacccttaggcctcattcggcctctaaggtcaataaaagactcattttcacattttattgaatgtaaataaaactatgaaaacttaactttacataacgaaaatgcttatattcaagctccttaaatgtgaaaactagttgaatctgctaaaccaaattacgacatatcaaactcctccacacttaagttattgcttgtcctcaagcaacatat

SEQ ID NO: 3708 - DNA, 573 bp, Gossypium hirsutum
  unsure (1)..(573): unsure at all n locations
  Clone ID: uC-gsronu33B129f05b1
cccacgcgtccgattaactttagtaaaccgactgattcagacacgaagtcgaaagaatttagtaatcggaattccttctgaacttactttcttcagtgaaaggaataataagtgattagtgatgacataaatagttgaaggaataatatttgaaaggtaagacattgagtgtgacagttatggctgaacagattttgacagtctcttttgaggtattctatatgtgtaattgttcttgagattgttcctatgaccttcactcttctgataaaacctttgttttatggaaatattttctaatcatgatgtatagaaaaaagtattagtagttcaactagtatatataatctgtattgcttcattcccctctgacattctattgtgtttcatctattgaaactttatgaaaaagtacacatgatgatataactctgtttcttctagttgatgttctattcgatatgtatatatatgggaaggtatatcattctttntgcatttacttccagtgggttggatggatgtattctttcagacttcttttctctgaggaattatcgagatccttcatat

SEQ ID NO: 3709 - DNA, 562 bp, Gossypium hirsutum
  Clone ID: uC-gsronu33B129f06b1
cccacgcgtccgcccacgcgtccgaaaaaaaattgtgtttttggtgctttgaaattgcaaagtagaaaaatgggaattccatcagaaataagggatgtttgggtacagaggaaaagaaattccttcataattccttcccctgctgaagacgagaagaatttgagagccaagcaattctctcaagaaggaattcgtgccggtgtcaaggcggctgcggtcgccgccgttgtcagcgccgtacctaccttgattgcagtacgtaagattccttgggcaaaggcaaacctcaaccatactgctcaagctcttatcatcagtggagcatcaattgcggcctacttcattaccgtagataaaaccgttttggaaagtgctaggagaaattctcgagcacagttcgacaaaactgtttgaatgctagaattgaaggtattcagtggcgaaggttcgcagggcaagtatgatacatgttaataagttttaaggctgttgtatgccatgcattcacttttttttcttttttttttctgtggattttatcatcaattaagcagttttaatg

SEQ ID NO: 3710 - DNA, 532 bp, Gossypium hirsutum
  Clone ID: uC-gsronu33B129f07b1
cccacgcgtccggaaatttcgttaaacgctacgctccaaaaaatatcaccgccgcgccatggcggcgactgcatcatctccgtgggggaaacccggcgcatggtctgttgacgccgaagaaaatgaagcggaagtcgagcgacaacaaagcggcgccggttcctcaaccgaaaagctcggggatttcccttccttagccaccgctgtcaccaccaccaaggcgaataaaaagaagggtcaaaccctatctctctccgagtttgcttctaagcccagtgagccagcccgactcactcgcgaggatctcctcgcactccccactggccctcgacaacgttccgctgaggaactcgatcgcaaccgattaggtggtggttttaaatcttatggttcgaataggtatggttcggatggcgatgattcttcgagtaatagtagatggggattgaataaagatagagaaactgcttcctcacgcgccgatgagattgacgattgggcttcggctaagaaatcgacttccgccgcaaac

SEQ ID NO: 3711 - DNA, 562 bp, Gossypium hirsutum
  unsure (1)..(562): unsure at all n locations
  Clone ID: uC-gsronu33B129f09b1
tcctttcgtccgctttgttgaaggccttccattgcaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactatangcgataatgttatcactgaagacgaaatcaaggctctcattaaagggagtgagggagtttacaagcctgttgaagcttacctcttggctaatcccgaagcctgcaactaggatataagttgcttaatttgaattcttatgcttgcttttaaagaggggtttgattttaatgttgtgcttttgatattttctttttcatcttaaaacctatattgtcttctggttgctcagtaagaatgatggtggtggtgatcgaactttgatcatctttgatatataatgaaataaataaatttattaactggcaaaaaaaaaaatctatacccaatatatattttacagttttcatgg

SEQ ID NO: 3712 - DNA, 565 bp, Gossypium hirsutum
  Clone ID: uC-gsronu33B129f11b1
accattactcttgacaagaacctcgcaacaagtctgggcaagttgctcctcaagtacaggccagaggacaaagcggccaagaaggaacgtctcttgaaaaaggcccaggccgaggctgaaggaaaagcccccgagtctaagaaaccaattgttgtgaaatacggtcttaaccatgttacttaccttatcgagcagaacaaggctcaattggttgttattgctcatgatgtggatcccatagagttggtagtgtggcttccggctttgtgcaggaaaatggaggtcccatattgcattgttaagggaaaatcacgtttgggatcgattgtccacaagaaaactgcttccgtcttgtgtttgaccacggttaagaacgaggataagctggaattcagcaaagtactcgaggcaatcaaggcaaacttcaatgacaagtacgacgagtacaggaagaagtggggtggcggcatcatgggctccaagtcacaagcccgaaccaaagcgaaggagaagcttcttgcaaggaagctgcacagaggatgacataaaggaattaatagacctt

SEQ ID NO: 3713 - DNA, 186 bp, Gossypium hirsutum
  Clone ID: uC-gsronu33B129g01b1
ataaactattaatttgccgttagaataccaagctgaataaagtagtcttttgagtgtgtgtgtgttttaatttggatcacaaatttagtaattgtagtgtagtgtattttgtttgtataataagcatgtttaaaatattttatattttacataaattttggtgtctcggaaaaaaaaacatataat

SEQ ID NO: 3714 - DNA, 64 bp, Gossypium hirsutum
  Clone ID: uC-gsronu33B129g02b1
cccactcgttcgtgaatgtgtatccttttgtctatgggcaggaatcgaaatgtttctttggtcg

SEQ ID NO: 3715 - DNA, 427 bp, Gossypium hirsutum
  Clone ID: uC-gsronu33B129g05b1
cccactcgtccggaaaagtacaagtgggatgcatggaaggctgttgaagggaaatcaaacgaggtcttcctatagttctgaatgatttcattgctgggcaggaagtcggcaatgttccatttgtggtggaaaatggatgtgggaaattttcaaagtcaccaaaagaaatagccaatatcataagccagtggtttggtcccaaagcagatgaactcaagtccatgtctgaaaatgctttaaggctggctaggcctgaggcagtattcaagattgtccacgatctccatcagctggtcagacagagaaattttgtaccccaattttcttgtacaacttaggtccactagaaaaactaaacaaagaaatagattttctaacgattttcccctttttgatttcattatcaattaccttgttttcttatttc

SEQ ID NO: 3716 - DNA, 138 bp, Gossypium hirsutum
  Clone ID: uC-gsronu33B129g06b1
cccattcgtccgcccacgcgtccgatggtatcttgggatggttgctttactttatatggagtagtttgaacttacaagactgtaatggaattttgttaaatttgcttagtttcttctgatgaagttttgcagttttct

SEQ ID NO: 3717 - DNA, 252 bp, Gossypium hirsutum
  unsure (1)..(252): unsure at all n locations
  Clone ID: uC-gsronu33B129g08b1
attttgcaaatctttgaattcctccatggccagaaaggcaaagttaagctcctctgactcagaacccccgaaaatagcgtcggaacctcaaccggtccaagaaaaacagcggcaacaacctgtatacatacccgaagatccgaacccgaatccaaacgtggacgaagaacagcaaatactanaagtggaagaggaaatcgaagaagaagtagaagtagaagaggaatttgaagaggaggaggaggaggagga

SEQ ID NO: 3718 - DNA, 504 bp, Gossypium hirsutum
  Clone ID: uC-gsronu33B129g09b1
catttatcggggagcaatttgatgaggcagatgagatttgtggtgtagttgccagtgttcgccaaaggcaggacaaacttgcattgtggaccaagactgcaacgaatgaggctgctcagatgggtattggaaggaagtggaaggagatcattgacatcaatgataaaattacatatagcttccatgacgactctcgaagggaaagatcagcaaaaggtcgatacaatgtttgaaccatttgcaggtttctttgttcagcagtgtactctttatttgttacctattttgcatgtgagtttatgttatgtgataccaccaacaatcaagttccatgttagagacagttttgatattttaacacattgagaattttaccctattccttggatacttaatttgctgaatctcatagcatatgatgattctgggggccattagaattatgtacttggcaatgtttttggtgcttaacttggaaggttgaactagtttcagtttgagtcc

SEQ ID NO: 3719 - DNA, 559 bp, Gossypium hirsutum
  Clone ID: uC-gsronu33B129g11b1
ttagtgtatgacatggccttcctctgagaatatggatgatggtgacatgttgcccctgaaatgttccaatgatactgaggatatttacagatcagggagaaattattctggagaaagtaatgttgctaatggaaatcattctgtcaagcctcccacattccaaagaggagtgcttaggaccaattgtatagattgcttggatcgtacgaatgttgcacagtatgcatatggattggctgctcttggaagccagcttcatgctttagggattaaagattccccaaaaatagacctcaatgatcctttggcagatgaattaatgagtctctatgagagaatgggcgacacacttgcgcatcaatatggtggctctgcagctcacaataagatattttctcagagaaggggtcaatggagagcagcgacgcagtcccaagaattttttaggacacttcaacgttattatagcaatgcatacatagatgcggagaaacaaaatgcaattaatatattcctcgggcatttccagcctcagcctggtaaacctgcactttgggag

SEQ ID NO: 3720 - DNA, 548 bp, Gossypium hirsutum
  Clone ID: uC-gsronu33B129g12b1
ttcttttatgcttccagttatagatttctcaaggggggatctgaaaccagtcagccgtggatgggatttagtgaaatcccaagttcgagaagcattgggggagtacagttgtttcgaggcattgtttgatccaatcctgtatcttcaaaaggcagcgtttggggctttgcaagagacctttgacttgcctttacaaaccaagaaactgtgtgtttcccataagccctttcgtgggtatttcaatccttcatctggaccgtttcaaagcttggctatggaagatgctcatattgctgaaaacattgaacaatgcctaaccaacactttatggcctcaaggaaacataagtttcagtaaaactctggcgtgtttcactcaactagcatgcgagttacagaagaaaattttgaagatgattttggagagttttggacttgagaaatacatggatgagctcattgacgccctaagctatgaactgaggatcatgaaatatgaaaagccaaaaaccaatgatttaacccatgtgttagctgcgcactgtgact

SEQ ID NO: 3721 - DNA, 468 bp, Gossypium hirsutum
  Clone ID: uC-gsronu33B129h05b1
cccactcgttcggctaccttaacacaacttaccaactcaaaaaccccaagttttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgtgtggtgacttatatctgtcagttaacctttctctcctttactatgatgtaatggctatgcttatggccttatctggttaatgaagtatccttactat

SEQ ID NO: 3722 - DNA, 568 bp, Gossypium hirsutum
  unsure (1)..(568): unsure at all n locations
  Clone ID: uC-gsronu33B129h06b1
ccaattggacatggaactcgcctggcacaggcacacggaatccgttttgagtttcacagaggtgctgctgaccatacatatatgaggatcgatggggaaccgtggaagcaaccactgccaaaagatgatgacgcagttgtagttgaaatttcccaccttggacaagtcaacatgctcgcaacccaaaattgccgatcgaaaagtgtgagcgatgtttcctcatcaactagtcatcataatggtgaagaagatgatgattttagtgatgaagatgactctagagctgagccagagttcaggaaatttggtgcagcagacacgttcagaatcccagatgagattgatatttctcaacttagttaaacatctgataattccatttcttgtgttcattacttattcactgtaataatgtttggtgttcatttggtttaaatattgccgtaaaaggttataactcatagttaaattgccgcttttaaaccagaaaccaaatgatcccatcttaatgacgccattagcttcccagtaatttgattttgctttggnagnnaaaannaaagcactt

SEQ ID NO: 3723 - DNA, 99 bp, Gossypium hirsutum
  unsure (1)..(99): unsure at all n locations
  Clone ID: uC-gsronu33B129h07b1
tccattcgtccngnttttttgtaaatgtttgtaggttggtttatacaaatattatgggaaataaattctgatgaaataaaacgaattcaacctcttttt

SEQ ID NO: 3724 - DNA, 450 bp, Gossypium hirsutum
  Clone ID: uC-gsronu33B129h10b1
gttgttaggccttcttcagctaccaactgacaaagtggtcctgttagaacctgttttccgtccattggttgaaaaatatgctgccgatgaggatgccttctttgctgactacaccgaagctcacctgaagctctctgagctaggatttgctgatgcataagctgatggttgcggaatagaatgaagccaacaacatttgcctccacaaaatgaatgtattgggttttgtcgtctcttagtagtttataggcagttgttgcttgatgaatatgggtatttgcagttttattttgttgaacatgttgaattgagtttgtgggagatttcgatggactaactaaaaagctctttcgtaataaataatatacaatttattccatataaaatcaaaaaaaaaaaaatcataattaagtttaactcaatataataaatactggcttgctcttaatg

SEQ ID NO: 3725 - DNA, 458 bp, Gossypium hirsutum
  Clone ID: uC-gsronu33B129h11b1
ttcattcgtccggaagtacccgcctagactctggggtactttctatacatgtttctttggtctcattcaggtccttgttattgctgcggttgttgaaagggatgctcacgcttgggtttttcactctggtggtgaactcttcactattctctatgcgggagtggtggcatcggggattgcatttgctgtacaaatatggtgcattgacagaggtggccctgtcttcgttgctgtttatcaacctgttcagactcttgtagttgctattatttcttccttcgctttaggtgaagagttctatttgggagggatcataggggcagtgctgatcataacgggattatatttagtgctatggggtaaaagcgaagaacgaaaattcgcagctcaagaaaaagccgcaattcagtcttcaacggcggagcacggcaacagcagagcatcgagccatatcaaaa

SEQ ID NO: 3726 - DNA, 433 bp, Gossypium hirsutum
  Clone ID: uC-gsronu33B134a01b1
gccggtgttggagaacgtgcgggagagggtaatgactcgtatagggaaatgattgagagtggtgttattaagctaggtgaaaagcaggctgatagcatgtgcgctcttgtttatggtcaaatgaatgagccccctggtgctcgtgctcgtgttggccttactggtctgactgttgctgaacatttccgtgatgcataagggcaggatgtgcttctcttcattgacaacattatccgtgttactaaagcaaactctgaagtgtctgacttgctagggcgtattccatctgctgacggttaccaaccaaccttggctactgatcttggaggtctttaggaacgtgttaccaccaccaagaaaggttctatcacttctgttcaagccatatatgtgcctgctgatgacttgacagatccagctcctgcaacaacct

SEQ ID NO: 3727 - DNA, 488 bp, Gossypium hirsutum
  Clone ID: uC-gsronu33B134a02b1
catcattgccccctttacttctaccatagcaacaagtccaattgagtccggtatcggggttcctcctacccctaatttcagcaccacggtaactcaagaatgcatacgatctgctcagcgatccattcccggcgatctaccaattgcaaggagagcttcactccaccggttccttgagaagagaaaggataggatgaccacgagggcaccatacgagataagtaactccacagcatcttcatccaagccaggcgacgacaagtcatggctcggtttggctgctcaatctccgtagtagtcccagccgagttgaaaattttcaccttttttgaggcttatttattaagcctcctagaccttttttagcaggttttaagcctgtctttggtttttcctcagctgtctattggtttctaggtatcggctcttaaatcctaactctcaatcaatatttcattattagataaatgtaattattattctattga

SEQ ID NO: 3728 - DNA, 477 bp, Gossypium hirsutum
  unsure (1)..(477): unsure at all n locations
  Clone ID: uC-gsronu33B134a04b1
gcttggcaaaagagaaggagctactttactaacaggaggcaaacacattggccaaaagggatattacatacagcctaccatatttgctgatgttaaggatgatatgatcgtagcaaaaaatgaaatttttgggccagtaatgtcattgatgaagttcaaaactatggaagaggggattaagagggcaaacaacacgacttatggtctggcagctggggttataacgaaggacttgaatgtggcaaacactgtttcgagatcggtccgtgctggtatcgtgtggatcaactgttacgctgtgttcgatatggattgcccttatggcgggtacaagatgagcgggtttggtagagattatggtttggatgcacttaaccagtatctacaaatcaagtctgttgtaactcccattcatgattctccatggcatagtacctatngtacgtacacgagtcatgtactattacccaaaaatgc

SEQ ID NO: 3729 - DNA, 303 bp, Gossypium hirsutum
  Clone ID: uC-gsronu33B134a07b1
gttgacgattcatgatggcaaaagggactgcactatttaaccctatccttataaatgccaccaatgtcattatggaatttaactttactgtagttcattactaaggtgtcatttacagactcaattctcttggattgtgaaaaaggttgtatgattccgctccactcggatagaataagtgtatgagattgacattctcatacttcatcattgtactttattattttattacaaatatatttattcagtatttatcttaaaaaaaaaaaaaaaaaaaaaaaaaaaaaaatagaaatcccaacc

SEQ ID NO: 3730 - DNA, 362 bp, Gossypium hirsutum
  Clone ID: uC-gsronu33B134a09b1
tcgtctcacgcgtccgataaaatcacatgcaatgggggttgcttcttcgaacaacgaccacaccaaggtggaattggttgaaccaccaaagtcagtcaaggtcggagagcgagtgaccttttctggtttcacaggctagccggatgatgtgttaaacccaaagaaaaagggttgggagactctacaagtggatctccacagtggtgcatatctgggggcctgttataaagatattactttgaccacatctgctgtgatttgctaagattactccattaccaatgggtcaatgagatgaagatggtgacatcttgccttttatcccactgaagatatatgtagattgtgatatgaattgtaac

SEQ ID NO: 3731 - DNA, 511 bp, Gossypium hirsutum
  Clone ID: uC-gsronu33B134a10b1
ttatcctaccaaaaaaaatgaggacttcattggtggtactatctgccttaatcagctgtgtaatggttgcttcagccgccaactttaaccaagacatcgacgttacttggggagatgggaggggcaagattctcgaaaacggaaaccttctcactctcaccctcgacaaattctccggctctggttttcaatccaagaaccaatatctgtttgggaagattgatatgaacattaagctggtcccaagcaactctgctggcactgttaccacttactatcttcgttcggaagggtcgacatgggatgaaatcgacttcgagttcttggggaacctaagcggagacccatacatagtccacaccaatgtatatacacaaggcaaaggtgacaaagagcaacagttctacctttggttcgatcccaccaaagacttccacacctactgccttctttggaaccctcaacgtattatcttctctgttgatgggactccgctcagagaggtcaagaa

SEQ ID NO: 3732 - DNA, 376 bp, Gossypium hirsutum
  Clone ID: uC-gsronu33B134a11b1
tttgcttcgcgtgcgatcaagagaaaaacccagaggcgataaaatggccaaatcattgctgctcatcgcactatttgcggttccatgtcttggcagcgctacacgcatggtgaagaacccgttggtggttcaaggtcaagtttactgtgaccattgtcgtgctgggtttgaaacaccaaagactagaatcatggctggcgccaaggttaaggtggtatgttccaaccggaagaccggtgatgtcgtgtacgataaggaaggacacacggattcaaccggacaatacaagatcgctgtctccgaggatcatttggatgagatctgcgacactgttctcgttaagagctcgcatccggagtgcgctgaaatgtcaccg

SEQ ID NO: 3733 - DNA, 408 bp, Gossypium hirsutum
  Clone ID: uC-gsronu33B134a12b1
ccagatctctttatcctttatcattattatttgtttttttcctttttctttttcatataaaaactgccattgaatcgaggcccagtggatcctttattctataaatcgccttctttgttttctttgtaagcgagacgaaaaatacaaactcaagaatttgtcggttttttggctcttgttatagagatcaagagtgtcctagtgggtaaatctgagtttgttcgaactgatccatggattctgagcaatattatgctcgggaatggaggacagtcccaggtgcttcaacacccgagactttgaatggtaacttcaactgcaatatctgcttagattttgcacatgagccgattgttacactctgcggtcacctttactgctggccttgcatctataaatggcttcatg

SEQ ID NO: 3734 - DNA, 374 bp, Gossypium hirsutum
  Clone ID: uC-gsronu33B134b01b1
cttctttgaagaacactgatgaagtcgatggaaaggcaaggcctggtgctttgtttgtgaaggttagcatggatggtgctccgtatttgaggaaagtagacttgaaaaactacactaaatatcaggagctgtcttctgcacttgagaagatgttcagctgttttaccataggtcagtatggatctcatggaacctcgggcagggagctgttgagcgaaagcaagctcaaggatctacttcatggatcagaatatgttcttacttacgaggataaagatggtgactggatgcttgtgggtgatgttccatgggagatgttcactgacacctgcaaaaaggtgaggatcatgaaaagctctgatgccattggactc

SEQ ID NO: 3735 - DNA, 459 bp, Gossypium hirsutum
  Clone ID: uC-gsronu33B134b03b1
cccactcgtccgatctcgtcaaatatcggtgaggtggcctccatattcctaacagcagcattgggtatacccgagggcctgattccagttcaacttctctgggttaatcttgttacggatggaccacctgcaacagctttgggattcaatcctccggacaaggatatcatgaagaagcctcctcggagaagtgatgattcactcatcactgcttggattttattccgctatctggttattggactatatgttggagtagcaactgatggcgtcttcatcatttggtatacacacggttacttcttgggcattgatcttagcggggacggccacacccttgtcacatacccccagctcgctaactgggcccagtgctcatgctggaaaaatttcactgtttcacctttcacagccgggaaccaagtcttctcctttgaaaataatccatgcgattacttc

SEQ ID NO: 3736 - DNA, 463 bp, Gossypium hirsutum
  unsure (1)..(463): unsure at all n locations
  Clone ID: uC-gsronu33B134b05b1
cccacgcgtccgcccacgcgtccgcttatctccatcttaaaattatttacaaacaaaagagaacaaattttccagggaatgggaaggatattatgaggttgaactgcagtaattccttataactgtaaattttaacagaaaatgaaatgaaatgttgacagaaacaaacctgttcatgtacatcgtttaaaatctcctctcatcttcaagggggatgagctaatctcattcaagttcagtgtgcattgtacggggttaaccccaaaacactagagggattacaaaaattgttgtgtatgtgccattgccataggctatatgtttagcattcaatactcggcttctcggtttacaaaacttggtgataaccttgatacttaaaatggttaatacattgaggtggactcaaaacttgttcatggcggagacatctcttccatttctggttntaatgagcagagaa

SEQ ID NO: 3737 - DNA, 520 bp, Gossypium hirsutum
  Clone ID: uC-gsronu33B134b06b1
atttttcataattttaatacaaattgatattgccatcttctttgaaattcttaaccaaaattcggttacttatgatgtcacaagtggctgtacaggagaccttgatatgatcatctttttaataacattcttgtagcatgttgctgttctgacccgtgtcttaggcctactcccttgactcttgcttggtcggatgggattttttgcccatcataacccttttccactcaaaacatcaaaggacaataattttttttttatcaactacaagaagcatgacccataaaattgcaaatatgaaagtcgtttctaagctttaactactcattcctctgattggcatgatccaaagattacattctgctgctttctgaaatttaatatattagtccttgatttttttatctcatctgtaatgggtcaatgtcaccgggcacaaatttcaaataaataaaacaaatagattaaaccaaaaaatatataaaaaagttcatttacatagaaagcagcaggcccaatt

SEQ ID NO: 3738 - DNA, 410 bp, Gossypium hirsutum
  unsure (1)..(410): unsure at all n locations
  Clone ID: uC-gsronu33B134b07b1
accgaactcaaatagtttcttcaaggatcacggtgggtcgtgggaaagtccttatggtgacttcttcctttcctggtactcaagcgagcttgtatctcacggcaatcgtctcctctctcttgcctcatccatttttggtgatactgaagtcaatgtttatgggaaagtcccgttgatgcacttgtggtacaaaacccgggcacacccttctgaactgactgccggcttctataacacggcctcaagaaatggctatgaagcagttgcagagatgtttgcaaggaattcatgcaaaatcaacttgcctggaatggacctgtcagatgagcaccagccacacgatgctctttctagccctgaatcattacttgcacaaatccgaacaacgtgcaacatgcactnggttgagg

SEQ ID NO: 3739 - DNA, 452 bp, Gossypium hirsutum
  Clone ID: uC-gsronu33B134b08b1
gttaagtttgctagctttggaactcctgaaggggtctgtggaagctaccgtgaaggaagctgtcatgctcaccactcatatgatgcttttaataggctttgcttaggacagaacttctgcacagtgaccgtagctcctgaaatgtttggaggagacccgtgtcctagtgtcatgaagaagctctcagtggaggtcatttgcagctgatggagctcatcagaaagtacatgaaataaacatggttcttcattgttctttctcaatccaacatgtcattctgcactttttcgggttattttggataaataagcccacaatccccagatcacaacaccaaccatttgttttggcattcccaggtgaagttggacaaatgcacaacacaccccctgggtataataagctcttatataaattgggaaaaatgattggagataagctctatgtatata

SEQ ID NO: 3740 - DNA, 435 bp, Gossypium hirsutum
  Clone ID: uC-gsronu33B134b09b1
ttccttttgcacccgctctgtttctatctggggtctgactagaagccggcgccgacatggttcacgtcagcttctaccgcaattatgggaagacctttaagaagcctaggcgtccatatgaaaaggaacgattggatgcagagttgagacttgtaggagagtatggactccgatgtaagagggagttgtggagagttcagtatgctttgagccgtatccgtaatgctgctagggatcttctcactcttgatgagaagaaccctcggcgtatttttgaaggtgaagcacttcttcgtaggatgaatagggatggacttttggatgagagcccaaacaagcttgattacctcttggctttgactgtccagaactttttgagcgtcgtttgcaaacactagtattcaaaactgggatggccaagtcgattcaccatgc

SEQ ID NO: 3741 - DNA, 423 bp, Gossypium hirsutum
  Clone ID: uC-gsronu33B134b10b1
agggaaagctgctcgcctgctgcaccggccgggacggactggccggaccgacccacgcgtctgtgcgttagtggacgctctcagaagatggccggttccatagcaataccgaccgtagaggaggctggtgggaaggctcataggcagcggcttgctcccagggacggccgttaatgtgacccaaccactggaggggtgaggaaaacacatttataccacacaggaactgtggctcttctaaaaactggacaggaccaaacaaggcctgaccggcctatgaggtaaaagactcaccagagcctaggtctagagagggcccagcattaaatgactgtggggacttatcagagccttgcgggtcctgctctgcaggaagctgcagacgcataccttgagggcctacctgaagacaccaacacgtgt

SEQ ID NO: 3742 - DNA, 258 bp, Gossypium hirsutum
  Clone ID: uC-gsronu33B134b12b1
ataagagaaagacatactgttctaggggggggctttctcattgtccacgtgggttattacacacaggctgccatatgtgctggtgctgaggatgatatgatcgtcgcaaataatgtaacatttgggccagtaatggcagtgatgacccgcaaaactatggtagaggggagtctgagggcagacaacacgacttatggtgtggctgctggcgttattacacacgactcgtatgtggccaacactgttttgagatcggtc

SEQ ID NO: 3743 - DNA, 539 bp, Gossypium hirsutum
  unsure (1)..(539): unsure at all n locations
  Clone ID: uC-gsronu33B134c01b1
ctcactcgtccgaaatagcagtcatcaggttttgtggagttcaaaaacggctctactatttgtagtattgaatgtccaaagaaatgaaaggaggtttgtgttttacccgttgctcgttagagaggatttgaagcagcggtagcgctgcccaggtcctgtcaatggacacatactcttctggggaagaactcgttcttaagactaggaagccttatactattaccaaacaacgtgaaagatggactgaggaggagcataataggttcctagaggctttgaagctctatggacgagcttggcaacgcattgaagaacacataggaacgaagactgctgtgcagatcaggagtcatgctcaaaaattcttttcaaagttggagaaggaggcacttgctaaaggtgtaccaataggtcaagctcttgacatagatatactggngtgatcctcgtgagaagttatgtgaggccattgatactatccctcttagctgcataatngtaggaaatagagggcttggcacgcttaagagggctataat

SEQ ID NO: 3744 - DNA, 373 bp, Gossypium hirsutum
  Clone ID: uC-gsronu33B134c02b1
tccactcgtccgacaaaatggatgaggcaaaaacctactttctgatgttacatatatatatacacacagatagggggctactgttttactatgtctagaaattcacatctaatgctttagggaatgagtaataatttactcttaaagtaggaagttagtatttgcctagataccagaaattgagtttggtgacccatggacgatcaaaataccatataaagaataggctacagcttgagaaatgaacacttgggtatagttgcattattaaatttttggacctgttttaggagtttactttgatgctcttcataattacccctctttgccatccccaacccaagaacaaaagtttctattatgttgttttcgg

SEQ ID NO: 3745 - DNA, 440 bp, Gossypium hirsutum
  unsure (1)..(440): unsure at all n locations
  Clone ID: uC-gsronu33B134c03b1
ggatgtcttgaaaaccatctttttagaaggacaatacctcttccatggtccaatagaattaagattgcacttggggcagcaaaaggtttggcctttctccatggtggtcccgaaccagtcatttatagagattttaaaacatccaacattttactcgattcggagtataatgcaaagttatcggattttggtttagcaaaagctggtcctcaaggagataaaacacatgtttctactagggttgttggaacctatggctatgctgcaccagagtatgttatgacaggacacttgacatctaagagcgatgtctacagctttggtgttgtgttacttgagattttgacaggccgaagatcaatggacaagaaacggcctagtggggagcagaatctggttacttgggctcgaccatatntagctgacaggagaaaacttta

SEQ ID NO: 3746 - DNA, 502 bp, Gossypium hirsutum
  Clone ID: uC-gsronu33B134c05b1
gctggcttggttgcaattgcagagaactgtcagttgctcagtgatctcgatgtctccaagtgcacaataaccgactctggaattgcagctcttgctcgttctaatctgatcaatctgcagatcctatctgtgtctggttgcaatctggtctccgacaaaagcctgccatcacttggaaaattgggtcagaccctcttggggttaaatctacagcagtgcaaggcaatcagcagtggtgcagttgacctgctagtggagcagctatggaggtgtgatatccttttctaaacgatgttgcagtatgggattgtcaacaactcgggttttgacccttcgagaagcttcagaatagcctttgttagtattagcagtttgtgtagtttttgggtccatcatctatgggtcttccattgtccagtactcagtccccttttccagggaatacggacattttccttgtttcttttttgcaggtctctttacatcagagatctgttaccag

SEQ ID NO: 3747 - DNA, 509 bp, Gossypium hirsutum
  Clone ID: uC-gsronu33B134c09b1
ttctttacgcgtccgattcaaaaccctaaaggccgctcccgccgcaagcgccgacgaaaatggcagtctccgagggattggttctccgcggcaccatgcgagcccacaccgatatggtcactgccatcgccactcccattgataactacgacatgatcgtcacttcctcacgtgacaaatccatcatcctttggcacttaaccaaagacgaaaaaacctacggcgtcgcgcgtcgttgtctcaccggccactctcatttcgtccaagacgttgtcctctactcagagtcccagtttgctctctccggttcctgggatggtgagcttcgtctatgggacttaagcgcaggaacttacgctcgtcgtttcgttggccacaccaaagatgtgctatccgttgccttttcattgacaaccgtcagatcgtctgagcttctcgtgatcgaactatcaagctctggaatacccttggagaatgctaatacactatccaagagggcgatgctcata

SEQ ID NO: 3748 - DNA, 515 bp, Gossypium hirsutum
  Clone ID: uC-gsronu33B134c10b1
ccttgtcctcctttacgctaaacctccacgagccgtatacacttccctagatggcacggggtatttgttttcttctgatattttggccaccatggacaagtacagcaacgatgtggcggattgtgtcatcgagaaggccaaaagggtgtgcagagagcaaggtgatcctgaggttaaagtagaggtgataatagagagcggtgatccaagggacgtgatttgccaggttgccgacaagatcaatgctgatgtgcttgttatgggaagccatggctatggcctgattaagagggcattcttggggagtgtaagcaatcactgtgcacaaaacgtgaagtgccctgttttgattgttaagaagcccacatgttcgtcttctgcaagtggaaccaaatgattgaaatttcggattacatagtcatactttgctttgtttatgtacaaatttcactttagtgggtatgtttctggtcttggttttcttttctcatatctttgtctgctcattactttgt

SEQ ID NO: 3749 - DNA, 52 bp, Gossypium hirsutum
  Clone ID: uC-gsronu33B134c12b1
gcgtctcttgttgtccgtggaccctggcgggtctaggggggggtcggacgta

SEQ ID NO: 3750 - DNA, 422 bp, Gossypium hirsutum
  Clone ID: uC-gsronu33B134d04b1
gttcaaggaccacttcttcccttccattttactttgttttagttgccataacgtcaccttccaatacaacccacaatgaggcaacaatatgtcttcactactctcacgttgctcatcctgttttccctcagttgttcaacaacattagcccaatctccggcactggccccggcaccttctggcccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctgcagccttaaatcgggcacattgaattcactcaccgatgaacaaaaagtgcagctggtgcaattccacatcgtcccacataccta

SEQ ID NO: 3751 - DNA, 420 bp, Gossypium hirsutum
  Clone ID: uC-gsronu33B134d05b1
cccactcgtccgggaaaaccagtatggatcggttccgcaagcttgagcgccaagaatctggttgtcttcatggatactgcaactggtgatggcatagaagcttggattaatctagaggaggaagacatggctaaatttggaagtgatgaagaattgcttgcaacattcaaaagcacttttgtttgggaatgatagctactacagctgtcagagttgtaggttgctttccatataatttgattaaggaataaagattatttggtcctacacctgctgtgaaatatctgaatttgacgacataataggtggattatatcaaagagattatacactttcaaattaagctagtctatggagataaggcctcttttgtatgcccaataacctctagttatgtgtgattgatctcgattttgtact

SEQ ID NO: 3752 - DNA, 489 bp, Gossypium hirsutum
  unsure (1)..(489): unsure at all n locations
  Clone ID: uC-gsronu33B134d06b1
ttttcatagaaattaaacctctgcgattagcagcagcattcgaatgtagggaaagaagaaggtgaaagggcttctatactgcaatttgtgatggtggatgcgtggtggtcccttcttggggctgccatcccggctgtaattgcaggacaagcttttagaatgaagaaaaagcatgccgaagaagagagaattaagagtgccaggggaagggagaagagctcggatgatatctttgtttgcgagagagtctgcacatcaaagcgaatgttgaaaaaagttggggcattttcaaaggatccgattcctgatacttgtgtaaccgtttgtggtgtgtctgagctcgatgcttgctccgatgcttgtgctcgtaccgtttgtgttaaccaacatcaggtacccaactggaatgacattggccttcgaggtgtcaagtgaatgtctagactatctgctcccattcttcttagacatnggcttttattacagtga

SEQ ID NO: 3753 - DNA, 142 bp, Gossypium hirsutum
  Clone ID: uC-gsronu33B134d07b1
ttttaaaaaaaaaaaaaaaaaaaaaaaaaaaaaaaatttaaaaaaaaaaaaaaaaaaaaaacaaaaaaaaggggggggccgttttaagggtcccaggctaccttccccgggctggcaagtcataactttttttttggggcac

SEQ ID NO: 3754 - DNA, 517 bp, Gossypium hirsutum
  Clone ID: uC-gsronu33B134d08b1
tctcggacgcgtgggcggacgcgtggggaagggcccaagaagggggtagtccttccccaaaggaccgcaggcatgcgaatggttcggattatagtgcaagtcctaggggaaggagcagaagccccgatgctgaggatggggcttatcggagctctaggaaggaaaatggccacagccgcagacttagtccaccccctaggaatgacaggagccctgtttacaatgatgatgatgataatcatgcgtctgccagacgcagtgaatcaaattaaggcaggcaggcaggcggtggttcaaattcatgttttagggacattgtgtgttttcgcaacaactttgaattcttgcttgatatattgatggatatttaaggtgctgttaaagacttgcaagttatgaagaagaatgactgcttaccaggtttgaaattttttttttacactctcgatattctcgtcaagcaaaatgattcaccccaaataattccattgtgggatacaatggtgggtggagggct

SEQ ID NO: 3755 - DNA, 440 bp, Gossypium hirsutum
  Clone ID: uC-gsronu33B134d09b1
ttcgtttcacgcgtccgcccacgcgtccggttcaaggcttttgatttgggaggccatcagattgctcgaagagtttggaaagattactacgctaaggtggatgcggttgtgtacctagtggatgcttacgacaaggagaggtttgccgagtcaaaaagggagctggatgctcttctctcagatgaagctttggctaatgtcccgttcctcatcttgggcaacaagatcgatataccatatgctgcgtcagaagatgagttgcgttatcaccttgggctcaccaatttcaccacaggcaaggcaaacgcatttaacagacagagcttgcaccctttaagttctgatattggattcacatcatccgtccaagcatgtatctgcttaatggctgtgaaactttcttatgtttgtcaagtttttaagatgattgaactgtctgg

SEQ ID NO: 3756 - DNA, 474 bp, Gossypium hirsutum
  Clone ID: uC-gsronu33B134d10b1
cccacgcgtccgctttcacaaatctaagaccagagctccaaaagattgaatttttaacccctcaaattaaaatccttcctttttcgcgttttcggttgaaaatttgtataaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagaggagtttcgatgccctttatgttcagagtatttcgacatcgttggcttgtgttgtcacattgatgatgagcatccagtggaggctaaaaatggggtttgtccagtctgtgcaatgagggctggcgttgatatggttgcgcatataaccctacatcatggaaatatatttaagatgcagcgcaggaggaaatcacgtacaggtggatctcattcacg

SEQ ID NO: 3757 - DNA, 54 bp, Gossypium hirsutum
  Clone ID: uC-gsronu33B134d11b1
ataaaaaaaaaactaaaaaaagataagggaggggattattaaaaaaaaaagatg

SEQ ID NO: 3758 - DNA, 313 bp, Gossypium hirsutum
  Clone ID: uC-gsronu33B134d12b1
ttttctcttacacccaccctttggaaaaagcagggggagtcttttgaagggaaagatgtttgtgaaagggcttatatactgcaatttgtgatggcggatgcgtggtggtcccttcttggggctgccatcccggctgtaattgcaggacaagcttctagaatgaagaaaaagcatgccgaagaagagagaattaagagtgctcaggggaagggagaagagctcggatgatattctttgttgcgagagagtctgcacattcaaagcgaatgttgaaaaaagttggggcatgttcaaaggatccgattcctgatac

SEQ ID NO: 3759 - DNA, 412 bp, Gossypium hirsutum
  Clone ID: uC-gsronu33B134e01b1
aagtgtcaaaccccacaattgttgtggtaaacattgtgaagaaaaatggaaaaacaaatgatatttgcatgggcaatgatattttgccttgccatggcaccagtgtatggccaatactactccagaactgttaaggcaggtcctcgggtggaaaagattacccacctccacttctacttccacgacattcgcagtggcagtaaccctactgcattcctgatagccagtcccaacatcacccaggacccgccctcatacggcaccttgtttgcaatggatgatcctctaactacagagtttgaactaacatccacgctcgtcggaaatgcccaagggctctacttagcattgagtcgagaccttaccaagttttctgcagtcttttacgctgattttacttttaccactggca

SEQ ID NO: 3760 - DNA, 490 bp, Gossypium hirsutum
  Clone ID: uC-gsronu33B134e02b1
gttattctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcatcgctggtatctctggagggcatatcaacccggctgtgacattcggtttgttcgtgggacgcaaggtgtcactcatccgagccctgatgtacatggtggctcaatgcttgggtgccatatgtgggtgtggattggtcaaggctttccagaagacctactacaacaacta

SEQ ID NO: 3761 - DNA, 426 bp, Gossypium hirsutum
  Clone ID: uC-gsronu33B134e03b1
cctattttcagtatttttttaactatggcttcaaatcccaaggttttcttcgacatgacgatcggaggtcaaccggccggccggatcgtgatggagcttttcgcagacgtcactcctcgtactgccgagaacttccgggcactctgtaccggtgagaaaggcgtcggtcgttccggtaaaccactccactacaaaggctctaagttccaccgcgtgatccctgatttcatgtgccaaggaggtgatttcacagccggaaacggaaccggaggtgaatcgatattcggatctaagttcgccgacgagaacttcatcaagaagcacaccggacccggcatactatccatggcgaacgccggtcccggaacgaatggatctcagttctttatttgtaccgctaagaccgagtggcttgatgggatgcat

SEQ ID NO: 3762 - DNA, 432 bp, Gossypium hirsutum
  Clone ID: uC-gsronu33B134e04b1
acttctttaagttcagctaaataagtctgtattttgtgtactagatccccctgatacaaactttctttcatgcatcatttgatttcgcgagttccatatcacccataaggcacagcaaaacacctgacactgttccttggttcctttttcgaagacccaaggcattgctggaagacatggagactattctcttccccggagccacaacgagggcatctcacatttgtggttaatcgtttgcatcgaagattgactagtgtaggaatatagttccaggatatcctctaggccaaaagtagaatttttgatggtatttgtaagctccataattttctgtagaaatctttgaaatcggtctgtaataaattactaggatccgaattaacttcttgtaatagtttataagcgttccttattgagaattctccggac

SEQ ID NO: 3763 - DNA, 495 bp, Gossypium hirsutum
  unsure (1)..(495): unsure at all n locations
  Clone ID: uC-gsronu33B134e06b1
gcatgtggaagatcttgatacaatcgacaaaatgatagatgcaggtgaagcaacttataataagtggcggcatcccgatccttatatcgttccttgggctcctggtggttccaagtttactcgaaaccctgtcccaccttctgggatcgagatcgtgtatgattatggtcgagaagaaaatgactaagacatccatcttttcaacttccccagaaataaagttgatgcaggtctaaaggatcgttgagtgtgtaacgagtggtctaggacagcaactaatttgcattacctcaattgaaacgagataaggcttttaataacatttatggtgattctccattgtgcttattgctgtgtgcctggtgttttgtataataaaagatcattggtctgattaaggtacaaaatgctcgcttacatggcatggaactacaacgatcttgaatctttcttgtcataaactatatttctcttaatttaaatgcagnttttttt

SEQ ID NO: 3764 - DNA, 349 bp, Gossypium hirsutum
  Clone ID: uC-gsronu33B134e07b1
gtttttcccttttaaatgtggtgttgaatatctagactgatcgtattcctccaatataattgttcgtctggggtttggacatcggtgataattattgcttgataaaaaaaaattaaaaaaaaaaaaaaaaaaacaagaaaaaaaaagacaagaacataaatacaaaaatataactgaatgtaactgtgataaccgagaatggttacaaggaccaaaccgaccctgctaagaacactgttgaccccgattgcagaggcgttggcattcttggtatagcttgggctttcggtggcatgatctttattgttgtttactgcatcgctcgcatctctggaggacatatcaaccc

SEQ ID NO: 3765 - DNA, 441 bp, Gossypium hirsutum
  Clone ID: uC-gsronu33B134e08b1
ttgtttagcttgtttttgatgtgcagttagtattaaaaagtgcaatgcaattttatgggttttcacatgaggtcagatctgaagccaggatagtacatgatctgttttttgacttgttgaagattgtattttcagataacgatttccgcgaagctagaaatgctctttctttctctagcccagtatctacctcgacctctggtccttctgcaagacaggtagcagttatcaagaggcagaagccaataaatgaggtggaatctgatccagacctaactcaaaagacattgcaacgtggattccctcatgctggtgaggaaacaagggttagagtgcacatgccccaaaaggaatcgagacttgggaaaggaagtggtattatcaaggaacatcagcaggatgattctgcttaactcattcagggagctggttatttgcaag

SEQ ID NO: 3766 - DNA, 214 bp, Gossypium hirsutum
  Clone ID: uC-gsronu33B134e10b1
cccacgcgtccggctttgtttgtggtaaaaataatgtataagccatttggttgggagcaaattttccttttgtccaaaggatttttgctgctcattcatggtgacttggtttatggttttatctgttgttgttaaaatcttataaaaatatatatcggctgctgcttttggtttgtctcacataatacaaacaaaaaaaccccccacgggttct

SEQ ID NO: 3767 - DNA, 192 bp, Gossypium hirsutum
  Clone ID: uC-gsronu33B134e12b1
tttgtttacgagcacgcatcattacacataaggagagatgctggcaacacaacttatgataagtggcggaacacccatcactatctaaggggcttgagctcatgtaggatccaagttgactcgtaacgcctgcccaccttctgggatcgagatcgagtttgattgtggcaagataagaaaatgactaataca

SEQ ID NO: 3768 - DNA, 192 bp, Gossypium hirsutum
  Clone ID: uC-gsronu33B134f01b1
tttattaaaaaaaaaaaaaaaaaaaaaaaaaaggggaaaaagatcacaaaaagcagaaaaatgaaactgatagaaaaaaggatattactgatgaaaaggggaaccagtgggctggggcctacgctataaaatcctcttgccgccctcctgccagtaccagtccggctcctgaagccaagtgtagtggggacc

SEQ ID NO: 3769 - DNA, 362 bp, Gossypium hirsutum
  Clone ID: uC-gsronu33B134f03b1
tctttctagaactgtcgttttgaagagaaaatctagaaagtccaccaaaccttgcgacggatacaacaatggccaaagttgatggcatcagcaagcctccaattgcagattttgtgacacccttgtgctctctcatccttgttgggatgttctatttcctattttcagtgtcttgtataattgcttggttccaaatgttggatttttttagcactcgatgcttagtacatgacatatagctgtagtataccactgaatattttagccatcattctgtgtgtttctagtattcgtacagacaccaatacgcaccatgttcacctaaccaaattacaagtcaccaaaccccattgttattggaa

SEQ ID NO: 3770 - DNA, 405 bp, Gossypium hirsutum
  Clone ID: uC-gsronu33B134f04b1
tggaattaccttcattatatcaagaaataccaaaggtatgagaagaggcattcgaacatacctgcacatatttctccatgcttccgtgtaaaggaaggggatcatgtcattattgggcaatgcaggccattgtcaaaaaccgtgaggttcaatgttttgaaagtgattcccgctggatcttccggtggtgggaagaaagctttcactggaatgtaagctgcgagtgttattctgtatttttgtctggggtcgtaggagcctacgtttcactgttagatttcttttgttattgtttttctttccatttacttcttatgtttggatgctgacatctggaattttgaagatatcacttgaatatgcttgaatttttgcattactagtataatcccattttcagatgat

SEQ ID NO: 3771 - DNA, 492 bp, Gossypium hirsutum
  Clone ID: uC-gsronu33B134f05b1
cccactcgtccgcggacgcgtgggcaactccaaggatgaccctgctaaggaggctgccaacttcacttctcaggtcatcattatgaaccaccctggacaaattggaaatggatatgccccagtccttgactgccacacgtcacacattgctgttaagtttgctgagcttttgaccaagattgacaggcgatctggtaaggagcttgagaaggaacccaagttcttgaagaacggtgatgctggtatgattaagatgattcctaccaagcccatggttgtggagaccttctctgagtacccacccctgggtcgttttgctgtgagggacatgcgtcagaccgtggctgttggtgctatcaagagtgtcgagaagaaggacccaaccggtgccaaggtcaccaagtctgctgctaaaaagaagtgcagaggccaaaaggctttagcggtgaagcagattgagtgttcttatctttggttatatgtggtttgaag

SEQ ID NO: 3772 - DNA, 384 bp, Gossypium hirsutum
  Clone ID: uC-gsronu33B134f07b1
tcgcttttatcctctctctcacaaaaagaggttttttttatcgatcaacaaaaaaaattgtttatttgcagggcgccacgatctgcatttctctcgaccgtagcgaataattcaattccccggcgtcgtaatctcctcctccatttgcaaatcaatcgatttctttgatctttgagtgtaatccatggagggttaagaggcattgtttttgaggtggaattttagctgctgacgtggttttttttggatttggaaaattcggaaacaatgtctacgagaggtgagcatcaaacggtaccgctgtcggttttattgaaacgagaattagctagcgaaaagattgaagacccggggattgtacacgggctagcaagtcacagcaag

SEQ ID NO: 3773 - DNA, 403 bp, Gossypium hirsutum
  Clone ID: uC-gsronu33B134f08b1
tttatttaaccaaatcttctttgctttgctattttggttcgttttgctaagaactggctaacgcacagcaaaaaaccgtggaggaaaccaacaagaaccaagcggtggttcttgccctctatgaagccttaaacacacgagacgtcaacaccgttcaccaaatccttgctcccgacctagagtggtggttccacggtccacccactcaccagtttttgatgcgcttactcaccggcgcttcatccgacgatcctttccgttttgaggtcgaccctgtctcagtcaccacctttggatccaccgtcatcgttgaaggctgtgataacagccgttcgatctcctgggttcacgcttggactgttcgtgatgggataatcacccaagtgggggagtatttaacaac

SEQ ID NO: 3774 - DNA, 342 bp, Gossypium hirsutum
  Clone ID: uC-gsronu33B134f10b1
ttttcgacattgatgtcctggttcacggagagcctgagagaaacgatatggttgagtctttcggtgagcagttgtctggttctgctttcactgggaacgggtgggtccaatgttacggatctcgctgtgttaagccaccaatcatctatggtgatgttagccgttccaagccaatgtctgttttctggtcatcaactgctcaaagcatgactcaacgcccaatgaagggaatgcttactggccctgttaccattctcaactggtcactggttagaaatgatcagtccagattcgagactcgctaccaaattgtcttgccatcaaagatgaagtggaggatct

SEQ ID NO: 3775 - DNA, 422 bp, Gossypium hirsutum
  Clone ID: uC-gsronu33B134f11b1
tcgactctgctctgtttctcctctgttggtagttgttactggtttcttacactacttgtaagataaccactattatctaccaaaacagcaaaatagagaggaagttgtcacaaaaatttccggttgttacactattagttacttcaaattcggtggctttctctactattttatcagtgttcttggggcattacgggcagattaagaaagggtatttgtttcatggtcatggaaaggctgaactcaaatctgtaccttcagaactgttacataatgaaagagaatgagaggctcaagacgaagcacaagctctcaaccaggagaatcaagccctttatctgagctgaaacagaaactctcaaaggccaacaacaactcacagggaaaaaattcagcaaacactattgctgacctcaatctca

SEQ ID NO: 3776 - DNA, 86 bp, Gossypium hirsutum
  Clone ID: uC-gsronu33B134g01b1
gtttgattaatgttgaaccatcctttttgcttttgggatgttgttatttttgaaattaatacagcatgtatatctattcctctcgc

SEQ ID NO: 3777 - DNA, 394 bp, Gossypium hirsutum
  Clone ID: uC-gsronu33B134g02b1
gttcatagtcgtttcgtgcgccccatacgaccttaatagatcaatacattatgcacagtcatctcgtgctacccgtgcgatcctatcagaacttcctccgtatcaatgtccaaccccatgcaatatgttgcgtatggcatgctcaatcatcacacgtgtatgcaaaaatggccatgctcaataacaatcatttaaacatatattaaaagcatatcagtcgtacaatcaccgtcaagtcaattaaaacacagtcatacgatcacagtcaattgatcaaattcatagtctaagtcggtcatttacccacaagggcaaaacaatcattttaccctacaagggtatttcggtaattttacactacaagggtatgtctgtaattttacaaattggggct

SEQ ID NO: 3778 - DNA, 370 bp, Gossypium hirsutum
  Clone ID: uC-gsronu33B134g03b1
cttattcgtccggaagggtgcttggtggctagcactaataggggctgtaaggctattcatttgtctggtggagctacaagtgttctattgaaagatggtatgacaagagctccatgtgtaaggttcggtactgcgaaaagggcagctgatttgaagttgtatttggaggaccctgataatttcgagaccttgtctgttgttttcaacagatcaagtagatttggcaggctccagggtatcaaatgtgcaattgctggaaagaatctgtatattagattcacttgcagtacaggtgatgctatggggatgaacatggttttcaagggagtgcaaaacgttttggaattgctttaaactgatttccctgaca

SEQ ID NO: 3779 - DNA, 292 bp, Gossypium hirsutum
  Clone ID: uC-gsronu33B134g04b1
gttaaacataagtcttacgccgaatatctgcttcaacagctatttcgtgcgaagaatatacatttaagggagggggaaacttttaagggagtagtagaaaatcatttggtttttgaagagcccttaaaagagcaaattgatgggctctatcaaatctgttgtgatctcattctaaatggggccaacagtagctactttctaaaaattgtggaattttatggatccacgcttggtatgtagccaagcccaagaaaaaaggaacgaggggaagaatcgacaaggaatccataac

SEQ ID NO: 3780 - DNA, 366 bp, Gossypium hirsutum
  Clone ID: uC-gsronu33B134g08b1
tttcttgtccggtagggtgctcgatggctagctgcgataggaacagataggctattcatatgtcaagcgctgctacaagtcatttattgtaagagggcatgacaagagcaaccatccttcagtcaggttctcttggtctgcttttacccatggctgtaacgacgaaatgtagaacttctccttccaggcaatcttctctatccctctgttaactgtcagtggccagagaatgagcaagagtattcgctgatctaggcacatgcttaaaatagatcctttgaaagccttctttcatctgttgaattgttggactgatagctcatacttctgattagaggtggtgatctgctttacattgatttatta

SEQ ID NO: 3781 - DNA, 474 bp, Gossypium hirsutum
  Clone ID: uC-gsronu33B134g10b1
cccacgcgtccgcgtattagcgctgaaaagggtggggaattttttatcgacaccgatagattaatgcggcaagcaccaactcctataccaagtccacaaagcagtggagacttttcagcactaagtccgatctctggtggctttgtaatgagctgcagagtccaaggggaaggtaagaacagcaagccattagtgcaactggccatgcgacacgtgacatgcatagaagatgctgccatcttcatggcccttgcggcagccgttgacttaagcatcgaggcatgcaagcctttccgaagaaagtttaggagaggctcccgaggctctcgccattctttatgaaaaaaaagaacaaagaattaaggtgatttgtttccatgaacaaagtatagctctatatttgctttcatttctgtataatttggcattgtgtataggatattttggtttaggttttatcaaaatattgtttat

SEQ ID NO: 3782 - DNA, 418 bp, Gossypium hirsutum
  Clone ID: uC-gsronu33B134g11b1
tttgtttgatcatgaggaaaagcaaaaaggtaaagtaaaagagaagcttgacaagtacaataaagagaagttattggagttttgtgacgtgcttgacataccagttataaaggctactacaaggaaggaagatatgattataaagctgatggactgtttgatggctcctcatgctacaaccactgttctacttgctgaacaagaaaagtcaagtaagggtaaaaagcgcaaaagggctacgatgtctgggaccacagataaacgatcaacaaagagtccaagaaagagtgaggatattccaaaatctacgacaaagagtgtgcctgattcagaggatgagtctgaacaagaagaacaggaggtagaagaagattaggaagatgatgaggaggatgaggaacataatgaaaaataaaaa

SEQ ID NO: 3783 - DNA, 429 bp, Gossypium hirsutum
  Clone ID: uC-gsronu33B134h02b1
ccttttcgtccgcccacgcgtccggaagaccctcgggacaggcctattgacgtacgttacaactcttctcttcgctgcatcattgtaattatttccacctatggctttaagccttcatattgaacgctttgatttatggccttttgttatgtgttatatccctctgaatcatatttctgcaactgcaacctttttcatcttggaacaaggactcttaaaggcttacattctgtataccgtggagtactgccattgaagacgtagtatgggccaaaaacagagatgtaccggaatttcatatgcctgtatcttaagttccatgaaaataattgtgctcgatttatgctgctaggcacttttggttaatataaacagtttataacccggagaacacaagtgaatattacaatgaattatcgaggaaaatta

SEQ ID NO: 3784 - DNA, 203 bp, Gossypium hirsutum
  Clone ID: uC-gsronu33B134h04b1
tcgtttattcgtccgtaaaaaaaaaacaaatacaaaggggggtgtttttaaaaacaacgggggttccaaaaatggaattgggtgaaccaccggcggcacccatagtgggagagcgtgttacctttcctgggttcacactctatgccggatgatatgtgcaacccaaagaaaatggttggggagactctacaaatggatctgca

SEQ ID NO: 3785 - DNA, 481 bp, Gossypium hirsutum
  Clone ID: uC-gsronu33B134h05b1
ctctgttgagatctttggtggatacctgtacttccacaaggcaccagataaggatgaattccaccgggagacatgccgcatgatcaaggcccttcaccaatatgattgcctgagagctaacaaagcaacatcagcatggggattagaggcacgagtccccttcttagacaaagaatttatcaatgttgccatgtctatagaccctgaagcgaagatgatcaaaaaagatgaaggacgcatcgagaagtgggttctaagaagggccttcgatgatgaagagcatccctatctgccaaagcatatcctctacagacaaaaagaacagttcagtgatggtgttggttatagttggatcgatggtctcaaggcccatgctgcccgacatgtgaccgataagatgatgttcaatgcttctttcatatttcctcacaacacaccaactacataagaggcatattactacaggatgatttttgagagg

SEQ ID NO: 3786 - DNA, 280 bp, Gossypium hirsutum
  Clone ID: uC-gsronu33B134h07b1
tctttactcgtccgaccactcgtgcgcccacgcgggccgggtgaaccagtgtcggggaatccggcagcgcccatggggtaaatgggctgctgagatccgtgacccaaggaaaggggttagggtctggttaggaactttcaatactgctgaagaagctgcgagagcttatgatgctgaggcacggagaattcctggcaagaaagctatggtgaactttcctaacgagacttcgtggacctctgctaagcatgcagtcaagacatagtctgagaaaccactt

SEQ ID NO: 3787 - DNA, 301 bp, Gossypium hirsutum
  Clone ID: uC-gsronu33B134h12b1
cgcgtggggttttcagatgcgcgtaaagggaatgatcaaagccgaaatgaaggagtggcaggacaagaaacataaaaaggtttcttaggttacattgttgtaagttgtatgtttggtaaggagtaaatttaggtttaaatataatgtactgttgtggtataagtgttgtaaggcaacattgcatggattttaattatccatgaaagcatcgctatgaattgaacaatgttttggtgtctggagtaggaccagagatgtagtatataattataatgcatttatgtaggtgattttaaatatg

SEQ ID NO: 3788 - DNA, 531 bp, Gossypium hirsutum
  Clone ID: uC-gsronu33B136a02b1
cttatttttccgattgatttggggccgtcaaaaagcgagtccttgtctgagaactcagaagtttggttggaagaattctttagccaagtatataaaaagatacatttcaagtcattcgatttcgatggacttgccaataaaattgtaaaggaaatcagctcacaatttcaaaggacagttggaagtgaagttctgttggagattaatgaagaagtgatggtacaaatacttgctgctgtctggttttcggacaaaaagggagctctagaagattgggttgcaaatgtgctgggaagaagctttgctgaggctgagcaaaaatacaacctcaatcctcaatcagttgtgaaactagttgcatgtgaaggtagtgtggtgaaagaacaagcttccggaatatgtctttctgcaaaaatagggctgagctgatttttttttcctttttgaggatgtaataaatgctattgtagctttcagttatggaaagtcttgtttgtaggctttcttttgggtattattttgtgttgataa

SEQ ID NO: 3789 - DNA, 509 bp, Gossypium hirsutum
  Clone ID: uC-gsronu33B136a04b1
tttcttttgcacccgctctgtttctatctcggctctgacgagaagccggcgccgacatggttcacgtcagcttctaccgcaattatgggaagacctttaagaagcctaggcgtccatatgaaaaggaacgattggatgcagagttgagacttgtaggagagtatggactccgatgtaagagggagttgtggagagttcagtatgctttgagccgtatccgtaatgctgctagggatcttctcactcttgatgagaagaaccctcggcgtatttttgaaggtgaagcacttcttcgtaggatgaataggtatggacttttggatgagagccaaaacaagcttgattacgtcttggctctgactgtcgagaactttcttgagcgtcgtttgcaaacactagtattcaagactgggatggccaagtcgattcaccatgctcgtgtgttgattaggcacaggcacattagggttggtaggcaagtggtcaacatcccatctttcatggtgagg

SEQ ID NO: 3790 - DNA, 126 bp, Gossypium hirsutum
  Clone ID: uC-gsronu33B136a06b1
gatattttcattttttttttgtttttaatgtagggagtgttttttaagtataagaatatataattatttttaattggtactaaaaaaaaaaaaaaaaaaaaaaaaaaaataagaaaaataaagggt

SEQ ID NO: 3791 - DNA, 403 bp, Gossypium hirsutum
  Clone ID: uC-gsronu33B136a07b1
ttttcattgaattttctgatgcttctttccctagttgtttttgctctaatggcttacgccatggctgccgaggctccagctccaagtcctacgtcgggatccggctcattctctccttcattcgtctctgttttcgccgtcgtggctctgctcttcggctccggtctccggttctgaaggtgatacaccttgttatggcttctacggttgctgtagagagactcctggatttatatatacatatattcggctttgaatttcaataataatagtagatctaagggatgattctatatataatatgagagagaagtaattatgtgcatcaaagattatttgattgttgatgtttggacttcaattattttgttagcattatgagtggtattttcactttttatat

SEQ ID NO: 3792 - DNA, 518 bp, Gossypium hirsutum
  Clone ID: uC-gsronu33B136a09b1
tttgttacgcgtccgcccacgcgtccgatagctgtagagctaaccagcccttccaatataaccacctaaagagacccatcaagcaaaaaaacaagggaggaatatagcagcaatggcgacgccaaagcagcagcagatgttggaacaacagcaatcaccgatgcagcgagtgaagaactcggaggctggggtgatgatggttacttcaagatcaaaaggggtgtagacgagtgcggtatcgaatccgatgtcgtagccggattgccttccaccaaaaaccttgttcgagaggttacagatacaggaattgtcgaagatgcttcattctaagagaagatcatctagacaggcttacctaatatcatagtttatcaatgaaggaactgttatcgttgtttccatttcaagtttcaaatgttacgcttcgcattgcaagaacttcagcctgtatataattcatatgttctgctacgaagtatggataatgcaatgcaaccattctgacaaattaccacttc

SEQ ID NO: 3793 - DNA, 405 bp, Gossypium hirsutum
  unsure (1)..(405): unsure at all n locations
  Clone ID: uC-gsronu33B136a10b1
tctctttcccacttgctttgaatgacattattaactgcccaggatgatttaaattcatccatacttcaattattgtaggacaatattggaaaatttaattgttgtcttcctcagagttacgacatcggggacaatgaatttccacaaccacttttttatgcttgagattagttaaaatagagatataattccaggagattcttcatattgtaattttaactttcgaaggaagatgtaaattccatattttcctgtaaaaatctttaatctcggtctgtataaaattattactaggacccgaattagcctcctgtaatagtttataggcacttctaactgagaaattgcctgacggttctcctctccacacttgnagtcatcgtatgttgtctccttcaaaagatc

SEQ ID NO: 3794 - DNA, 193 bp, Gossypium hirsutum
  Clone ID: uC-gsronu33B136a11b1
ccggaacgcccgggccggcccgccccacccgttcgcttcccccccgcacggacccaaagccggggggggttaaataaggataagccgggggaacccacccccaagcggcgcggacaaaaaaaaaacccgcgccacacgcaagaaaaaaaaccccgccgagggcacaaggaaaaaaaaacatccacccccgccg

SEQ ID NO: 3795 - DNA, 535 bp, Gossypium hirsutum
  Clone ID: uC-gsronu33B136b02b1
gttttccttttttttaaagaaagtttttatttgttggattctttttgacattaatttaagagtcaaaataaatttacagagttgtaaatacagctcactcaacaagacaactacttcacattttgttacatggactctctcattgttctaaaatacctgtgtccagccattgtgacctttgaaaaaaattgagcatacccacaattatatccgacatttacttcgagtccaagtgatctagaaaatattcaaagaacaggggggaaaaccgaacaaaatttccagcatataatcaagagaataaaagttgaaaaaacaaattctaaccacaaacaaaacaaaaagagcaagtttgttgggttcggtgtttgttggtattacaagtatttgatgagtaggtatatgatgacagccagaatcacgatcccgatcacagctaaaagcatgcacatacaggaacagatgaaggagctaatatatcgggaagcgcttgcattcagcccggatatgtgcaaccgtgatgatttacatgcca

SEQ ID NO: 3796 - DNA, 103 bp, Gossypium hirsutum
  Clone ID: uC-gsronu33B136b04b1
ctttcgttttcgggcgggattacccgctgagtttaagcatatgaacaacaacaaggtggagaaacacatggaattaagttattaaacttgtctgtttgaagag

SEQ ID NO: 3797 - DNA, 501 bp, Gossypium hirsutum
  Clone ID: uC-gsronu33B136b05b1
gttaatcaaagagtaactgaagaagatgcaaatattcgtcaaaaccctaacagggaaaactatcactctcgaggttgaaagcagtgataccatagacaatgtcaaggccaagattcaggataaagagggcatccctcctgatcagcagaggttgatttttgctggtaagcaactagaagatggccgaaccctagctgattataacatccaaaaggagtccactcttcacctagttttaaggcttagaggaggaaccatgatcaaggtgaagactctcaccgggaaagaaattgaaattgacattgaacctactgataccattgatcgtatcaaggaacgggttgaagagaaagaaggaattcctccagttcagcaaaggcttatatatgccgggaagcaacttgcagatgacaagacagcgcgggactacaatattgagggtggctctgtgctgcatcttgtgcttgcactgaggggtggctgtctctagatggtgccatg

SEQ ID NO: 3798 - DNA, 348 bp, Gossypium hirsutum
  Clone ID: uC-gsronu33B136b06b1
ctttcgtttccgcgattatgtcgaggagttaattgggtgtgcattcgtggtgacgacaaatcctagtgcagttggagggtgcagttgtaaaagttcattcatggtgaaacagtagatgtttcaagcgcattgctcatactaaatcaattttttttttgtcataacatttatttagatgcaaaataatatgcacactttggtctcgtagttctatggtgtttggattcgggatgaatatcataatgtaacgaatggctgctgattatctggtaacgaggaatttcctctcaatgagattggttactctttttacaaaaaaaaaaaacaaaaaattctccttgttattcc

SEQ ID NO: 3799 - DNA, 503 bp, Gossypium hirsutum
  unsure (1)..(503): unsure at all n locations
  Clone ID: uC-gsronu33B136b07b1
agtgaatatgatacggagagatttcagcttctaaaccatctccgtttcccttggccagtaaatcatacatcagtcagccctgaccgaaggcttattactgttgttggagatagcttggatgggttgcttgtggatttgcaaaacggaaagactgtagcaacggtggtaggtcatctagattactcctttgcatctgcatggcacccagacgggcgcatatttgccactggaaatcaggataagacatgccgtgtgtgggacgttcgaaacctttcaaggccagttgcgactctcaaaggaaacttgggtgccatacgatcaatccgcttttcatccgatggtcaattcatggtggctgctgaacctgcagatttcgttcacgtgtatagtacgcgtgctgattacgagaaaagacaagagattgacttctttggggagatttcnggagtatctctgagtccagacgatgaatctttgtatataggaatatgggacagaacgta

SEQ ID NO: 3800 - DNA, 379 bp, Gossypium hirsutum
  Clone ID: uC-gsronu33B136b10b1
tctcttacgcgtccgctgatcgataccctcccattaatggggctttgtattagtttttttactgacaggcattgtccgttgatggacgaacaacctttttcgagaaatttagtaaattattttaatcggccttggtggggtttattgcatgtttagctctttcacaactgtgtaattattcaatgtcatttactcggagattacaaccacaatattaaattatgattgcaattttgcgatttcataaatgggaaataataatgaagttaaaactatttatgtaaaaaatataacaatttggatttgaaacttgagaatgatgtgcaaataaaaaaaaaactgggttaataataaaaaggggtggcctcttttaagaatc

SEQ ID NO: 3801 - DNA, 315 bp, Gossypium hirsutum
  Clone ID: uC-gsronu33B136b12b1
tcttttctcagaggaagaatttttgagagatgtaatgcagtttctgatttttcgaggacatactcggcttgttcctcaaggtgggttagctgagtttcctgatgccattctaaatgcgaagcgtcttgacctttttaacttgtatagagaggtggtgtcaagaggaggctttaatgtcgggaatggcataaattggaaaggacaagtattttcgaagatgcgcaatcacacattgacgaatagaatgactggagtgggcaacactctgaaaagacattacgagacttaccttttagagtatgaattggctcacga

SEQ ID NO: 3802 - DNA, 387 bp, Gossypium hirsutum
  Clone ID: uC-gsronu33B136c01b1
cttccttaccaccagctgctgctgccccaactgagaacgaccaccatgagggagagacaaaagagaagaagggatttttggagaaaatcaaggagaaaattcctggttaccactccaaaacagaggacgagaaggaaaaagagaccactgctccccattaatgaatcaatataatgcatttcaagtaaaagatgtctatgagattgtgtggtttattaatttgttggaactgtttgttctctgtatttctttttggggttgcatacatcatataaatttctgcgtctgttttcatgattgtaagtaaaaagtaaaagggtatgtatatttaatgtttttaatgttattataataattaagaaatgatggtactatttcctttttatc

SEQ ID NO: 3803 - DNA, 381 bp, Gossypium hirsutum
  Clone ID: uC-gsronu33B136c03b1
tttgtttgtttattccattatttatgttagatgcaaatctttttgggttagtggttagtcatggcaagtctagcgggagatgtggctgaaattgtctggactgtaaggcaacatcttttcactgttcaatatatcctcctttgacagcggtctatgctctatatttgcggtattaaaagatctttttgagcatatgcttcctgccttgatggatcatcagtagtgcttagccttgatttaatggataagaaaaatttgcagattgtatagcctacgcagaaggctgcttgtctaacttgtcgggttgtatttgccgtaatttgtaactactgaatgataaatgctcttcgtgataactgtcatggtttattacctattata

SEQ ID NO: 3804 - DNA, 477 bp, Gossypium hirsutum
  unsure (1)..(477): unsure at all n locations
  Clone ID: uC-gsronu33B136c04b1
cttacgtttccgctcatgtccttcatctctgccgttccagaatctcaacgttctggtatatatccgcgctcaactttccttttctctgtcatatatttctgagttttggtttgattttttttgtatgaaactttcgatcagctttgttccaatcactgttgttcgaagcttgtggtagaacagtgaatccagtgaacggagctgtcggacttttatggacagggaactggcatgtttgccaagcggcagttgaaactgtcttacgagaaggaactgtacgggcggtgcctgaacttatggctccctcaccagcatccggtgaaaaatcggaagctactaagattgcgtgcatgttgaagttgcaagaaacagaaacaaaatttaattcaacctgtcggttttccacttcaagatctaaagtttcacctaagcgcataaaangtgaagaattcagtaaatttcagccgtccgatctag

SEQ ID NO: 3805 - DNA, 503 bp, Gossypium hirsutum
  Clone ID: uC-gsronu33B136c06b1
cttacgtttccggagactgcctatagcgcatcttattacccgtgcatggatatactgtatgagtgctatgaagatgtagccagcggaagtgaaatccgcagtgttgtattggctgggcaacggttttatgagaaggatggtctccctgcttttccaatgggaaaaattgatcagacacgcatgtggaaagttggtgagcgagtccaaaaggcacgcccatctggtgatttagggccattgtatccttttactgccggtgtctatgtggccttgatgatggctcagatcgagatattgaggaagaaaggacactcgtactctgagatcattaacgagagtgtgatagaggcagtggattccttaaatccatttatgcatgctcgtggagtttccttcatggttgataactgctctaccacagcacgattgggatccaagaaatgggccccacggtttgattacattctaacccaacaggctttggtggctgtcgacaagggcac

SEQ ID NO: 3806 - DNA, 121 bp, Gossypium hirsutum
  Clone ID: uC-gsronu33B136c07b1
ttgtttaatcttctatctgatttatattgaaattgatttcctatgtagcatttgttctttttgttaattttctgtaattataatcgattccccgttaatagaacgccatttcataattttt

SEQ ID NO: 3807 - DNA, 492 bp, Gossypium hirsutum
  Clone ID: uC-gsronu33B136c12b1
tcggtttcttccaatattcttctctctgacaacctggaacctctgatatccgatttcgggataagaaacattgggtgtagaaaagaaaaggataagaaggatgaaagcgacgctgaaattgatgtttattgtttcggtgttgttttgttggagcttttaacggggagcaagggacggaggagaatgtgaggcgggtgaggaggttagtgaaggaaaggaaaggagttgaggcgcttgactccaggttgagattcgccggtgaatcggaggctgaaatggtggagagcctccgagttggatacttgtgtacggcggagtcagctgagaaaaggcccacgatgcagcaagttctgggattactcaaagacatacatccgacagtagacgatttcaaccgatttcattggtaaaactataaagtaaaacgcacgctcatacagtttcggcggtgttattcacgcgctgaaaaatatttgataatgaaatcggaca

SEQ ID NO: 3808 - DNA, 537 bp, Gossypium hirsutum
  Clone ID: uC-gsronu33B136d05b1
gttaccttgaaaccgaaactgaaacctttgcattgggataaagttcgagcgagttcggatcgggctatggtgtgggatcaaataaaagcaagctcatttcagttgaatgaggaaatgatcgagacgttgtttacggcgaataatttgaattcggctactaaagaaagcggtcgtaggcagagtttgccgtctgttaatcaagaaaatcgtgttctcgatccgaagaagtctcaaaacattgcgattctattgagggcattgaatgttaccattgaagaagtctgtgaagctctcatggaaggtaattcagacactcttgggactgagctcctagaaagcttattaaagatgtctccaacaaacgaagaaaagcgtaagctgaaagatttcactgatgagtccccattcaagctaggtccggctgacaaattactcaggctgtgctcgacataccttttgccttcagagggtcgatgcgatgctttacattgctaaattcgactctgaaatcgagtacctgaaaaggtcttttgaaac

SEQ ID NO: 3809 - DNA, 390 bp, Gossypium hirsutum
  Clone ID: uC-gsronu33B136d06b1
gttcttttacgatctccggcgggttaatcctaccatcgtcgtgtttgttgataacgaggtatggatggagtccggtacgccatcgttccggaagaatttcgttaacggactggaattctacgctatgatgtttgagtctttggatgcggcggtcgtggggaacggggaatgggtgaggaaagtagagacgttgcttctccggccaaggatattagcggcagtggaaacggcggcgaggagcacggctcccccgtggagggagaggttccgtggggcggggatgagggctgtgcatttgagccagttggcggagttccaagcggagtgcttactggggaaagttcagggcatgggatttcacgtggcgaaacgacaaactgagttggtgct

SEQ ID NO: 3810 - DNA, 553 bp, Gossypium hirsutum
  Clone ID: uC-gsronu33B136d07b1
tttgttaagcactacagggtttgatcatggtcacgagttctcatcgttcgatgatgctgatccatttgggtcaacggggccatttaggacatcactggagagtcagacaccaaggagagatgccaataaatggagtgcgttttagatataaaagtatataatataatataaattggattaaatggactaatggggttgtggttatcatgttaagccttgtaggtgaagaagattttggtcatttgtgtggcggctttgattcttttattagtataaatagcgactggtaatggagtggttgtggcagtgtctttattgttttttttcttttctgcaactttataccgttgttcgttttgtcttttctttgaactggttgtttttagttgtagaagcttcaatcatccttgttcatggacaggtctggactcacgaaatgttgttgtttcaaataagtggaataatcattggacgtgatatcgaacgtaaaatttgtataaactcatttctcatgcacttccgttttttgttatgggttctggcttcctttttt

SEQ ID NO: 3811 - DNA, 480 bp, Gossypium hirsutum
  unsure (1)..(480): unsure at all n locations
  Clone ID: uC-gsronu33B136d08b1
ttgattttccccagatacaaacagaacatgtctgttttgaacagatcatatagttattcaaaggtgaataaagaagacccagatgagataatccatagacgagctcagttcttgatttacaaagtgctagaacaagctgattctagaagaaaaccatcgttctttcgaatcaaattatgtaggctgaagctgaagattggtagaaaattgaagaaattgaagaaaactgcgatggtcagtatttctggtttaagagttgatgtttacagacaggtttttaatcagttgaaaacttggagacgattgtttaaccgtggtggtaatgatcatggaaccattgctgccgccattcatcgtcctttgctcacttaaaacattatatgtatgtatatacatgcatatacttatatatgtatatgcatatataagatntttatgatttgttttggttaaaaataggagagttctgctaaaagaaaa

SEQ ID NO: 3812 - DNA, 503 bp, Gossypium hirsutum
  unsure (1)..(503): unsure at all n locations
  Clone ID: uC-gsronu33B136d11b1
tcgtttacgcgtccggttataatacacttccatcttccaaccaaattaatctttcttaacatatacattcatgcggatgagttgcaacggttgtcgagtccttcgcaaaggctgtactgaaagctgcactataagaccttgtctccaatggattcctagcgctcaatcccaagccaatgccacccttttccttgctaaattctacggccgtgctggtcttattaatcttatttgtgctggccctcagaatctccgtcctggagtttttaaatcattgctatacgaagcatgcggtcggatagtggacccagttcatggttcggtcgggttgatgtgctccgggaactggcatctgtgtgaagcagccgtcgacgcggttttaaacggtgcgccgattaacaagttccttctgaattgtcggctaccaagtgcccgccgcttaaatcctcctttgacattcgacacgtttcaaaagacangaaatccaatgatgggcttcgcaa

SEQ ID NO: 3813 - DNA, 416 bp, Gossypium hirsutum
  Clone ID: uC-gsronu33B136d12b1
atcgcttacgcgtccgtccacgcgtccgcccacgcgtgcgttgatgcacgtctaagatacccaccgtacacaaatggaaagctcagggtactaaagtctctagttggtggcagcatattatggattatccgtgctttgatgggatggtccaaggcttaaaagagaaaacctatgtggctatctctgatgtcactttatattatttttttcacgttatgcaatttactgatttcaatatattctcaagcatgtaagtctgtttaaagaccacggatgtatagttttcttttttcgcttaaaatcaatgtgatgttcataatgtaggtatcatgatttgagaattattctatacgaatgaattggcactgatgcagctcaacattgtaaaaatgtgttgatttgatgattaaaccttg

SEQ ID NO: 3814 - DNA, 507 bp, Gossypium hirsutum
  unsure (1)..(507): unsure at all n locations
  Clone ID: uC-gsronu33B136e01b1
tttactcttccggtgtctttttcggttcggagaagaaaggtgggtaaaagatgcttgcttatgacctgcaaacggaaacacgcaaagatatcgggtcaccaacagcatgacgcctatgtgaacatgtgtacaaagtgagactaatctgcagcttctggtgaagagcatgtcttatttttcaccttcttcttgacatttatttaaggaggctcacccttaggtattgtgggttggcaaaagaaaaaaaaatgaggatgaaattctagccttattgggaaagagatttggagttctatgtaagatatcacttccatatagtatctaaattttttgctccattttattttggggcctgaggaaaaagaatatacatagagatattgttaatcatttttaggcaaccatttttgaggagggttgaatactgnctgatgacacttttctctttatgcattaatgcctcgatgttctcttcacaatcttggaatggaaaatgatcattctttt

SEQ ID NO: 3815 - DNA, 415 bp, Gossypium hirsutum
  Clone ID: uC-gsronu33B136e04b1
cttacgtttccgccggcatgcataatgataagcagaggtccacaattccagcttatcaagcaacagtaatttggagactgcaagagcaaaagattgaaatcccatcctttacttgtgcagacgttgatgaaagggttgcatgaaatccatggtttaaattctgcagctatgccagtaaagatggaaatatacctaaatgagcatctggaacttaaggagcaacgactgtgatcgaactttttatcgatctagttagttttaagtctcatgatgctttcgtttcttacttctgcaaatgtgaatactgaaaaacagtagtcttacatgtagtaatgccttgaaagatgctgttttgtgcaagattcaatgcacattccatcatgttttcatattttttaaagaatgtttgatttgc

SEQ ID NO: 3816 - DNA, 497 bp, Gossypium hirsutum
  Clone ID: uC-gsronu33B136e05b1
tttacgttttcgcaaccagcctagctcaacttctgaattgaatgtagatagatcagttgaattgccaccacaggatgaaactggtaacatgggggtttcaaaggtgatcagagctgaccagaagagattcttctttgatcttgggagcaacaacagaggacatttcttgaggatatctgaagttgcaggttctgatcggtcttccatcattctcccactgtcaggattaaagcagttccacgaaatagtgggtcattttgtggagataacaaaggatcgcattgaaggaatgatgggtgcaaatcttcgaacggtggatccgccacaaaggtgaatggcaggcagtggaagatggtaaaaataattgtcaagtttggtttaaagcctctaattgtagagatgcaattgtggtgtcattcaaggtttggaataatccgatttttgtctgtttgataacagagaaatattggagataagttgtgaagggaaataatgga

SEQ ID NO: 3817 - DNA, 488 bp, Gossypium hirsutum
  Clone ID: uC-gsronu33B136e06b1
tttgcgtctcactctcagactcagctgagttaaaatcgctaaagcgatatggctttgcagctatgggaaacgttgaaggaggcgacaacggcgtatacgggtctatctccggccactttttttacggttctagctctgttatgggctgtttactatgtagcaaagggtctatttgggtcatccgatgatcatatccatcaacggtctacggctttcgaggagcagatggagccgctaccgccaccggttcagctcggcgagattaccgaggaggaacttaagcagtatgatgggtcggattcaaagaaatcactccttatggccatcaagggccagatctatgatgtttctcaaagcagaatgttttatggacctggtggaccttacgcgttgcttgctggaaaagatgcgagcagagctcttgcaaagatgtctctcgaagaaaagatctgacaggtgacatttcaggtcttggtccattcgaattg

SEQ ID NO: 3818 - DNA, 79 bp, Gossypium hirsutum
  Clone ID: uC-gsronu33B136e07b1
tctcttacgcgtccgcccacgcgtccgtgcaatcattgttactgtataaatcatgtttatcaattttttacttttaatc

SEQ ID NO: 3819 - DNA, 515 bp, Gossypium hirsutum
  Clone ID: uC-gsronu33B136e08b1
ataggtgaggatgctgcagctgcaaattcaggcccctttcttcaggaagagatcatgtctttgaaaggtttggaagtcattgctggagctgagcagccagagtcacttcaatctgcccctgagcctgcttctgccagtgcagtgccatcccctgctgtgcacgagagcaagcctaccgagaaaaaaacctgccaagccaaagtggttcaaaatgtgagcttcggcacatgatctcaacattaatagatttcgagaagcggttaacttgattgtcagatcaaatgataaagtttgttcaatggcagtgactaacaggtgactctatgtgaaggatattaacacttctacaaagtttgatgtgaatattttgctctgttgaacttctttttttacagtttgataattgcttccttttgcttcgatatttcaagcccgtggaactctgagtaaaaatttcatgctgaaaccaatgtccggatatctgggctttagccaaagttcaccatcatttagag

SEQ ID NO: 3820 - DNA, 73 bp, Gossypium hirsutum
  Clone ID: uC-gsronu33B136e10b1
tcgtctacgcgtacgcccacgcgtacagccaccgggcgaatttaaaagaacaggggtttcaaaccacaggagg

SEQ ID NO: 3821 - DNA, 488 bp, Gossypium hirsutum
  Clone ID: uC-gsronu33B136e11b1
tcttttcgcgtccgcccacgcgtccgcaagatggcttcaaaaagaacagcatcgcttgccctcttctttgccctcaacgttctcttcttttctctagtcagtgcttgcggttcttgcccttcccccaacccaaaaccaaagcctactccttccccatccccctcaggcaaatgcccccaagatacccttaagttaggtgtctgtgctgaggtgcttggtttagtcaatgtaactgttggttcgcccccagtgcaaccatgctgctcccttctccaaggccttgctgatcttgaagctgttgtttgcctttgcacagcactcaaagctaacgttttgggcatcaaccttaatatcccagtttccctcagcttgcttcttaacgtctgctcaaagaaagttccatctggcttccaatgtccctaattattgtgtccaattctttgtcttcttggtgttttgcgtggctttgaggtctaagtagttttatg

SEQ ID NO: 3822 - DNA, 467 bp, Gossypium hirsutum
  unsure (1)..(467): unsure at all n locations
  Clone ID: uC-gsronu33B136f01b1
gtttttatctacatttcgccccagaaattatagtaaaacagagacaatgaaaggagcattgatgttgagttggattctgatcatctgcctctcccaagtagcagttcggagccaatactactcagatacccgaccatatcatcccaagccacctaaggtcaccaatcttcacttctttatgcacgaacatacgggtgttacagcagtcgtgctaacccaagctaacatcacaagcaataattcatcagtgacatttgccaccctagttgctgttaatgatcctctcaggactggtcctgagcctgactcagaggtgattggaaatgttcagggtatttccctcttagcnggatcaaatgcatcgagcccgcagtacatagaatttggatttataccggtaagtttacggcagctctttaagcgtattttcaaggggagaaccaggctttgcgtggtcggaggaagag

SEQ ID NO: 3823 - DNA, 395 bp, Gossypium hirsutum
  Clone ID: uC-gsronu33B136f02b1
cttatttgtccagacaagtcatatcttgagtttgtcgggaaaactagaactcgacaggatggaatggcggctctagctgcaggtgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgcgatccatgcaactgttgaaaagcttgatgaaagccctagattatgaaaaaagaaagcagcaaaataacaggcctctgtaatgatttattctcaaggatgaatgcctgcaaggtctatgactataattatgcctctgtc

SEQ ID NO: 3824 - DNA, 562 bp, Gossypium hirsutum
  unsure (1)..(562): unsure at all n locations
  Clone ID: uC-gsronu33B136f03b1
cttactcgtccgaaataattattgcatccgtcctttcccttcaaacaaaacacccccccctacatatatgcatatcccaaagttgttctcttaatcggaattatcatgggacgatcaccctgttgtgaaaaggcacataccaataaaggtgcctggaccaaagaggaagaccaacgcctcattgactacatccgtctccacggtgaaggttgctggcgttccctccccaaagctgctggactgcttaggtgtggtaagagttgcaggttaagatggataaactacttgaggcctgatcttaagagaggaaatttcagtgaagctgaggatgaacttatcatcaaactccacagtttacttggaaacaaatggtctttaatagctgcgagattaccgggaagaactgacaacgagatcaagaactactggaacacgcacatcaaaaggaagcttataagcagaggaatcgatccacatactcatggtccactcaatcaacccaccaacaccaataaatccactgaatnggatntcaggaacgtacccaaagcttcaaaatcca

SEQ ID NO: 3825 - DNA, 583 bp, Gossypium hirsutum
  Clone ID: uC-gsronu33B136f04b1
gttattttttacattgacgactatgatgaactcttcatcgtctatcgattgaaggaattgttaaaatacaaagggtttcaagttgcccctgccgagctcgaagcaatgctcattgctcaccctgaaatcatcgatgctgctgtcgtcgcaatgaaggatgaagcagctggggaagtacctgttgcatttgtggtgagatcagataaatctcagatcaatgaagatgaaatcaagcaatatatttcgaaacaggtggtgttctataagagaataagccgtgtgttcttcattgaaaccattccaaaggcaccatcagggaagatcttgagaaaagaattgagagctaaactggctactggaaactattgattattatatttgctctctgaaatcttccccaacttttccatgaaaaaacttgttgaaataatatacaaagagtgtatgggttaaaaataggaacctgttatatatgctccttaaaatctggatatatatatatacacaaagtgagtttgggaagattgtaaagttatgagatgaaaagattaaattgctgaagaggatgtatgattatatcctt

SEQ ID NO: 3826 - DNA, 174 bp, Gossypium hirsutum
  Clone ID: uC-gsronu33B136f07b1
ttttttaaatgaaagattaaggagtctatttttacataaaataaacaaagcaagaaaaagagttatacattttaagatatttgaattttagtgagaatggggtgaataaaagagttggaattatctgtgatcatctccttgttatatattaaagttgaaaattgtctttttgtt

SEQ ID NO: 3827 - DNA, 395 bp, Gossypium hirsutum
  Clone ID: uC-gsronu33B136f08b1
ttttgttatcgcgctgggtgtgaattattgtagaagcgtgcgggtgtacttacttaagataccggctaagcaagaaccagtgttaaagctgataataacgaacgcacggtgaatggtattattgaagctcagctgccatatatctcctaaacaaagcatttatcaactagtgcaaaagctagtcatactgataaagtatctatgaaaccaccggacccagataccaagtatttaagccaggtactatcagttgccgaaatgttagaatggcctgatttcaatgaccaagcatggctatttagcagcaatgaatatcaatcaaagaaaaaacccaaggtgggatttcctgagattgatgagaccccacgtgtatgggcagaggctttccaaattga

SEQ ID NO: 3828 - DNA, 461 bp, Gossypium hirsutum
  Clone ID: uC-gsronu33B136f09b1
tttcttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggctctatctgttgttgttaaaatcttataaaaatatatatcggttgctgctcttggtttgtatc

SEQ ID NO: 3829 - DNA, 526 bp, Gossypium hirsutum
  unsure (1)..(526): unsure at all n locations
  Clone ID: uC-gsronu33B136f10b1
tcggtttcttcatttgttaagttctccttgtgctcagagataaattgattcttgtctttttgaattttgcaatttgagaaatgcactgcaaggtattgattttatttctccctctgatgatgaaatctgtgcaaaatggttaggaataaaagtggttcaacaggggaaaacccttgtgattttgctcttgcttactacttcgtatcactcatttccacatttcaccttgtgtatattttagcatttatctttcctgtcttctaatctgcgccacctttcctatccttcacccactccacacgacacacatataacccccttctctctctgttcaattgcagtgcggatggttcatcttttatcgtttactctctctttgtttccgtttgaagagatttttaagctgtttatcttttctcttgataataagctctaacggcaggaaaaaacaaaaggaagggatcttttgaagtggaaaaaaaagagaataagatcagattaacatctttgntgnttttttttttta

SEQ ID NO: 3830 - DNA, 213 bp, Gossypium hirsutum
  Clone ID: uC-gsronu33B136f11b1
ttggttctactctcgcccaagcacgcttaactgcggagttctgatgggatccggtgcattagtgctggtatgatcgcacccgtcaattcttgcgcattctatttatataaaggctacccctgatcgcgcttgagcctcgaatttgaatttaaatacgaccaaataacgtttcgagtgatttattctgtaaataactaattagttttatgactg

SEQ ID NO: 3831 - DNA, 565 bp, Gossypium hirsutum
  unsure (1)..(565): unsure at all n locations
  Clone ID: uC-gsronu33B136f12b1
tcgtttcgtgaaaagctgaatgaaacctttggaaatatgattgccagaagacgtagtggagaggaatattttgatgattttctgcagaccatggtcaatagagattcgtatccagaagatgaaaagcttgatgatcaagagatcatagataacctaataacactgatacttgcagggcaaaccaccactgcatctgctatgatgtggtgtgtcaagttcctatctgaaaataaagatgcactcgacaagcttagggaagaacaattgccaatagtcagaaataaggctgaaggagcctcactcacccttgaagatcttactgaaaagtcatatggcttcaaggttgtaaaagaaacactgcgaatggcaaatgtcttgatttggctttcccgcgttgcgatggacgactgcatacttgatgggtttgaggtaaagaaagggtggcttgtaaatgttgatgcaacctgtatacactacgaccttaatgtgtacaaggaccctacacngnttaacccttcaagattcgacgatttccagaagccctacagtttcctccttttggagc

SEQ ID NO: 3832 - DNA, 271 bp, Gossypium hirsutum
  Clone ID: uC-gsronu33B136g01b1
gttattttcgccgccgtgattcaaaactcagcccactgtctccgatcgtgtcaactcgtaacccaatctctcaaatatggatcgacccagattcgtaatcgacgccgtcgaagccgagcaaatggccaaacaatcaggcaagacggtgctccaactccttccttctttggtcaaatcagcccagtccgttgcccgcccgccgatctcgaagtaccaagttggggcagtcgggatcgggtcatccggtcggatctttttcggagccaattta

SEQ ID NO: 3833 - DNA, 472 bp, Gossypium hirsutum
  unsure (1)..(472): unsure at all n locations
  Clone ID: uC-gsronu33B136g02b1
atcattacctgtgaaattctgttctcatttttctttcaagaactaagcgaaaatggcagcagaggaaggccaagtctatggctgccacactattgaatcatggaacgaacagcttcaaaaaggcaacgaatccgaaaaattggtggtggttgatttcactgcttcatggtgtggaccctgccgtttcattgcaccttttcttggctgaactagccaagaagttcccttctgttacctttcttaaggtggatgtggatgagttgaaggaagttgccactgccaaaatcattgaaatgcagtcggcgagtcagtggagagcccagctagaggcctccaagcaaagtaccaagttgctggtgatagatttctcggcgacctggtgcggaccctgcaaatggatggaaaccgtgattgatgatatgnccactatatgatgatgttgagttcatcaagatcgatgttgataccttga

SEQ ID NO: 3834 - DNA, 302 bp, Gossypium hirsutum
  Clone ID: uC-gsronu33B136g03b1
tttacttttccgtgcagattgtggacagctttgttaagaacaagaacaagaacaagaaatggaataatgttgactctggtctatgaatggtgattcatgtctgaaatttatcatttttatgtgtttttctttgctgtttactggatttggcttagattgttctctaagaacatgacagccataaataatgtacgctatttatcatcatatttgaccatataattgagttattacaaaaaaaaaaaaaaaaagaaaataaaaaaaaatactaaaataaagaaaatataatatatatatatatg

SEQ ID NO: 3835 - DNA, 527 bp, Gossypium hirsutum
  unsure (1)..(527): unsure at all n locations
  Clone ID: uC-gsronu33B136g06b1
cttactcttacgcccacgcgtccgcccacgcgtccggtttcagagattttgctcgagtgaggcatattatctggacgttcttgtccttaacaacataacatttaatatgacatatatgtgtgatataacagttctataacttcatttgtagctaaaaattttatttgtccttggatgcagtgtctatctgttgtccccttggaaattttcagatggataattgcagctgtagctgggttcatgtcagcaacttttgtggcacttaatctcaaagctcacattacttcagctggagaaagatgggtcttaatcgttgctggcatctttctattgcagctgggtcttgctgttgtgctcaaactctatttgttcaccgtttcggtataagagtaaaccgatcttccataaagctaaatcggcttagttgtagatcacagagaaagtgaatttttgtccttgggccgtctaattggcgaaaatattattcatgacaagtaaaaacatcatctattcattcaaaanaaaaa

SEQ ID NO: 3836 - DNA, 205 bp, Gossypium hirsutum
  Clone ID: uC-gsronu33B136g07b1
tcttacgcgtccgatttttttttctcttacctatcaaccttttttgcttgtaatttatcttcatggcggccatggtttctgcttatctcttcgtttttctagctctctttggcatggttgcatctgactctgatcatctccaggatctctgtgtagctaacaaagctgcaggaataaaggtgaatggatttccttgcaaggagga

SEQ ID NO: 3837 - DNA, 317 bp, Gossypium hirsutum
  Clone ID: uC-gsronu33B136g08b1
ttgcttctaagtaatgtgtcatttttgttgaaactagggggttatttttttggtattactcctgactcatctaccatatggcatgaaaaagtaattggcaaataccgctgtttctggatttatgtaatttcctttttctttcttctggttactgcttcacctgtttttgggaggtgattgtgtaaaaattttagtgtgctttagttattgtaagaatatttttaacatttttaactttaacattattgtaagaatattttgaattatacttcagttagcaatttatatcatatatttttcattgaatttgaaggatc

SEQ ID NO: 3838 - DNA, 433 bp, Gossypium hirsutum
  unsure (1)..(433): unsure at all n locations
  Clone ID: uC-gsronu33B136g09b1
tttgttcatttatacatagaaatgagagaaatggttcatattcaaggtggtcaatgcggtaaccaaatcggtgccaagttctgggaagtcatctctgatgaacacggtattgatcctaccggtacctatcacggagactctgatcttcaactcgaaagaatcaatgtttacttcaacgaagccactggtggaagatacgtccccagagctatcttgatggatcttgaacccggtacaatggattccgtcagagctggccccttcggtcaactcttcagacctgataacttcgttntcggtcaaactggtgctggtaacaactgggccaagggtcactacactgaangtgctgaacttattgactccgtcctcgatgttgtcagaaaggaagccgatggatgtgactgtcttcaagattccaaattacccactc

SEQ ID NO: 3839 - DNA, 538 bp, Gossypium hirsutum
  unsure (1)..(538): unsure at all n locations
  Clone ID: uC-gsronu33B136g11b1
tctgttaaatccaaaagaaacccaagattataaatggagtatcgatttgagtatttgaatagtttagattacaagaatggcaggggaattagtattgctggatttctggccaagtccatttgggatgagatccaggattgctttggctgagaaagggataccatacgagtacagagaagaagatttgaggaacaagagtgatttgttgctgcagatgaaccctgttcacaagaaaatccctgttcttatccataatggtaaacccgtttgtgagtctgtcattcaggttcagtatattgatgaggtctggcatgataaagctcctttgatcccttctgatccttatcaaagagctgttgccagattctgggttgatttcgttgacaagaagatatatgacctgnggagcaaaatatggaagacaaagggagaagaacatgcaaatgcaaagaaagaatntattgagtgcctgaagctgttggaggagagcttngagacaagacttactttggaggagaaagtcttgatatgtggatgt

SEQ ID NO: 3840 - DNA, 517 bp, Gossypium hirsutum
  Clone ID: uC-gsronu33B136g12b1
ttgtttacgcgtccgatcactggtgagagtaaaaaagctgttgtgaattccccattccttgagaagctgaagaagaaaggttatgaggtgctctatatggttgatgccatcgatgagtatgccattggtcagctaaaggaatttgagggcaaaaagcttgtgtctgcaacaaaggaaggtttgaagcttgatgagagtgaagatgagaagaaaaagaaggaagctttgaaagagaaatttgaaggtctttgcaaggtcatcaaggatgtcttaggtgacaaggtggagaaagttatggtctctgatcgtgtcgttgattccccttgctgtttggtgaccggcgagtatggctggactgccaacatggagagaatcatgaaggcacaagctttgagagataacagcatggctggatacatgtcgagcaagaagacaatggagatcaatcctgagaaccccatcatggaagagctgagaaagagggctgatgctgataagaatgacaagtctgtgaaag

SEQ ID NO: 3841 - DNA, 314 bp, Gossypium hirsutum
  Clone ID: uC-gsronu33B136h01b1
gcggttctttttgaggacccgggggataggcaacagaggtgctttattggattgcctcaccattggcggcttgggccatgcaagcaggtgtctgcgacgcttgagggctatggagcgagagatgcctacaaggctgactatgctaaaagctggggtcaacttatgtgacctaatggtgacccacgctctactgagaccatgcataccctatcaacgcacttggcggagctgtacaagctaataccgttaatgctgactgagtggtacagattacgggaggagtcactgaaaatgaactacacatcgttggtgcg

SEQ ID NO: 3842 - DNA, 514 bp, Gossypium hirsutum
  unsure (1)..(514): unsure at all n locations
  Clone ID: uC-gsronu33B136h04b1
ctgcaccggctccggacttcactctggtcgacccacgcagtccggtctttttcacgaccactcaatctgtaaattatgatggaggatgtcatgcttttatgtatgtggcacttattttcaatgtgccccatcattatccctgcttttctttccttttttatggtctttctttgtttggcttggtgtttctcagctatctttgaaaattctataaaaatcaagcactttgggttgctttaaaatagatactacaagatcaaaaggggtgtaaacgagtgcagaataaaatccgatgtcgtaaccggattgccttccaccaaaaaccttgttcgagaggttacagatacaggaattgtcaaacatgctggaggctcttttaagatcatctagacaggctcacctaatatcatagnttatcaatgtttgaactggcaccgttgtttccatttcaagcctcaaatgttacgcttcgcattgcaagaactccagcctgtatatcattcatatgttctgc

SEQ ID NO: 3843 - DNA, 528 bp, Gossypium hirsutum
  unsure (1)..(528): unsure at all n locations
  Clone ID: uC-gsronu33B136h05b1
tttactttcgggaaaacacncagagccacnccggaaggctcatatctcactgaaactctttccttctttcttttctgagcaaagccttaaggcaatgtgagaatgaatctctcatgagttgatgagtatactctgtgcttgtcaaactacggatcctgcacatcaaaaattaagcttagataaaatgatattaaatgttaaaagactcaggaagtattttgagtagagatttggtagctaagaggcagtgcccgtttatggcccgggaagacctcgttttggcatagcatacttgctatcatctctattattaatcctcttcctgcagctcttttcaactttttgagctgtactccatggaggagggtctttctttaacagctttctaaaggatttgtaaatttagatatttttgaaataaaatctaggataatttcttccttctacttaaaatattaacgtaagcaaacagtttatacattagtcccttatgtttaaaatagtaccgtttaggcacttacattacat

SEQ ID NO: 3844 - DNA, 64 bp, Gossypium hirsutum
  Clone ID: uC-gsronu33B136h06b1
tttactcttccgtccacgcgtccgcccacacgtgcgggcactcatccgaaaaaaaatatataac

SEQ ID NO: 3845 - DNA, 507 bp, Gossypium hirsutum
  Clone ID: uC-gsronu33B136h07b1
ttggttcaagcagctagggttttcgacgattttgctgtcggtttggtttccggtttggacaatgatgtcgggtttaatttgagctcagttgaactacctgctccctggttcatatactcttttatgggaataggaattacgatatgttgtgttgctctcattggttgcatagctgctgaatctattaatggatgctgcctttgtttttatacacttctcaaaattattctcgttctaatagaagctgctttagtagcatttattgcaattgaccgtagctgggagaaggatcttccatttgacccaactggagaaattgatagcttccggtcctttgtcgaagacaacgttgatatatgtaaatgggttggcatcagtgtggtcattattcaagcattagcaatgctagtggcaataattttgcgggcaatggtttctgctagaagaagagacatcgatgatgaagatgaagatgactatgaaagcatagaggtagaacttgggagc

SEQ ID NO: 3846 - DNA, 307 bp, Gossypium hirsutum
  Clone ID: uC-gsronu33B136h08b1
gtgtagagattgtcactactattcccaccatcggtttcaatgttgagaccgttgaatacaagaacatcagcttcactgtttgggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgagggatgctgtgctgctagtatttgcaaacaagcaagatcttccaaatgctatgaatgctgctgagattaccga

SEQ ID NO: 3847 - DNA, 308 bp, Gossypium hirsutum
  Clone ID: uC-gsronu33B136h09b1
tatgaccgagtcgtcgtttgccagaaggtcggagatgcttctgttgtgaagattattgagctcgaagattaaacttatgttagtttctctcctttccgaatctgatttttgaaagcgatgaatgactttatatagcacctgtgaggtattggctccaggttttggtggatttgaaattgtgttaagaatgcatacactattttaagtctcataaaagggaaatatggcccataatcccataattagctaatgggaaaaggcaaaagaacaaccccaatttttccttgattcagtggtaaataaagata

SEQ ID NO: 3848 - DNA, 459 bp, Gossypium hirsutum
  unsure (1)..(459): unsure at all n locations
  Clone ID: uC-gsronu33B136h10b1
ttgcttacgcgtccggactcgtcgagtggtacggcgagaacgctaagatgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatcctaccatggtgatcaagctgctgacatactgntcgatttcttgaanagtgtaagaagatccatctcact

SEQ ID NO: 3849 - DNA, 507 bp, Gossypium hirsutum
  unsure (1)..(507): unsure at all n locations
  Clone ID: uC-gsronu33B136h11b1
atgcgttttctttgccgtccactcgtgcagacacacgtgcggggctcatacgcatacatatatatagcaggatgatgctcggaaaacgctcacgtcagtcgatcaagaggacgacacgcatgacgggcatcaccgtcgatgtcgtcgaccaccaccaagacccaatcatatcccatcctccccctcaaatccaccctttgcatgaatcccccgacgctaactcccgttacgatcaacgcttcttggccatggtgtcgcccagaaacccagcttcttttactagccatgtcatcgacagcggcaccactgccgctgctccttttttgcgagcttgttggctttgtaatcgccgcttagctcctggtcgtgacatatatatgtataggggggatacagcgtttngtagtcaagagtgtagagaaaaacagatgaagcaagatgaaagaaaagaaaagctaaacggctagagttggttgaaccaaattctaacagattatttaaagaaga

SEQ ID NO: 3850 - DNA, 468 bp, Gossypium hirsutum
  Clone ID: uC-gsronu33B137a02b1
cccacgctttcgcccacgcgtccgcccacgcgtccggagcttgattctcgattcctccgaacattcatcttgtttagccaaggtattgaaaaagattagtcctcatgaacatgaacaaatataaaaacagttgtaatatagaaaaacaaaaattcaattggaaggtcactatatttgtaaagaaacataatgtataattagttccagtttgaaataaatgtaggaattggcttgttctgaaaaaaaaaaaaaaaaaaaaaaaaaaaaaaaaaaaaaaaaaaaaaaaaaaaaaaaaaaaaaaaaataacctaaaggggggacgatataaaaggtccaagttttctaacgcgtgcatacaacttaataacttttgtaaagggtaacaaaagtccaattttttggcccccgtttgacaaccaaattattgggaaaaccctgggaacacctaatttaatgggcgtgcaaaac

SEQ ID NO: 3851 - DNA, 505 bp, Gossypium hirsutum
  Clone ID: uC-gsronu33B137a05b1
cctacgcgtccgctctcttctttcctcctagcccaaaaaaaaaaaaccctctttcctttctctcgttctttttcccgttcaatcatgtcttgcttcattagcaaatatgccgatgagttggctaaaaacgctgcttacattggaacccctggaaagggtatccttgctgctgatgaatccactggcaccatcggcaagcgtctttcaagcattaatgtagagaatgttgaagataacaggcgtgctctccgtgagctcctattcacaactccaggagctcttcagtacctcagtggtgttattctctttgaggaaaccctttatcaaaaaaccgcttcgggcaagcccttcgttgatgttttgaaggaagggtggtgtcctccctggcatcaaggtcgacaagggtaccgttgagcttaacggaaccaatggcgaaactttcacccagggtctagatggccttgcacagcgatgccagaagtactatgaagctggtgcccgcttt

SEQ ID NO: 3852 - DNA, 485 bp, Gossypium hirsutum
  Clone ID: uC-gsronu33B137a08b1
tcggtttaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgacttcctttctcatgtattttgatctgaatatgtatgtttagatcaatatgcagtcaaggggagggagctttgtattttcttgcatgtttgtctttttaattctgtatgaattcaatgtatcctatgcttttatttgtgttctaatgaatataagtaagtatgatt

SEQ ID NO: 3853 - DNA, 456 bp, Gossypium hirsutum
  Clone ID: uC-gsronu33B137b03b1
ctcacgcgtccgggccgcccttttttttttttttgtttttttttttttttttgggacaagtttaacaactgtgtaataaagcaaaagggtgaaggaacattgctatgaataactgcctttaacactgttaagtttcccctgagattccattctaccaggtcggaagctgatcttaaagttttggtgtcgcacacagcattaaaaaggatcctgactttggaaccattttcaccacaacgcattacagaaaagaagactttgacagctgttacttcttttgaaaacccagatgtcatagggcaatctcgaaagacgtggaggcttccttcaacttcagatctgcattggggacatctgtcatttgtaacaactttcctgattctgaaattagcaaagtttggaataaaatcccaagagatccaccagattgtaaatgcaatttttgatgggatctat

SEQ ID NO: 3854 - DNA, 498 bp, Gossypium hirsutum
  unsure (1)..(498): unsure at all n locations
  Clone ID: uC-gsronu33B137b04b1
ctttcgcgtccgcccacgcgtccgcctgattggggtgatgacaaaaagccaagtcccgagaaaattgagctggacaattcaactcagttggataagcctgaagatgttaatgaaccccaggtgcaaggactaggctttgatgctttggataagggtttcgagaaggaagaaccgaaacagaaaggcaggaaaaaccgaaaaaagaccaacaggaagatgcaagaatggtggaaagatgatcatttgggtgaggtaggcaaaaaggatagtaagctgaagcagctcaagacgaagtggaagaaagggtttaaaatgccacattttgatctagggagacggttttatttttgcaggagcaagaagttcggggaaccgaatcaagatgactgtgatgcgaatggagaattcagttttagaaggggatggaggagaaagaacaacaattcgatcggaagtgacatgtggagcggngatcttttcagtcgtgagctaagcagc

SEQ ID NO: 3855 - DNA, 498 bp, Gossypium hirsutum
  unsure (1)..(498): unsure at all n locations
  Clone ID: uC-gsronu33B137b05b1
cttacgcgtccgctcgacgggctaggagccatggagttggccatgggggcttgggcagactgggtagcatcgaaagtcattccccagaagaaacgtgtcttttttgttacaatgtcaccaacacatttctggtgagagtctatacccctaacctcaattgttctatgtttctctcagttggataatttcacctggtgaaagcttgccaacttatctagttgccataaatcataatatagaggtatattagacagagatgacgaatagatgagactaataaatgcaccatggagttactaaaaggagtgatctgaaaatattagcatgctgtatatactttctggggcttgggatcctagctgatgatctggaaatgttgaagcattgaggacctggttacaaactgaatgagctgcagatttcatttttgatattctatttagactttacatgcatggaaatcattgntggccatgaatccattgaacaatcttagtg

SEQ ID NO: 3856 - DNA, 484 bp, Gossypium hirsutum
  Clone ID: uC-gsronu33B137b07b1
tcgctcatagccgccgtagcttctgctatattgtacgttctttaccgccctcaccgtcctactttcactgtttcctccctcaaaatctcggcacttaacgtaacctcagcttccaagctgatcaccaacatcaacctaaacgtcacagccaaaaacccaaacaagaaagtcgtctacagttacaacccaatcaccgtatcgcttgtcacagacgacgacatcgctattggagaaggttccttcggttccttcgtgcacggaactaaaaacacgaccctcttgaaagctgccataactagtagcaaccaagaactcgatgacgcgtcagctgccaaattgaagaaagctttgaagagcaagaaggggctgccattaaagataaagctcgatactaaagtggaagcaaaaatgggagcattgaagacaccaaaggttgggatagggttgtttgtgaagggattaaagctactgccccgaggcaaaa

SEQ ID NO: 3857 - DNA, 297 bp, Gossypium hirsutum
  unsure (1)..(297): unsure at all n locations
  Clone ID: uC-gsronu33B137b08b1
tcggctgggatgaccattggattttctgggtgggtccattcattggagcagcactagcagcactctaccacgttgttgttatcagggccattcctttcaagtcaaaatgatcaaaatcgacggtccaaatgatcatatgatctcaaaaaaatgaaaaatttcacccatgcaccctttcagtttgtgtatttcccatttgatccttttgtttttgtatatgtaagaatgtgtgtaatatatattatttacttcaaanaaaaaaaaaaaaaaaaaaaaaaatttaaaacccaaattaag

SEQ ID NO: 3858 - DNA, 478 bp, Gossypium hirsutum
  Clone ID: uC-gsronu33B137b09b1
tcgattaaatgggaattttatgcaaggtagttgatatgctgctgttggtggcgtttatggtgatgcttgtagccggacctttaatcgatgcgcagctggttttgccggagaccactttcccggaggtgctcgtccgtttgaagcagcaatatgcggcggagtaccaagattatttgatggtggagaagcctcatttcttcgtggccttggtctggttggagcttattttccagtggcctctggttttgcttaacatttatgggattttggcatccaagcattggttccataccacttgtctcatctatggtgcctctgttattactgccatgaccgctttattaggggagctgatgggatcccagaaggcatcagataaattgttgacagtgtactctcctttcatgggactcggtgttttagccttcctgcgagggctggttccaaactcaggcaaggctcggaccattggcaaaag

SEQ ID NO: 3859 - DNA, 493 bp, Gossypium hirsutum
  Clone ID: uC-gsronu33B137b11b1
cttctcttctttcaactcaaagaaaactcccaagtaatattagaatcatgggtgttgtcacttataactatgagtctacctctccagtcgcccctgccaggcttttcaaagctttttctcttgaagctgacaaggtttggcccaaggctgctcctcaggcagtcaagagcgttgaggttgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgaaatcaaggctcaaatcaagggagtgaagggagttacaaggctgttgaagct

SEQ ID NO: 3860 - DNA, 242 bp, Gossypium hirsutum
  Clone ID: uC-gsronu33B137c01b1
ttttcttggtctaaccgaggaagatgctaagaactctccctttgctcagaagcacaagaggtgatccaactgatttcaaaagcctatatggttgcagtcccttggtatgagaggctcagttgttttcctttttccttttcccaatgaacaatgaaaataacagaagacatcagttctgagtacactttattttgtgaattatgattttgtcatcaattaatgattttgctttgaataaggtt

SEQ ID NO: 3861 - DNA, 483 bp, Gossypium hirsutum
  Clone ID: uC-gsronu33B137c02b1
ttttcttctgctcgcctgtcagcacaagttggaggaagaaaactcccaattgattgaagcagctgagaagcggaaactagcatgggaacgcctggaaaccactgccgctgctttcaaacctgcagctactaacaatgtccctcctgtaaaaccagccacaccgcctgtcgcctgttgattggcaaaagatagatatatgcatatagtatatatatataaatagcctgctctgattgcagtgttggatgttggtttcttgaatacgatggccgaagttgtgattcaatagggtctgtatgtcattaccaaaaataggagggggtttgtattttgtatctaaaagctgaaattgctgtactgaaaattactagtggtactacattacagttgcctggaaaggtcgagaggcattgatgaatgatgagttgttgggttgcaagttaaaaaaaaaaaaaaaaccctaaaaaaaaaaataaaaagggc

SEQ ID NO: 3862 - DNA, 487 bp, Gossypium hirsutum
  unsure (1)..(487): unsure at all n locations
  Clone ID: uC-gsronu33B137c04b1
ggtaaagccagtgactggggcatctgacaatcttcgggaatggtggaaggataaagtcaggtttgatcgtaatggtcctgctgctattgcaaagtaccaggcagataattcgattcctggcaagaatgatggctgtaactcgatcggcccaactccacacaccttgcaagaacttcaagatacaactcttggttctcttttgtctgcactgatgcaacactgtgatcctcctcaaaggcgattccctttagagaaaggcgttcccccaccatggtggcctactggaaatgaagaatggtggccacaactaggattgcccgaagatcaaggccctcctccctataagaaacctcatgacttgaagaaggcttggaaagtgggggttctcacagctgtgatcaagcatatatctcctgatattgccaagattcgcaagcttgaaggcagtccaagtgcttacaggacaaaatgacagcanaggagagtt

SEQ ID NO: 3863 - DNA, 432 bp, Gossypium hirsutum
  Clone ID: uC-gsronu33B137c05b1
gaagaatatgttccaatttcatgaaaccgttaaaattccacagaatttcattaatgatttgcagagactgcaaatacaacaaaatgaacagaaagtacagatttctaattctaggaatcaatcaactaaaaactaacagacctaagctctctctcctctaatcctcctagcaagttggatatctttaggcataatggtaaccctcttagcatgaatagcacacagattagtatcctcgaacagtccgacaaggtaagcttcagcagcctcttgaagagcggcaacggcactgctttggaatctcaaatcagtcttaaaatcttgagcgatttctctcacaagcctctggaatggaagctttcggatcaagagctcggtgctcttctggtacttcctgatttccctaagagccacagttcctggtctgaaacg

SEQ ID NO: 3864 - DNA, 483 bp, Gossypium hirsutum
  Clone ID: uC-gsronu33B137c07b1
tcgctgacgcgtgggttcaccgtagtccccgttttagtcactgcatatatctgccactacaatgtccacagcatagataacgaactggaagattcaacccagataagaccggttgtgcgaacagctctggctttatgctcaactgtttacataatgacaagctttttcggatttcttctatttggtgacgccacaatggatgatgtgcttgccaactttgataccaaccttggcatcccctatagttccctgcttaatgatgctgtccgtgtcagctatgctgctcacctcatgctcgtatttcccattgtcttctatccactgcgactcaacatggatggcctcctcttcccttattcaaggcctctagctcagtctaatacaaggtttgcttgtattactgccggactcgtagcagttatcttcttgggtgcgaatttcatacccagcatctgggatgctttccagttcactggagcaact

SEQ ID NO: 3865 - DNA, 473 bp, Gossypium hirsutum
  Clone ID: uC-gsronu33B137c08b1
tcggtttagatacctgaaattgtggcagtagaaccagtgactgatgaagaaactggccttgagatgaatgaagagaacattgagaaggtacttgaagagattaggccctatctggttggtgcagcgggtggatctcttgaattagttgccattgaggagccgatcgtgaaagttagaatcacaggtcctgcagcgggggtcatgactgttagagtagccgtaacgcaaaaattgcgagagaaaattccggccattgcagccgttcaacttttatgattccaatgcaatgttttaagatttaacaaaatagttaccaaatatagcatttattgttgttaggcttgtatgaatagtgaaaatcctgctgtatagttcatagtttccatacttttctctctttggatgccattgccagtcctaagtatattgttttttcttttctaaattcaattcaacaatggcgttccgatttt

SEQ ID NO: 3866 - DNA, 414 bp, Gossypium hirsutum
  unsure (1)..(414): unsure at all n locations
  Clone ID: uC-gsronu33B137c09b1
tcttttttttgagtaatttctttttcttgcagaaatttgtatatttgctccgtttgttttaagaaatggcagagctttgcttctctaaaggcattatgatcatgtttgttgccgttgtgctctcactcaccaccactgcatcagctcaggacagtgcaatggcgcctgcgccgtcaatggataccggagctgctttctcgccggcggtttccggaattgcggttatgttctctctgattgtttcccttgttgcgcttttgaagcactgaattgagtacatttgagtgattgagtattgtatcatattgagtttattattaattaattactaaataattactgttattggtnaaaaaaagtaatttttaaatatttttaaaacataaaaaaaatttttaaattttattaactttg

SEQ ID NO: 3867 - DNA, 476 bp, Gossypium hirsutum
  Clone ID: uC-gsronu33B137c10b1
gacttggaaaatatggatggtcttcacatgatatttaaaatagtcaaggggataagttagtacactttttcgcttaaatgctctttttctttattaagacgtgcttgaatttatgactgattcatggatccatgatttatgttattggttatcttacagttttgctcaatagtgctcaaatttttgagaaaatatttggagacgaattgagcatggatattattggttctcttgaatgtaagtatatcactatttatttacagatatattatcagggactgttggtggattgaattgaatgttcaatttgcaacttcatttgattgtttggatgcgggcttatagttataagattttgtacaattattttttatgataataaccttttaataacatttttttcgttttatcactctttgcacgtgtagttgctctataaaatagaataagagaaatgttatgtaaacatgccatag

SEQ ID NO: 3868 - DNA, 368 bp, Gossypium hirsutum
  Clone ID: uC-gsronu33B137c11b1
tttttttcctggagttgcaatgtggcagttcatgccgcctgcagcagtggatacttcacaggaccatgtcctccgccctccggttgcctaagttggcaaccaacaatgattggggttgcattttgatgcaatcaagggtataagttaatgttctgggctgtttagatttcactgaagtttttctaactggctttgttgggtgactgtcattgtactcctacgatttggtgctggtaatcacatgtaaatttctaataagttaatctggcaacctttgtttctctgtgttctaggttaaggctaggtactcatgtctgcaaaacaatttgttttgtgctcaatttttataattgattttactttgcttc

SEQ ID NO: 3869 - DNA, 487 bp, Gossypium hirsutum
  Clone ID: uC-gsronu33B137d03b1
ttcacgcgtccgcccacgcgtccgcccacgcgtccgcccacgcgtccggtacaatctaagtctccctgtgagaaaatggcatcctaccaaatcttagctttcgcagctttgttcttgatcttgttacccgtagccgtcaatggagatttaggtgacttatctcctgctctatctcctttctatgataggttgtgtgatgatgttgattgtggaaagggaacatgcaaagcggacataagctaccctttgaactacatctgtgagtgtgatgctggttggaaaagaactcaagacgacagtgatgatgatgatgatcataagtttctgccatgcgttattcccaactgcactcttgactactcttgtcaaccagctcctcctccagtacctcagcgagaagttcctcgcaattcatctttatttgatccttgctattgggcatactgtggagaaggaacctgcaacaaaactgcaacatacaagtacg

SEQ ID NO: 3870 - DNA, 451 bp, Gossypium hirsutum
  Clone ID: uC-gsronu33B137d07b1
tcgtcacgcgtccgatcctgcatatgcctctgccgtgaatggatttgctatcccggagtgaataactacctgtgttgcaaggatttccttttcctcgatccatacgattagacccgaagccgatctaaacgattgacggtcgaaggctgcgtcaaaatgaactgtggcccttccccttttgaatacctgttgaatattgccagtagaatgaataagttggtttctgctaaaccagataaaccaaagtctacagaagaagagtcagagttgctcattagtcccttgagcaaagacccaagacactgttgaaaaatatggcagctattttcttcttcacggcagcatctgagacattgagcattcaccacgactcgctttaatttgagattgaaaaagatgggatgaaattccatgatatcctccatactgtcatttgaatctttgaaggata

SEQ ID NO: 3871 - DNA, 476 bp, Gossypium hirsutum
  Clone ID: uC-gsronu33B137d09b1
acgcgtccgcccacgcgtccgctttgtcctccattttttttctctttgatttttcattgctttacactatttgatcaatcagaagctcaaccctaaaagtttcattagaatgaacagtgttaacctttctcatcaatatcctcgaacatcaagctttacttgtcttaactcttgcttgacagaacactggggtgatttgcccttaaaagtcgatgactctgaggatatgatcatctacaattcccttcatgaagctcttaacttcggttggtcaccgacgacgacgggttcaacggcggcaactacaattaaacctgagccgaaagatgaatcagcagagatcatggaaaacgcgaagccaatggagttgactcaaaaagtggtgaaagggagacattaccgtggagttaggcaaaggccgtgggggaaatttgcggcggagattagggactcagctaggaatggagcaagagtgt

SEQ ID NO: 3872 - DNA, 274 bp, Gossypium hirsutum
  Clone ID: uC-gsronu33B137d10b1
tcggcttcattgaagtgatcgttcacaaggatgatactagcaaagagctgttggagtggggctccagggtttctgctgcgaatagccgacccccaaatcctcagtaaattcttggcgctgccttcagcacatgatgctttatgctttgacctatttaagttgatgaaaatttatggtatgaaagctgagtttttcaacatttttccaaaatttgcggagtgcttgctcatatttgtgtacatcactttcaacgtcgtttccggtaatgaatgct

SEQ ID NO: 3873 - DNA, 488 bp, Gossypium hirsutum
  Clone ID: uC-gsronu33B137d11b1
agagtttgtggttggttagtggcaaccacaagacaacaatattaaattttgggttcagtttgatcagctattctgtgctgcccttcttcttcttcttcttcttcaaacaagcaaaaaaacaagaggaaaaaaatgggtggagaaagaaaggtctacactttggctgaggtttctcaacacaaccatgctaaagactgttggcttgtcattgagggcaaggtatttgatgtgactaaattcttggaggaccaccctggtggtgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaattccttgttcccctgct

SEQ ID NO: 3874 - DNA, 476 bp, Gossypium hirsutum
  Clone ID: uC-gsronu33B137d12b1
tgtttgatgtaaggtcaaaggcatttcaggcggtggatcaattttcacagatggtgaagcagtataatgagaagggtaatgctgaagatacttcaggtgctggaagtttagggatttcatcaatgcctggaaatgctagtttacttggatgggccatgagttctttaactcttaaaggcaaagcttctgatcaagctccagttgctactgcaaattctgtcacacctgcaactaccacagcctctacagccagctcaggactaatagaaactccaagtacagcaccagttcaccgagtaagttccagtacagattttgcagatcaaccaatgcctccatctcctacttcaaccgatggatggggagaaattgaaaatggcattcatgaagaacatgacagtgacaaagatggatgggatgatattgaaccccttgatgagccaaagcctttttcaactttggcaaatattcaggca

SEQ ID NO: 3875 - DNA, 489 bp, Gossypium hirsutum
  Clone ID: uC-gsronu33B137e01b1
gttaagttcatggaaaccgtcgtttcctccgtcgttgctcccgacgaactcaccgtcgaggaacggaatctcctctccgttgcctacaagaacgtgatcggcgcccgccgtgcttcctggaggattgtttcttccatcgagcagaaagaggaaggacgtggcaacgccgatcacgtctccatcattcgtgagtacagggccaagatcgaggctgagttgtctgagatttgtgccggaattttgaagcttctcgaagagaagctcgttccggctgccgggaacggggattccaaggtcttttatctgaagatgaagggagattaccataggtacttggctgagttcaagactggagatgaccggaaagccgctgctgagaatacgctctctgcgtataaatctgctcaggacattgcagtttccgagctcgctccaactcatcctattcgtttgggattggctctgaacttttctgtcttctactatgag

SEQ ID NO: 3876 - DNA, 494 bp, Gossypium hirsutum
  unsure (1)..(494): unsure at all n locations
  Clone ID: uC-gsronu33B137e02b1
attacattgacctcttttgtcacgcaaggaacaatattaccgccatgctaaatgacatgagagagatgccaggattaatgagccatatgccaccattgcctgtatctgttaatgaggatttagcaaatggcctcttgcctggagcaactaatgtcttgcctgttaatgagtttgcatgtgctgggttgcatggccaaaaaagtggagtcgtagacaccaccataagctaaaaatttgttcaatttatggaatctgtcgntatatttatctaattgaggtttcatgcaaagccttctttatgctggttgggaatgtaaactttccgggttgatctgaatttttcgctctttttggtcttacactctgttctcattattcagcttcaccaatttgcatttagtcatgtagtcatcttacagctgcttgactgcttggtgatgtctattctcctttcacaccattgatgacttacagctgacttacaggtcagcatg

SEQ ID NO: 3877 - DNA, 497 bp, Gossypium hirsutum
  Clone ID: uC-gsronu33B137e03b1
ccgggagagaaattattaaagaaggttgttatctgatgtcaacacttttgaaccaagggatacagattcagtgttatgaagctatcttaggtgggtcgttggcaagattgattttgactcgtatagggggagaattttttgccacggttattcaggcagctctggagttgtatttcatggtagcttggttgatattttactttgtggtgaagtctagggaagctaatacagaaggtaggaggtatgggaggagagaattggaggctttgattgatggacttggatgaaaattcaatcggaaaaaatgggggaaattttcatttgctgctataactttcgattctgacactgaagatgcctgaagatatcggcaacattttcaatgcttcgagtcttcctgtttttgcagagctaatgatgcaatactgccatagtttcggtctaagaacctgccaatgcattgcatgtacttttttatgagggaacacaatatatac

SEQ ID NO: 3878 - DNA, 437 bp, Gossypium hirsutum
  Clone ID: uC-gsronu33B137e05b1
agccgcccgcctgcacgtacccggacttaattccttgacccacccacgcgttttcgtattcgtatgctttggccaacagagcacggggagatacataatgtgcattttggttagccacagatatggaaatttgaaggcagcaaactatacaacggcagtgctgctaacctcattgcggtctcaacaaccacctcaagaacagaaatggtgttatcggattgtggagatctcaaaaaacagccgccagaactaccgttgccaaattcaccagatcacggaatcactggcttatttccaagaagctacaccacaacctgaaacgatgcctattaacataggcagccgttcgacaagaagaaaagcaacgacaggcttcagattttttagaccaagtccatggatattatgcatggacgcagaccagatttgtactacca

SEQ ID NO: 3879 - DNA, 496 bp, Gossypium hirsutum
  Clone ID: uC-gsronu33B137e07b1
tcgatgggattgaaggttatatcggaaggcaaattggctgttttgcttctatccggtggccaggggactcggcttggaagttcagatcccaagggatgtttcaatattggacttccttctgggaagtcactttttcaactgcaagctgagcggattttgtgtgttcaaagattagccgcacaagctaaaaatgagggctcagtgactatacactggtatgtaatgactagcccatttactgatgatgcaacacgtaaattctttgagagtcataaatactttggtcttgaagcagaacaagttacctttttccagcaaggcacccaaccttgcatttcaaaggatggtagatatatcatggagactccattcaaggtagcaaagtctccagatgggaatggaggagtatatacagctctgaaatcttcaagattgttagaggatatggctgcgagagggattaaatatgtggattgctatggtgttgataatgcat

SEQ ID NO: 3880 - DNA, 413 bp, Gossypium hirsutum
  Clone ID: uC-gsronu33B137e08b1
tcgatttgaatgcccccattccaagtcccttgctccctctccttaatctctacatatgcgcttactgatttcttcaattcttatgacaagcatgcatgatctcaactggtgccactttttgtaaaagaattacatatatacactgtaatttacatgtatgaatagggagtgggaggatgattcatatccctatctcagcaccatgattttcaagttctatgatttgttttgcttctattttaatgtcgtcttaatgcatcagaagaaggaagaaggagaaagacataaaggttagcttccaagtttttcttgatgtcttttgatgtaaactagctagagacgatcagtttgctttaattattgtcactatttcaagtaatttaaatatatatatatattcttattcttgtgag

SEQ ID NO: 3881 - DNA, 382 bp, Gossypium hirsutum
  Clone ID: uC-gsronu33B137e09b1
tcgtttacgcgtccgtgctgagtcacatatttaacgcttttccagaagtcttaaaatcttattttgaaaacttggtacatttgcttgtttatgattgcagattcattcggctgctttctgtttaccatcctttgcaaagaaggtgattgaatcaaaaccttaagggtggaaattttgaagctttagaacaaaattctagttattggtgagcattagttatcatcctttgctttgatggcccagtgtagcaacgaaccttggatttggaaatttagataatgcactttcttttttgtctcgcttaggaagagaatttgaggtaatggttgtagaaggatatatgtccacaagggataatattggcatttagctgacacataaa

SEQ ID NO: 3882 - DNA, 486 bp, Gossypium hirsutum
  Clone ID: uC-gsronu33B137e11b1
ttcacgcgtccgcttcggtcaacagagcaaggggagatggtgcaggcaaaatttggtttgccacagattgccactagacagctagaaatatatacaacggcagtgctgcttgcaactctgcggccccctcaaccacctcgagaacagaaatggtgtaatctgatggaggagatctcaaaaatcagttgccagaactaccgaagcacagtttacgagaacccggaattcctggcttatttccaagaggctacaccccaggctgaattggggtatcttaacatagggagccggccgacaagaagaaaagcaacgacaggaataggacatcttagagcaattccatggatatttgcatggacgcagaccagatttgtactaccagcatggcttggggtaggagcaggtttaaagggggtatgtgagaagggacatacggaagacttgaaagcgatgtacaaagagtggccgtttttccagtccacggtg

SEQ ID NO: 3883 - DNA, 404 bp, Gossypium hirsutum
  Clone ID: uC-gsronu33B137e12b1
tttttcacgcgtccgggaggtgaagaagaaagcgttgacatggatgtagaaagcgatgaagacgacgatgatcttcttattcccaacgtacatgtcgatgaagatttattcaagggattggaagaactggttggaagtggtagtaatggagtaggaatagtcccgacctttggtgataacttctcgtcttggagtaccggtaactccgctgccgccggagccgccgctagtggtggctgttagatattgattttcatttttaattattgtcgtcattttcttttcggtttgggtacaaagaaattaaaaatacttcgattttaattttttttcctttttattatttctccccagagagataaatatgtatgataaagtgcatataacatcacaaaatttattct

SEQ ID NO: 3884 - DNA, 469 bp, Gossypium hirsutum
  Clone ID: uC-gsronu33B137f01b1
atcggtctaggcaaaaactgccatcctgtttgagaatatgagagaactcggagttttacttgggaaaggtgggctgcatggaaatgttttcagaataaagccaccaatgtgtttcaccaaagatgatgccgattatcttgttgatgctttggattatgcaatgtcaaagttgtgagcaaaaggggttatctaacttgtggatcctttggtatcaaagttcagcataattttgtgtttaatagtaataagaaaagtacattttgtttgcatttgtatttgtcaaaaaggatcatcaaaatcccttctatattgtgaaatatgtttctctgtgtttgcatttgttgattggattcatcgaaaataagtatagttataggtgggaaacggaaaggttgtgggtatgggttggagcattgtgagttcaggttcatgaagtatataatcattttaacaagctattctagatttt

SEQ ID NO: 3885 - DNA, 318 bp, Gossypium hirsutum
  unsure (1)..(318): unsure at all n locations
  Clone ID: uC-gsronu33B137f03b1
atgaaaccaaggatccaaggagaggcacaccaattagaagcacctattgaccgaacaagtggattatcgtaagttcacataagaatttattcaaagattccttctatcatattctgataaatttgtagtaaaaacatctattataactttattattaactctcgataatatagttggatcacgttgtatcatatcttaataagatttttcatgactctacctattaaccccgtgtagtaagagatctagtgcatgaaacttcttatctatgtaagtcgtttccattaccagaagatataaggacaccacttttgcnna

SEQ ID NO: 3886 - DNA, 476 bp, Gossypium hirsutum
  Clone ID: uC-gsronu33B137f04b1
tgtacgcgtgggcggacgcgtgggcggacgcgtgggcggacgcgtgggttcatagcattgttagcaagatgttggtaaatgaagaactccatgcaagctgggaccagccaactcgatgcatcatcttccatgatgttgagtactcaaggttgcaggccttggcattccagttgacagaaaagctttcaatacttgctgagagtaatgagagggcagtcgaggctagatttggtggtggtggattggatctgccactaaggcggcgagataaccaggaatatgctgctgggacagctggcggcggcggcggtaggtggccagacttgtcctacaatcagggtaggcaaggtagttctggacgtgccgcgtatactggtggtggcagaccattggcattaggacaggcttcaagggatcggtcaagtcaatcacgaggaacaggcggatactctgggagagccggttcaggaatgaga

SEQ ID NO: 3887 - DNA, 259 bp, Gossypium hirsutum
  Clone ID: uC-gsronu33B137f05b1
gcgtgttgtgttcctttggccactttttcagggttcccagacgaatgactaaggtgatgaacaggaggaggattcacctacattctgctcactcgccctttctaagacatgaactctaacacggtagttattacattcctacgtatggtaaagcccatcgctaatatggacctaaaaaaagagctttgagagatgtttagtttcttagagaaaaacgttttgcaagaagaaaatttgaaatttgttaggtcatttggca

SEQ ID NO: 3888 - DNA, 483 bp, Gossypium hirsutum
  unsure (1)..(483): unsure at all n locations
  Clone ID: uC-gsronu33B137f06b1
ttttctcttccggatagtcgcagcacgcgataaaaatggaggcagccagaaccgttaaagacgtttccccacacgagttcgtcaaggcttatgccgcccatctcaagcgctccggcaagattgagcttcctccatggactgatattgtcaagaccggtaaactgaaggagcttccaccctatgaccctgattggtactatgtcagagctgcttccatggctaggaaaatatacttgaggggagttcttggtgttggtgcctttaggaggatctacggaggagctaagagaaatggaagtcgcccacgccatttctgcaagagcagtggatctgttgctcgtcacatacttcagcaattgcaggatgtcaacatcattgatattgatcctaaaggtggtaggagaatcacatcaaacggccaacgggatctggaccaagtagctggaaggattgcggttgctatctaagaaattttactntatg

SEQ ID NO: 3889 - DNA, 498 bp, Gossypium hirsutum
  Clone ID: uC-gsronu33B137f07b1
tcgggttcaaggattggagatcctaaacaaaaatggcgaatggataaatataaatccttcacccaattctttcgtagtcatgcttggagaatccttcagcgtatggttgaatggtcgattgccttctgcttatcaccgcttgatgatgaagggaaacgagaccaggtatagcatcggattgtttgcaaggccgagaggagggtacctagtaaaggttcccaaagagcttgttgatgacaaaaatccgatgctcttcaaaccctttgatctggaagaatttttgaaaatttactccccccaagctgttcaaggtgctactagatctactcttaaagcttattgcagtgtctaagatttgggcataaataaatcgtggtctctctctatgtaatataatcaaggctatcccaactcaacattgaaaggtggccaaatcaactgtccttgaagggttgtaaaagaggtagtgaatgcaaagacaaattagatattccgaat

SEQ ID NO: 3890 - DNA, 482 bp, Gossypium hirsutum
  Clone ID: uC-gsronu33B137f10b1
tttctcacgcgtccgcccactcgtccgacttaagcggagagggtgtgcaggattaaagggtcaccattgattccaatatgaggctaactactaagttgttgttcttatcagctttgatttgcattgctgtagctggcgttttaggccaagctcctcctactcctagtaatcctccgacatccacgccggcgccgccgactccacccgcttccacacctccacctactactcaaccacctccaacacccacaactacttctccgccaccagcttcctctcctcctcctacttcatcaccaccaccagtttccactcctcctccagcgactcccccgcccgttagctccccaccaccagcttctcctcccccggctactccacctcccgcaactcccccaccggcttctccacctccggctaccccaccacctgcttctccccctcctgctactcctcctacagctaccccaccaccagctcct

SEQ ID NO: 3891 - DNA, 109 bp, Gossypium hirsutum
  Clone ID: uC-gsronu33B137f11b1
ttcacgcgtccgattgtggtgcttggtactgagtgattgaaaaattttatgtaaaaatgtttttgttgggatcattctgctatgctataactacttttactttggattt

SEQ ID NO: 3892 - DNA, 103 bp, Gossypium hirsutum
  Clone ID: uC-gsronu33B137f12b1
tttttttggccctgttaaggcctcataaataaacctaaactattttatctgtgttttatcctatgtaatgatattatatgaataaaaattacatgtttacctt

SEQ ID NO: 3893 - DNA, 98 bp, Gossypium hirsutum
  Clone ID: uC-gsronu33B137g01b1
cccacgcttccgcccacgcgtccgggccgctcttttttttttttttttttttttggatttttttttttcatttatactttgaggtggaaatctgttct

SEQ ID NO: 3894 - DNA, 513 bp, Gossypium hirsutum
  Clone ID: uC-gsronu33B137g03b1
gctatggcgacgacggtggtgaagagcgcgttgcaggcgatccgtgagaggggtctccgcagtttcttaagggagctcaaggatgatggcttcacgaaatgcttcttcgatggaaaccttctgcaaaccaaaatccacaatataggggcaacagttgtgggtgttgataaattcggcaataagtattatgagaaactcggagacacacaagctggaagacacaggtgggttgaatatgcaaaaaaggatcgttatgatgcttctcaggtaccaccagaatggcatggttggcttcacttcataactgaccataccggtgatgagcttttgatgctaaaacccaagaggtacggggtggagcacaaggagaacttatctggtaaggggaatgagtttatctaccattctaaaggacatgcacttaatccgggtcagagagactggacaaggtaccaatcatggcaaccaaccaaggctgagtagtaatcttttgactttgcagctgtgggacga

SEQ ID NO: 3895 - DNA, 481 bp, Gossypium hirsutum
  Clone ID: uC-gsronu33B137g04b1
gcgttcgctattgcatctgagcaatctgtagcaccctggcaggcggcccttcatgggcaggtccactaggaagaagggatgggttcacagcaaaccggacactcgccaactcaaacttgccaggtttcaacaatactctcgaccgattaaagaacaggtttagcaatgtggggcttaacaccagcattgatctagtagccttgtctggtgctcacacatttggcagagctcagtgtttaacttttaccagtcgattgtacaattttacgggagtgggtgatacagatccgaccttgaacaccacatacttggaagaactacgccaaatatgcccacagggtggaaatagtagtgtgttgacaaatcttgatcccacaacacctgatggtttcgacaataactacttcacgaatctacaagttaatcgaggcttgcttcgaagtgatcagaatttattttcgactgagggtgctgatacaat

SEQ ID NO: 3896 - DNA, 516 bp, Gossypium hirsutum
  Clone ID: uC-gsronu33B137g07b1
ttgtgttctgcttgtttttctagcaaaattctcaggatctatcagttcatcaaagtacaataataatctcagtgttcttgatgatgatgatgatgaagatgaagatattccccatacagttgagtcacttgtcttggaccagcccaaaacaccgctgtcgcagaaagatgaagcaatagaaaacagtgccttaatggaagaaacagcagcagcagaagttgaaatcgaaactcaaaactgcagcctgcaagaggaagaagacgaaggtgaaaaatggggtttggatcctttgatgaaaaatggtgtttttgttggagaaagcactgaaagtacagatgagctgaacaaaaggtttgatgaatttattagaaagatgaaggaagaattgagggtcgaagctcgacagcagttagttatggtttaatttaaggatcggtccttttcaatggattcaatcaccataataaactccttaattttacatgtttctatgatcaaattttagcatgttcttag

SEQ ID NO: 3897 - DNA, 456 bp, Gossypium hirsutum
  Clone ID: uC-gsronu33B137g08b1
tttttttcgcgtccgggtaactgcacggatttgaacgagagctgtgagagatgggctgctcttggtgagtgtaccaagaaccgagaatatatgatcggaactgcagaacttcctggctattgtaggagaagctgcaaagtatgttgaaggtaaactacaagcttcaatgatagtatatctgctgctgcattttctgttgtaagttttttattgctttttttttttagtttttggattcaaatttacattcttatgctacagttttcacaaacatagttgaaatccatgtattctaaaacttactttcagcttggttaacatatccccccggaagcttcagatttctcgtagtctttttagattgctagcgtttcactttcagctgaaatctggaaaataattttttcatatttgacttttgatttaaatagcagtatatggatgtaaacctttttt

SEQ ID NO: 3898 - DNA, 475 bp, Gossypium hirsutum
  Clone ID: uC-gsronu33B137g09b1
tcgcttacgcgtccgcccacgcgtccgatttctgaatctttatttggtccaaattcgtgttcacagttgagttcgcagcgatgtcgaacgagtacgagttcgccgataagggagacaagattatctatgaaaccgaagccaaagggttcaacccgggattgattgtattgctggttattggtggactactgataacattccttgggggaaactacatactttactcgtacgcgcagaagactcttcctcctaggaaaaagaagcccgtatccaagaagaagatgaaacgagagaggctgaagcagggagtctcagcaccaggggagtaggaattcaaggtccgacttttctcttttttcgccattgttaaaaactgttttgttcacaatttctgtccagtttcgagagttaaaaacttcaacatctgaattagaagtaaaccccatacttgggtaagactagagagtaaaatact

SEQ ID NO: 3899 - DNA, 475 bp, Gossypium hirsutum
  Clone ID: uC-gsronu33B137g11b1
acgcgtccgaaaaaaaatcgaaccccccttctctctattgctttccatggcgaactcggtggctgattcacgtagcaacagggcagcggttcaagccaccaacgacgatgcttcagccagtaaactgtcatgcgttaaaaagggatacatgaaagatgactacatccatttgtttgttagaagacctgtgaggagatctcctattattaaccgtggttattttgcacgttgggctgctttcaggaagcttctatatcagtttcttgattgtgagggatctaatagtgaaaagggtaaaacaaggaggcagatactatcacttggtgctggatttgataccacctattttcagttgcaggatgagggaaaagcaccgtatctatacgtggaactggattttaaagaggtaaccagcaaaaaggcttcccttattgaatcctacagtcagttgagggacaaaattggtgcaacagca

SEQ ID NO: 3900 - DNA, 482 bp, Gossypium hirsutum
  Clone ID: uC-gsronu33B137g12b1
tttcgtacgcgtgggtttttatctcttttcatttctcttattacactctctctcaactattggcaaaaggactcaatcgttaagattttctcttcgagatacttaaacaaaatggccgtgaaaccaacagtagctttgagggcttttcttgtaggaggggtagctgtttttgcaaaagtagcaggtgcaatgaaggctgctggtggtgctaaactgggtgcagccgcagctgctatgactgtagcggcttctgctgcaatgacgggatcgaagcaggagcaaaaagatggatctaagcaaccttcaaaatgatcttccttttctttcgttctttctttcagcaccttgtaggcatttttaatgtaggtggcgtagtcagttgctcatgggagcttgtctagagaagatggctatgtttggaattctattttggtcatcacagagtttttttttttttaaatgacttgaaataagaaaaacct

SEQ ID NO: 3901 - DNA, 522 bp, Gossypium hirsutum
  unsure (1)..(522): unsure at all n locations
  Clone ID: uC-gsronu33B137h02b1
cattattctacatggtgatgcagtgcttgggagctatatgtggggctggtgtggttaaagggttcatggggaagacaaggtatggtgctttgggtggtggagctaactctgtgaatcatggctacaccaagggagatgggcttggtgctgaaattgttggtacctttgttcttgtttacactgtgttctcagccactgacgccaagcgcagtgccagagactctcacgtccctattttggcaccattgccaattgggttcgcagtgttcttggtacacttagccaccatcccaatcacaggaactggtattaacccagctcgtagccttggtgcggccatcattttcaacaaggacaagggctgggatgaccattggattntctgggtgggtccattcattggtgcaacactagcagcactttaccacgttgttgtgatcagagccattcctttcaaatcaaaatgatctacatcaatggtcatgatcatatgatttcaagaaagtgaaagntccactcatg

SEQ ID NO: 3902 - DNA, 525 bp, Gossypium hirsutum
  Clone ID: uC-gsronu33B137h03b1
aataaaattgcggaaagagcaccgatcgaatccgtacaatgcttcggccgcaagaagacggcggtggcggttacccactgcaagcgaggccgtgggcttatcaagattaacggttgtcctatcgagcttgttgagcccgaaatcctccgtttcaaggccgtcgagccaattcttctcctcggccgccagcgttttgccggcgtggacatgaggatccgtgttaaaggcggaggccacacttctcagatctacgccatccgtcaaagcattgctaaggccctcgtcgctttctaccagaagtacgtcgatgagcaaagcaagaaggagattaaggatatcttagtcgggtacgataggactttgctggtggctgatccgaggaggtgcgagcccaagaaattcggtggaagaggtgctagggcaaggttccagaagagttaccgttgaagaagttttatggtttgttcgcgaaacttcgttttggtttacaagagatactatgtttatgttcattttgaattaagt

SEQ ID NO: 3903 - DNA, 465 bp, Gossypium hirsutum
  Clone ID: uC-gsronu33B137h04b1
ctttgagtatttgattatgtggcctcctgtggtgatagtacataatacaattacaggaaagggtaaagatgggcgcatggaaggtttggggaacaaagcaatggatagcaaactaagagaccttgggtttggaagtggcaagtgcaagtccatgtatggtagagaaggtcatctcggtattacagtggtcaagtttgccagtgatcagtcaggcctgatcgatgctgtcaggctcgctgaatactttgagaaggaaaaccgtggtcgcaaggcttggtcccatctacagcctttgactttagggaaggatgacgatgataaaaatcccaatcttgtgaaggtggatgagaggaatggacaaaaaaagaggatcttttatggttacctcggaacagttgctgatctggacaaggttgattttgacactcggacaaggttgtgattgagagtaggggagagcataaa

SEQ ID NO: 3904 - DNA, 507 bp, Gossypium hirsutum
  Clone ID: uC-gsronu33B137h08b1
tcgctgtcgcgtgggcggacgcgtgggcgaagcttccttttccgttttagatctcaaaattcaaaaggctctctttttcatctcatggctgctactattgtctccgtcaaagctaggcagatcttcgacagccgtggaaatcctacggttgaggttgatgtggaaatatcgaacggtataaaggctagggccgcagttcctagcggtgcatccactggaatttacgaggctcttgagttgagagatggaggttccgattacctcggtaaaggtgtatcgaaggctgttgctaatgttaacacaatcatcggccctgcattgattggaaaggacccaaccgagcagactgcaattgacaatttcatggttcaacaactggatggaacccaaaatgagtggggttggtgcaaacaaaagctcggtgcaaatgccattcttgccgtgtcccttgctgtttgcaaagctggagctgaagtcaagaaacttcccctttacaagcacattgct

SEQ ID NO: 3905 - DNA, 259 bp, Gossypium hirsutum
  Clone ID: uC-gsronu33B137h09b1
tcggtttattcattgttggtggcaggaacaaagctttggtgggcaaggacaggattgactattgccattttgatcgctattacaggctatagtttctaggaactcataagataaggggtgaatgtgatttactttacaattgcttgtcataccttttttctttttggtttgaatttctctgtcacataacagagaatattgtttcatttgtgtaacaaaataaattgaaattttaatagaaatagatacgaataagacc

SEQ ID NO: 3906 - DNA, 198 bp, Gossypium hirsutum
  Clone ID: uC-gsronu33B137h10b1
ttgtttatacgcgtacgatttttatcgaacctggagatgtgataacttgatagctctagcatttgtataatttggagactttacgctgtcattttgaaatatacagtttattgtgcctggaatttctattaattgctgctgtatgaacatgatatttgaaaatggagttcaagtttgggggtggggtggtttgatttc

SEQ ID NO: 3907 - DNA, 486 bp, Gossypium hirsutum
  Clone ID: uC-gsronu33B137h11b1
tcggtttgctctgtatattgaaattttctttctcgattttctctttagccaaaaaagatgcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaagcaactcgaggacgggcggactttagccgattacaatatccagaaggaatcgactctt

SEQ ID NO: 3908 - DNA, 474 bp, Gossypium hirsutum
  Clone ID: uC-gsronu33B137h12b1
acgcgttcgcggacgcgtgggtgtgctcagtgtgggttcaactatgttccctggtattgcggaccgcatgagcaaggagatcactgctcttgctacaagcagcatgaagattaaggtcgttgcgccaccagagagaaagtacagtgtctggattggaggatctatcttggcatcactcagcaccttccagcagatgtggatttccaagggtgagtatgatgagtccggcccatccattgtccacaggaagtgcttctaagttttgtaattgcttttgatggtgatctacattttgcatttagttggctttttttggtgtgccgtgtcaagtgaactcaaaagtctggtttatgtgggggaagttagcgatcattgtaggacggtgtactcgatattgacgtattattattttagcctttcaccgtatcaccaccattaagatgatgggcccctaagagatggcggcggacggac

SEQ ID NO: 3909 - DNA, 466 bp, Gossypium hirsutum
  Clone ID: uC-gsronu33B138a01b1
gttataaaaagtggtacaaataaagaacttccaagtggcgataatgcacaaggaaaaagggagtccaatgaggtcacagtagcattgccaatggaaccagcaccatccaaagcaactcaacctactgacattgttgatgatttcaaggacattcaagaattgcagactaccccaatcgaaaagaccgaaggaaatgcaactttgaaaccaaacccgtcgggggaagaccaaagctcaaatgccaaaatggttaccgtaaataagccaatgcaattagatcatgtaaaaggtgatgaagaatttataatgccaactaaagttgtttctgaagataacatagcaccagaaggatttggtaaagatattcctgagacaacggtccatcctgtgccgccagtgcctagcaagacggtaagattttcgactgtaaatatcgaagagatgggtgcaacgaatgagaaatatc

SEQ ID NO: 3910 - DNA, 569 bp, Gossypium hirsutum
  unsure (1)..(569): unsure at all n locations
  Clone ID: uC-gsronu33B138a03b1
cttacattgacaaacctgatgttcatggttggacacccagggagctagctgagcaacatggacacgaagaaataaagacaatgtttgaatcaagaaaagagatgaaaactcaatctatcatgtcaatcccagagaaggctgagacacggtacctcgggaggtttacaagtgagccggtgatccgtcctgtggcaccggatggtacagatggatcatggagccaatcccggcagagacgtaggacaagtaacttccacaactcactgttcgggataatgtcagccgcaaacatggagaaagatttgctattgtcagtacataaacctaagggtgtgaaggattgtgttgtcaactctgctagagttgtaataagttgtccagaaaaggggcaaaccattgggaagctagtttcacttccagggaactctgaggaattgcttgagatgggtgctaaaaaatttgggatcattgggtgtaaagtggtgagcaaagaggagctgaaatgatggtatgaagtgatagagatgtgaccatctnngtttgtagtgatgtcaaatgcacatcaacac

SEQ ID NO: 3911 - DNA, 282 bp, Gossypium hirsutum
  Clone ID: uC-gsronu33B138a06b1
ttactgtctcgacccacgcgtgcgctttcgaaaaagagggaaaagaaaaaaagcggtcgagactctcacagccatggcgagcacctatgtactgaggttcatgcaccagcacatggtccatacccttttgtacatgcattcgagtccttcatcaatggcgtttcacacttcggtccatttttcgtccaacccaaacttcattaatcttaggtccccaatattaccaagaagagaacgtcattgctctttatgtcttgttaacgaccacatgtgcatcactca

SEQ ID NO: 3912 - DNA, 195 bp, Gossypium hirsutum
  Clone ID: uC-gsronu33B138a09b1
tttgttacatgcccttgtcgtccctttgatttccttatttttgggttttcttttctctaagtatcatgcacctttttgggaatattatatatatgcagtcttcagtttcttaatatcttaatggaaatgagagtgtcatcaatggtcgtgcattgacaatgtcatcttatttatgagtttcagcatgtgtttatt

SEQ ID NO: 3913 - DNA, 230 bp, Gossypium hirsutum
  Clone ID: uC-gsronu33B138a10b1
ttttcgtaaaagagggaaaagaaaaaaagcggtcgagattttcacagccatggcgagcaccaaagtacagaggattatgaccccatcccatcaacctgatctttaagtatctgcaaagtaaaagctcgcattcagaattggctttttggagcaaaaggatttgagattggaaggccgaatcattggtttggccgagtccatgaattaagttctggatgatgctgaaaaag

SEQ ID NO: 3914 - DNA, 276 bp, Gossypium hirsutum
  Clone ID: uC-gsronu33B138a11b1
ttgactgtctcgacccacgcgtgcgctttcgaaaaagagggaaaagaaaaaaagcggtcgagactctcacagccatggcgagcacctatgtactgaggttcatgcaccagcacatggtccatacccttttgtacatgcattcgagtccttcatcaatggcgtttcacacttcggtccatttttcgtccaccccaaacttcattaatcttaggtccccaatattaccaagaagtgaacgtcattgctctttatgtctgtttaacgaccacatgtgca

SEQ ID NO: 3915 - DNA, 280 bp, Gossypium hirsutum
  Clone ID: uC-gsronu33B138a12b1
ttactgtctcgacccacgcgtgcgctttcgaaaaagagggaaaagaaaaaaagcggtcgagactctcacagccatggcgagcacctatgtactgaggttcatgccccaacacatggtccatacccttttgtacatgcattcgagtccttcatcaatggcgtttcacacttcggtccatttttcgtccaccccaaacttcattaatcttaggtccccaatattaccaagaagtagaacgtcattgctctttatgtctgttttacgaccacatgtgcatcac

SEQ ID NO: 3916 - DNA, 414 bp, Gossypium hirsutum
  unsure (1)..(414): unsure at all n locations
  Clone ID: uC-gsronu33B138b05b1
tttatcagccaatttgatggccatgtattatccaccgtttcttccattaggggttctggctatagtgcgaggggtggttggacaatcgagcaaggctgctccatccattggcaatggaccttcgtcggctgtgaaaaagagggcttaaagttgatccccgatcagtttcaaacgtcttctttaagagaccatgctaatacaataataagggagggattctaatctgtttgatccgcagctaaataaggataaaaaaaaaatgaagtaggcaaattacaaatatattagcaatctaatagtatttgtaatacttgcttaggctgcattttcagcttgttttgtttacagtgtgtatcgcagtttttagtggcctacttgtctttgattaatgcanattttatttaaattttgatg

SEQ ID NO: 3917 - DNA, 307 bp, Gossypium hirsutum
  Clone ID: uC-gsronu33B138b06b1
tttcttacgcgtccgcccacgcgtccggggagctttaatgtgacagtcacgggcataacaattcaaaacagtccacaatgccatcttaagtttgataattgcataggagttgtggtacacgacatgtccgtctcatctccaggggacagtcctaacacagatggaatccacctacagaattccaaagatgtgctaattcatggcactactcttgcctgcggagatgactgcgtttcgatacaaacaggatgctcatatgtatacattcacaatgtgaattgtggaccgggacatggaatcagcattg

SEQ ID NO: 3918 - DNA, 281 bp, Gossypium hirsutum
  Clone ID: uC-gsronu33B138b07b1
ctttatttgcctttcttactcttccatagttccattcactccttaattccgtatctcaaagcagctgcatttcattcatcaaaactgagctttttgacatttggtaatttatacatttcatggagtaatatttgttgtcattaaaggctgtttaatctctttgttgaaatggttttccctctcttttaagttgtttataggaagtaaatatatcatttcagtttcatgtcattttgggttaggattgtttcgagtttaacttgttttagatttggctgttt

SEQ ID NO: 3919 - DNA, 378 bp, Gossypium hirsutum
  Clone ID: uC-gsronu33B138b08b1
aaaagatcgaaaaagactgcaccgatgtttcgaattctatgttatccattcccctcatgattcctggcaccagatactacaaaggcatgaagggacgtgaaaagctgaatgaaacctttggaaatatgattgccagaagacgtagtggagaggaatattttgatgattttctgcagaccatggtcaatagagattcgtatccagaagatgaaaagcttgatgatcaagagatcatagataacctaataacactgatacttgcagggcaaaccaccactgcatctgctatgatgtggtgtgtcaagttcctatctgaaaataaagatgcactcgacaagcttagggaagaacaattgccaatagtcagaaataaggctg

SEQ ID NO: 3920 - DNA, 512 bp, Gossypium hirsutum
  unsure (1)..(512): unsure at all n locations
  Clone ID: uC-gsronu33B138b09b1
cccactcgtccgcccacgcgtccgcccacgcgtccggttgcaaagaggctctcagcctttggctgcaccattgcctacaccgcaagaaacaagaagcaatctgttccaattccattctatgctaatgtccgggaccttgctgcaaacagtgatgttcttgttctttgttgtgcactgacaaaggaaacttaccacttggtcaataaggatgtcatggtagcattagggaaggaaggagtgataatcaacgtcgggcgtggctcgttgatcaacgagaaggaattagtgcagtgtttagtgggaggagaaattggtggtgctggtcttgatgtgtatgaaaatgagcctaatgtccccaaggagctatttggacttgataatgtcgtgttgtctccacacagtgctcccgcaacaccagaatcctttgaagctgtgctacagctgactggtggcaacttaaaagccttctttttcgataaaccnttggtatcagtagtctcaaatgaatgaac

SEQ ID NO: 3921 - DNA, 320 bp, Gossypium hirsutum
  Clone ID: uC-gsronu33B138b11b1
gtttgatagtggcctactatggtggcgacgggtgacggagaattagggttcgattcctccgtaggacctcctctattttctccttactattgttggtgtcccctaggatcatcgacactacaatgctcagctacttccgaactccctgcctcttccatctgatcttttaagcttccaccgctttcatcaatgttgccaacaaatggttcttccagctcgttgaaaccgactctacctcttggtcttactgatgtaccatcactggattttccagcttatctcccggaaccattggtccgattaccgttggcgagttcaca

SEQ ID NO: 3922 - DNA, 357 bp, Gossypium hirsutum
  Clone ID: uC-gsronu33B138c01b1
gttgcaaagcctcaacccaagaggcctcgtgctaatggtgccggatatggtcctcgagtcactaatatagctgctgacaaaacattttatcccagagtcactgacaggtacatgcagtacgtgtatgacagaccctatgtttacgccggacctgctgacaactacagccactctcttcttgcttctgctacctacaacttctctcctagtcatgggaactacttcggaaacgggtaccagtatcagactccgtatcttcactaattcccaaaaatggcataaaggtaactatgatcctctcactttagcggttagctttaacctttcaggtgcagtgcatgaatggatttagtatct

SEQ ID NO: 3923 - DNA, 139 bp, Gossypium hirsutum
  Clone ID: uC-gsronu33B138c02b1
tttaaaaaaaaaaaaaaaaaaaaaaaaaaaaaaaaaaaaaaaaaaaaaaaaaaaaaaaaaaaaaaaaaaaaaaaaaagggaggaaagatataaaggatccaagataacatacaaaaaaaatgcgggggggtcctttttt

SEQ ID NO: 3924 - DNA, 459 bp, Gossypium hirsutum
  Clone ID: uC-gsronu33B138c04b1
tcgttatactacaagaaagctttctttattatcatggaaaccaacttttgcgcttcttattttttaataggaacccttttttcggtctgcctttttgttgctttcaaaactggataaattctcgttgctaagcgtatctcgcttgatattttagagggcgaactggcgaaacataagtcttacgccgaatatctgcttcaacagctatttcgtgcgaagaatatacatttaagggagggggaaacttttaagggagtagtagaaaatcatttggtttttgaagagcccttaaaagagcaaattgatgggctctatcaaatctgttgtgatctcattctaaatggggccaacagtagctactttctaaaaattgtggaattttatggatccacgcttggtatgtagccaagcccaagaaaaaaggaacgaggggaagaatcgacaggaatccataacaaa

SEQ ID NO: 3925 - DNA, 321 bp, Gossypium hirsutum
  Clone ID: uC-gsronu33B138c06b1
ttgcccacgcgtccggttctagatcgcgagcggccgctcgcgatctagcagaggaccttcaaggtcttacttgtgaggaaaggtgggtggatacactcattgtaagattcaattattatatgattatgagatttcgtcatatctaatttgtgtattctctgcagcatgtaggagagtttgtttgctttctgaggttcttttgttcattatgtatttttaactatcattgcttgttcattttgccttatgtatcataaatcagtcttcattcattgaggaaattattattattttcttttacagatttcaaatattctgttc

SEQ ID NO: 3926 - DNA, 542 bp, Gossypium hirsutum
  Clone ID: uC-gsronu33B138c07b1
cctcacttcgtccgcccacgcgtccgtgagttttgaatctagggatttgcgggtggagaagacgagagctcatctctctgcttcaaagctcctgtccaggtagaattctcttcttcctttgcgttgtgttctttgttgttcagtcgccatggcttcaaagcggattttgaaggaactcaaggatttgcagaaagatccacccacttcttgcagtgctggtccagtagctgaagacatgtttcattggcaagcaacaatcatgggaccctcagatagcccttatgctggaggtgtgtttttagttaccatccatttccctccagattatcctttcaagcctcctaaggtcacgtttaggaccaaggtcttccatcctaacatcaacagcaatggaagcatttgtcttgatatcctcaaagaacaatggagccctgcactaaccatttccaaggttctgctctcatctgctcgttgctgaccgatccataccctgatgaccctcttgttcccgagattgctcacatgtataagactgatcgggc

SEQ ID NO: 3927 - DNA, 416 bp, Gossypium hirsutum
  Clone ID: uC-gsronu33B138c08b1
gttttgtttttctttatttgaatgctttttttgattttgcttgaatctctgctctttttattttaaaaaatatcgtctttgcattcgattgctctcaatattcgaaccttctgtattgatttcgtgtttttctgtaaaaaagagccccctatacaatgaagatattaacggctttatagccgaatcatattacaactgttaatatttcttgtttctattctcttgtctttgctttgcgtgtttctgctctttgtcttgctttttttttgctttgcaggtgatgggacgaggccagagggtgctatgctaaggcaacagaggcgccaggggtggtcatgcgttgaacgcgctaacaccacgtggtgagcggcgcggcgcgaaggggagggaatgaggctagggcttgctggctgaaa

SEQ ID NO: 3928 - DNA, 485 bp, Gossypium hirsutum
  unsure (1)..(485): unsure at all n locations
  Clone ID: uC-gsronu33B138c10b1
gttaattatatgagtttttatgtgatgtaatagtgtcctatttgataatagatgaatgttgtgtagtgtacaagttagtccttaaactatgattataaattgattgaacatgtagtaatgtacaagtgccgaatatgatttgatcaaattgaaatggttatgtgtatttggttttttgaattctattaatgtatatttttagttttctattgaagtgtaatgctgtttgcatgttttgcgcattctttaagttacaataaaattatattctactatgtggtattaataattaaatagattattgatattaaaaattggttggcttaaaagtttgtggaagtgtatgcttatgattgttcaaaatttgtgtcttgtctggtaataccccataaccccattccagcgacggatatgggttggggtgttacatntttagtacggtcaccacttggttgcaatgaaaatgtgtaccctaatcactaatg

SEQ ID NO: 3929 - DNA, 420 bp, Gossypium hirsutum
  Clone ID: uC-gsronu33B138c11b1
cccacgcttccgctctcgccaaaagacacccaaagacaccactttgaaacccggaaatgtcggacgaggagcatcatttcgagtccaaggccgacgccggcgcttccaaaacctaccctcagcaggccggcaccatccgcaagaacggttacatcgtcataaaaaatcgcccctgcaaggttgttgaagtttccacctccaagaccgggaagcatggtcatgcgaagtgtcactttgttggaatcgatatcttcactgccaagaagctcgaagatattgttccttcttcccacaattgtgatgttccgcatgtcaatcgtactgactaccagttgattgacatttctgaggatggatctgtgagtttgctgactgagagtggagacactaaggatgatctgaggctcccactgatgagaa

SEQ ID NO: 3930 - DNA, 554 bp, Gossypium hirsutum
  unsure (1)..(554): unsure at all n locations
  Clone ID: uC-gsronu33B138c12b1
gtttgtattggtgagtgatgtgaaatggttattttggacaggtatgtatttaaccctcgggttgagtattgatacaaccactataaggtaataagatgatgaaaaatgatcagaaatgtgatatgtgttttagtgatgtatgctaatgttgattggtataactgtttgttatgttacttattatttgcatatgaacttactaagcatttatgcttactccctccttcttactcattgtagttttggacaagccaactcaggagtcgggataggtcgaaggctcagtcacactatccggaagacttttggtaaatggcttgtaaatttaagtatggcatgtatagcaatatacctattntgtgtaaatgatcttatggatgngctgtggaatggctgaaggcatgcttgatcatgataaattatgaaaatgggtagtgtagattatgtttgatggtaaggaaaactattaagatacttagtgcattaaaacatataaaaaggatgaaatttgcataacagatactgcagaacacttaccgagttgaaattactaa

SEQ ID NO: 3931 - DNA, 479 bp, Gossypium hirsutum
  unsure (1)..(479): unsure at all n locations
  Clone ID: uC-gsronu33B138d01b1
tttcttacgcgtccgcacgcctaataaccgctcggatttttctcagacgtgaaaaaaatggggctgtctttcaccaagctattcagccggctatttgccaaaaaggagatgcgcatactgatggttgggcttgatgctgctggtaaaaccaccattctttacaagctgaagttgggagagattgtcactactattcccaccatcggttcaatgttgagaccgttgaatacaagaacatcagcttcactgtttgggatgttggcggccaggacaagatccgaccattgtggagacactatttccaaaacacgcaaggacttattttcgtggttgatagcaatgatcgtgaccgtgtggttgaagctagagatgagttgcacaggatgttgaatgaggatgagttgagggatgctgtgctgctagtatttgcaaacatgcatgatcttncaaatgctatgaatgctgctgagattaccgac

SEQ ID NO: 3932 - DNA, 507 bp, Gossypium hirsutum
  Clone ID: uC-gsronu33B138d02b1
tcgttaaagctctcaagtctctcccttgaatccaattccttcaaagcttggttctcagacattcaaacccgtaaattttgagatcgaagaggtggaatttagcaatgtcagggctggaatcaggttcaggttctcggtatgttcatcagctactcggaccagagcttcagctgcaaccccaactgagggacaccaagcactcaccggacaaagaaggaaccgatcatggcggtaccaccaccagttctggtggtggagaaagaaggcctcgaggtcgtccagctggctctaagaataaacctaaaccaccgatcatcgtcactcgcgacagtccaaattcactaagatcccatgtgcttgaaatatcttctggttcggacatagttgactcggtagcaaactacgcacggcggcgcggtcggggtgcttgtgtgctcagtggaaccggtgccgtcactaatgtcacattgcgggcaccggctgccccatccgggagtgtcataacac

SEQ ID NO: 3933 - DNA, 410 bp, Gossypium hirsutum
  Clone ID: uC-gsronu33B138d03b1
ttcacgcgtccggcatggcagacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagcaaccatggcttgtcgtaggttttgcctgttgccgccacggttacttggtgcttgccaatagatagagtgaagtactaatatttacttgtttttctgtccagtgtgagcatctctgctatctcaggatatattgtgactattacataattaatgtaaggaagtgagtcagattcctaatgaatgagaagaagctcctatttcgttt

SEQ ID NO: 3934 - DNA, 413 bp, Gossypium hirsutum
  Clone ID: uC-gsronu33B138d04b1
cccacgcgtccgctcataactcctcaaaattcttcttcaatggcgtctcgagttcttgttttggcttcaattcttattttctcttgttttgcagagacatgctatggggcgatctcattctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatagtcaagaaaccctacatcaacgtcaacgaaacccttgtatggaccatcgaaagaga

SEQ ID NO: 3935 - DNA, 483 bp, Gossypium hirsutum
  Clone ID: uC-gsronu33B138d05b1
ttgtttacctctttgacggaccagcaccagtccctatggaaaaatctgccgtgagtactgattcaacagatgttgatctatttgctgatgcaacttttgtgtcagcaccgaccaaggtgactcatgaatcaagtcctcaggcacagcaacaagttgatctatttgcttcccagcctgccattactcctgcagcctctccaactgttgacatatttgctgccggtgatccagttgtgcaaccacacataaagggacaggttgatttattcgcttctcagcctgccattactcctgcagcatctccaactgttgacctcttttccaccactgatccagttgtgcaaccagccatggcagcaaacgttgagccagtaaatgctagcattgttgatccatttgctgctgttccgctgaacaattttgatgggtctgacattttttgttcaaaacaaaaccccatgaatgatggaaacctaataaaat

SEQ ID NO: 3936 - DNA, 373 bp, Gossypium hirsutum
  Clone ID: uC-gsronu33B138d08b1
tttgttgtagttggtcattgtacatacataatggtgttgaacttagtgaagatgataacgatggctaatctgctaagtatgcttatattaatggaggtggtggcgggtgggtttccatttggagttgatggtcttcgcatggactactacataatgagttgcccatttgctgaatccatagtgaagaacactgttaatagagctttgcaagatgacccaacgttggcagcagctgtggctaggatgcattcccatgactgctccgttgagggatgggatggctccattctgattgactcgaccaaggacaacacagcatataaagactcacctggtaacgtaagcttgcgaggctatgaagatattgatgatg

SEQ ID NO: 3937 - DNA, 138 bp, Gossypium hirsutum
  Clone ID: uC-gsronu33B138d09b1
ctttttttttttttttgaaaaacaaaagtcaccatatttaactggaattgacgggcgcacaaccccatgttcaaacaatgccggcgaaaaaaggaaaaggaaaagacaagatgaaatacaaaagagcttctccaattg

SEQ ID NO: 3938 - DNA, 504 bp, Gossypium hirsutum
  Clone ID: uC-gsronu33B138d10b1
tttgatccctcgtctctggcgtccagattgctatctccgcatcgaacacagggggtgcttgggataatgctaagaagtatatcgaggccggtgcttcagaacatgcaagaactcttggtcccaaaggatcagaaccacataaggcagctgttatcggtgacaccattggggaccctttaaaggatacatccggaccatcactgaacatcctcatcaagctaatggctgttgaatcacttgtctttgcacccttcttcgccacacacggtggactgcttttcaagatattttaagtaaaagaacacaaaaacggttccagtctgccggttctcttccaaatctcctttttttttttcgtaagtatagttctagtgtgtagcacattttgacatatcctcttaaaggttgaatctatagcgaaaattttcccttgaaagggttgacaatgaaatcaatgatgatgatgactatgataatggtcaatctagaaaagagctaagaact

SEQ ID NO: 3939 - DNA, 465 bp, Gossypium hirsutum
  Clone ID: uC-gsronu33B138d11b1
tttactcgtccgcccacgcgtccggtagcagaggttctccttgctttggaatatctccacatgcttggtattgtatatcgtgatctcaagccagaaaatgttcttgttcgagaagacggacacataatgctttcagactttgatctttccctccgttgtgctttcaatccaacactagtcaatttgtccacacctgagtctgaaccattgcgaaagaattcaacttattgtgtacaaccagcttgcattgagccctcctgcatccagccatcatgtgtggtacctacatgtttttcacctcgcttcttttcatcaaaatccaaaaaagaccgcaagccgaagaatgaaatggggaaccaagtcagtccattgcctgagcttattgctgagccaaccaatgctcgctccatgtcatttgtgggaacccatgagtacttggctcccgaaattatcaaaggtcaggga

SEQ ID NO: 3940 - DNA, 435 bp, Gossypium hirsutum
  Clone ID: uC-gsronu33B138d12b1
ctcacttcttccggagaaatcgagatgaaggagccattgcgcaaaacgaaagtggtgataaggcatctaccaccgtccgtcaccgaaccctctattatttctcaaatcgacgatcgtttctccgatcgctataattggttctctttccgtctcggcaagtccagccataagcaacagagttactcccgagcctacatcaacttcaataggcctgaagatgtctttgagtttgctgagttctttgatgggcatatatttgttaatgagaagggtactcaatttaaggccgttgttgaatatgctccttcacagcgtgtaccaaagtccagctttaaaaaggatggtcgtgaaggaccattttcaaagatcctgattatctggaaattctcaaattgattgcaaaaccctgtgagaatcttcccagtgctgagattc

SEQ ID NO: 3941 - DNA, 480 bp, Gossypium hirsutum
  Clone ID: uC-gsronu33B138e02b1
cctagatgagaaaacaatcttccaccttaacccatctggccgctttgtcattggtggtcctcacggtgatgcaggtctcactggtcgtaagatcattattgacacctatggtggctggggagcccatggtggcggtgctttctctggaaaggaccctaccaaggtggacaggagtggtgcttacattgttaggcaggctgccaagagcattgtggctaatgggcttgcccgaaggtgcatcgtgcaggtctcttatgctattggtgtgcctgagcccttgtctgtctttgtagacagctatggaactggaaagattcctgacaaagaaatcctccaaattgtgaaggagaacttcgacttcaggcccggtatgatcaccatcaacctggatctcagaggggtggcaatggcccgtttttgaagacagctgcctacggacactttggagggacgaccctgactcacctgggaggtgtgaag

SEQ ID NO: 3942 - DNA, 376 bp, Gossypium hirsutum
  Clone ID: uC-gsronu33B138e03b1
ttcttaagcacaagaaactgcaaatcttgtcctaccgctcaaaaaactgaggaacatcaccatggccggaaataccacgggcttctttgacatgaagataggaggtagcccgatcgctggcatgggatggaggtttattctgattggactcctcacactggctactacttgcccgccctacacaccggggagaaaggcgtccgacatgaaggtaaggccctacactacaaaaggtactgtttccatcgggagatccctaactgtatgcgccaacgaagtgactactcaggcggaaacggtaccggaggctaatgcatctactgatccacgtgcgctggcgagtacttcatggagaaacacactggccccgggattc

SEQ ID NO: 3943 - DNA, 387 bp, Gossypium hirsutum
  Clone ID: uC-gsronu33B138e05b1
tctttacgcgtccgcccacgcgtccgacctaaagaagattgctgagaagatgaacggtgcttctggtgcggagcttaaggcggtttgcacagaagcagggatgtttgctttgagggaaaggagagtccacgtaacacaggaagattttgagatggcagtagcgaaggtgatgaagaaggagaccgagaaaaacatgtccttaagaaagctgtggaagtgattaagctttattttcattattgtgctttgctttctttgttacgggcaaaaaatggatggaacgtgtaaaactagacttatacagtgacattataataccgtacgcctgttttctttgacaaaagcctgtcctacaaaatttgcaggtaaaggacttagatttttatg

SEQ ID NO: 3944 - DNA, 484 bp, Gossypium hirsutum
  Clone ID: uC-gsronu33B138e06b1
tttaagtttgatcgtggagccatgcagatcagctcatttaaaggcaatggaagtagccaaaggagctggtgcattgctctcatatgatccaaaccttcgcttgccactttggccttcagctgatgaggctaggaaacagattttgtccatttgggataaggcagatattgtcaaggttagtgatgtcgagctcgagttcctcaccggtagcaacaaagtcgacgacgaaactgccatgaaactttggcgacccaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcatatgcatgtggagccatcacg

SEQ ID NO: 3945 - DNA, 399 bp, Gossypium hirsutum
  Clone ID: uC-gsronu33B138e08b1
cccaccccaccctttcttatcagtactggagttctgtatcgcatcatcctcaagaaaaagttaagagatattcaatgggcagcttttattcttctatgtgctggctgcaccacagcacaactgaattctcgttctgatcatgtacttctaacatctatgccatgttggatcatggcaattgtgatggcccttctgagcggatttgctggagtgtacaccgaggctataattactaagcgcccatcaaggaatataactgcgcggaatccctggctgtatattcccagaatgaccttcaatgctctagcaatactgatgcaggatattgatgctctcatgcacaagggcttcttacatggatactcgataattaccactctcatgatccctaatcatgca

SEQ ID NO: 3946 - DNA, 389 bp, Gossypium hirsutum
  unsure (1)..(389): unsure at all n locations
  Clone ID: uC-gsronu33B138e10b1
ctaagcttctgagctctaccctgaagtgaaatacaccactgtggaagaaggcctcagtcattttgtttgagaaagctagaaatcaaatcagatcattgttattaaactgataccagtaataatgtaaaaactgtcactgagagatttgtgcagaggacttgaggattctgtgtgtacgtatgtgtgtgtgtcataaatttctcgttactatcattcaacataatgccaaacatgcttttcttcttgtgtcgtntaaaaaaaaaaaaacaaaaaaaaaataaaaaaaaaaaaaaaaaaaataaaaaaaaaaaataaaaatanaaacaaacttatatatttaacaaaaaacaattcctaaaaattgggggggcccttttaaaggacccaag

SEQ ID NO: 3947 - DNA, 380 bp, Gossypium hirsutum
  Clone ID: uC-gsronu33B138f01b1
ttgttaacatacatcgacatcgctatttcgatttgcaaccatgagaagagtcaacggactcgctatcgtcggcagaaccttaacctgtggcggcgccgatgagaaacggctggctcaagcggcgttgatgagtacatgctcttcttcatcgctaaattctcatattttctcgcagaaactcgctgatcgattagggctgtcgcgtccttccctcgtgcgcagggttgcggggaccatgctgttttctgtggcagcatcgtctctggctcatgatgctcttgctgaggagaagcctcgctctgaaaagttcctgcccaaggaagatcgtctctaccagtatgaagcttgccctttctgtaccaggctaaagcatttgtgga

SEQ ID NO: 3948 - DNA, 448 bp, Gossypium hirsutum
  Clone ID: uC-gsronu33B138f02b1
gtttgaacatggggttcgaaaccgaggacggagagattcagtaccgctggaacacatctctgttctttggcgttcgaagaaatgccttgtttagccggtcttggcttccggctaccggtgaactaaagggaattttgatcattatacacgggctgaatgagcacagtggaagatatgctcaatttgcaaagcaactaatctcttgcaactttggtgtatgtgcaatggactggataggtcatggtggcagtgatggattgcatggatatgttccttcacttgatcatgttgttgcagacactggggctttcttggaaaagatcaaatcagagaacccaggtgtaccttgcttcctttttggtcactctaccggtggagctgtggttttgaaggcagcttcccatcctcgtattgaaagatgctgagggagttgtgctgacctctcagc

SEQ ID NO: 3949 - DNA, 458 bp, Gossypium hirsutum
  Clone ID: uC-gsronu33B138f03b1
ttcacgcgtccggtctctctctctttcacctctctagaaaaccctgcatttcaccttcttcactcccattttcttatatctcgaaaccccataaaccaaacgtttatccattaatattaagacccaattctcacatcattttcctttgaggaatttaaccgaaaagtttggatttcttttttgtaggatccaacccatttcaggttgttttcaatggcatcatcggacttgaaagaatcagctgccaataaccctgggcttcatactacccctgatgaagctaccaaagactacatcatgcagcaaactatgtatcgaattaaggatccaaaagtcagtcttgatttttactctcgtgtattgggcatgtcgctgctaagagagtggatgttccagaattgaaagttaccttgtactttatgggctatgaggatgtttccaagcttcaagtgatccat

SEQ ID NO: 3950 - DNA, 283 bp, Gossypium hirsutum
  Clone ID: uC-gsronu33B138f04b1
tcgttcacgcgtccgcccacgcgtccgatcactgtctgctttgatatcgatgctaatggtatcttaaacgtatctgccgaagacaaaaccactggacaaaagaacaaaatcaccatcacaaacgacaagggccgactctccaaagaagaaattgaaaagatggttcaagaagcagagagacgaggtttgttttattgcattcgtagttataatttgttattggtgtagcatcaattttgtgagctgcgtgtttctccgattatatttattgctggttgtggac

SEQ ID NO: 3951 - DNA, 534 bp, Gossypium hirsutum
  unsure (1)..(534): unsure at all n locations
  Clone ID: uC-gsronu33B138f05b1
ttgaggtggacatgatgaagatgtggaaaagttgaggaaatttgcaaggaatattgggcttttatttcaagttgtggatgatattcttgatgtaacaaagtcatctaaagaattagggaagactgcagggaaagatttggtggctgataaagtgacttatcctaaatcgatggggataaacaaatcaaaggagtttgcagagaagttgaagagtgatgcattagagttgcttcaagggtttgatcctgagaaatctacccccttaattgctttagctaattatatagcttacaggcaaaattagcttcctcttgtgtttgataaaaagggcttcgagaaagaagcacgatagtagtaataatattgtgaatagtctactacaatgtttatgttctaaagctcccatcaatggtacgtggatgtaattgttaaattcagttcttcctcaatttgttggtcctatgtacgagtacttactcttgatctggaactttntatcaataagtcaatgattaatctggngatttcttcttt

SEQ ID NO: 3952 - DNA, 519 bp, Gossypium hirsutum
  Clone ID: uC-gsronu33B138f06b1
tttctttcacgcgtccgcccacgcgtccgtgcaaactggggttttgctgcaattgaaggaattggatggggttgggcaggtgtgatatggctttacaaccttatcttttacattccactcgattttatcaagtttttcatccgatacgccctcagtggaaaagcttgggatctcgtcatcgaacaaaggatcgctttcacaaggaagaaagacttcgggaaagaagaacgtgaactgaaatgggcgcatgctcagaggacactccatggattgcagccaccggacaccaagatgtttggcgaccgaactagttacaatgaacttaatcaaatggctgaagaggcaaagagacgagctgaaattgcaaggttgagggaactgactacactaaaagggcacgtcgaatcagtaagtagactgaagggtcttgacatatatcacattcagcaagcgtacactgtctgaaaagacataatacatttcggctctactattgacatatactgtggagtattatga

SEQ ID NO: 3953 - DNA, 366 bp, Gossypium hirsutum
  Clone ID: uC-gsronu33B138f08b1
cccacgtcttccggtatatgatgattctgaatagcaatcaatcaactcaaccccattaacggtgcaggatgatggggtcaaaagcaagcctgcaccggcgctcgggctgtcgcggatactgctgctcacaatgccctcaaagtttccctcgcatgtaattaaggaccgaataatgagcagcagctaagatgggtcaaggcttagctgggaagatttacatgaaacttgctggagattccatgagagcttcctttatactttcttcgaccagggccttgcatatattaaaaactggcacttcactgatatgtggctgaatattgcctagggcacaaggcagcgggcgtatggagccattattatgtt

SEQ ID NO: 3954 - DNA, 352 bp, Gossypium hirsutum
  Clone ID: uC-gsronu33B138f10b1
gttgggtggatttatcagtttctgaactagaatcgggtaatagtcaaatgcgttcagattcaacacaggatgaccctcaattggagccattgttgtctcgaaggtcttgaaacttgcttgcatctgaagcaaacgttttggataatgccatttttttaacaaggtgtttccgatatctaatatgttgctcgattgtttacaatttagttaaaagattaggaccgagaactccgattcttgtatgtattgtttggaacattattgtactactactagtagtctaacttatttagtagctgtataaagctgcttcttgtacaaattttgattcaatctactcatttcatttctt

SEQ ID NO: 3955 - DNA, 527 bp, Gossypium hirsutum
  unsure (1)..(527): unsure at all n locations
  Clone ID: uC-gsronu33B138f11b1
tcttaacaaaaaaatgtctcggagatatgatagccgcacaacaatcttttcccctgaaggccgtctctaccaagtagagtatgcaatggaagccattgggaatgctggctctgcgattggaatactatcgaaggatggtgttgtcttggttggtgaaaagaaagttacttccaagcttcttcaaacctccacatctacggaaaagatgtacaagattgatgatcatgttgcttgtgccgtggcgggaataatgtctgatgcaaatatcctaatcaacactgctagggtgcaagctcaacgatacacatatgcttaccaagagccaatgcccgttgaacagttggttcaatctctctgtgatacaaagcagggttatacccagtttgggtggtctccgcccattcggtgtttcatttctttttgcaagatgggacaagaactatggattccaactntacatgagtgatcctaagtgcaactacagtggatggaaagctgcagctattggtgcatataatcaagcagct

SEQ ID NO: 3956 - DNA, 376 bp, Gossypium hirsutum
  Clone ID: uC-gsronu33B138g02b1
cgtccggtttaaaccagtagcagcaacttagatgcaaggaggtgtttttcaatgggttcttatcaatatgtgctggccaagtcagatctaagggttaccctctctggtggtcaacaacaccatagccatgatattaagcattcatcagctgaaagagatgcagaagagaaaaagatcagtaatatgagtaaaggtgaaagcttttcagtttcgaagatctggctttggtctaagaaaggcaaattctcaacttcatcagaatcccaaactggtatgacatcttctcttaactcagacttgccatggctgaagaaaacacatgaacaatgaaagcttattatgcttttagttcttatgtcacatgtttcttgttctg

SEQ ID NO: 3957 - DNA, 462 bp, Gossypium hirsutum
  Clone ID: uC-gsronu33B138g07b1
atctctacctctccttatctcatccaaaggtgtgttaactgggttagcaaaatgtcaaaccccaaagttttctttgatattttgattggaaaagcaaaagctggccgagttgtaatggagctatttgctgatgttgtaccaaaaactgctgaaaatttccgtgccctctgtactggggagaaaggtgttggacagtgtgggaagccgttgcactataaaggctcagcatttcaccgaatcatcccgagcttcatgtgtcaaggtggagatttcacaagggggaatggcacgggtggagaatctatctatggcatgaaatttgcggatgaaaacttcaacctcaaacacactggacctggttgtctatcaatggcaaatgctggaccaaacaccaacggttctcagttctttatatgcactgagaagaccccatggctggatggaaaacatgttgtctttggt

SEQ ID NO: 3958 - DNA, 421 bp, Gossypium hirsutum
  Clone ID: uC-gsronu33B138g08b1
ttcactttccggactcattatctggtcttgaggagttagtactcagggataataaattgatgaaagtaccatatgtcagcttattcaagaagctcttggtttttgatgtttctttcaacgaaatcacttctcttcatggaatgtcgaaggtctccagcacactgaaggaactctatgtatccaaaaatgaagttactaagatggaggagattgaccacttgcatgagttgcaaattcttgaacttggttcgaacagattacgggtaatggaaaatttgcaaaatttcacaaaattagaagagctgtggctgggaaggaatcgaattaaagctataaacctttgtgggctcaaatacatcaagaagattagcttgcacaagaatcgtttaacttctatgataggattggaggaatgtgttgc

SEQ ID NO: 3959 - DNA, 320 bp, Gossypium hirsutum
  Clone ID: uC-gsronu33B138g09b1
ttaaacttgatgatgccttctctttatatgagcaagccattgctattgaaaaaggaaaagagcattctcaaacgttaccaatggtgtatgcacagtactctagattttcattcttggtttctggaaatgcagagaaggctagggaaattctgactaggtcacttgaccatgtgcaactatgtaaacaattccttgaggccttaatacattttgaaacaattttgccacctctaagacagactgattacttagaatcattgattgacaagctcttggccccgagtttggatggcagtactgcagacaaggaagatctatct

SEQ ID NO: 3960 - DNA, 518 bp, Gossypium hirsutum
  unsure (1)..(518): unsure at all n locations
  Clone ID: uC-gsronu33B138g11b1
tttacgcgtccggtttcttctatcttgttcattggaccaaacaataaaagtatgggtggcttctgagaatggaaacctggaagtaacatacactcacaacgaagaacatggcctgcttaatcttcgtgggatgcacgacttagaatccaagccagtcttgttgtgtgcatgcaatgacaattatgtccggctttatgatctgccgtcgttctccgagaggggtagaatttttgctaagcaggagattcgagccatcgaagtagggcctaggggcctctttttcactggcgacggaactggttttaaagtgtggaaatgggcggagccagttgctacaacttgattgccttgcaccatttcataacacattcatcctcctgcaattttttggtggtaattattttatattttttcatcctttcaggtaaagtctctcatggtgaaaacaactttgggttccaccttttatagcataatagatcaattaagagtaattggatgaactagntgccctaatt

SEQ ID NO: 3961 - DNA, 461 bp, Gossypium hirsutum
  Clone ID: uC-gsronu33B138h01b1
ttgttcgccgattctcattttcccttctatgccgtttcagatcctagcctccgcccgttcgactcctattcgcagaggagaagaaggcgtcatcggctcacccgcgaaggtaagctctcctcccttttccttctcttttcttttattcaaaaaaaatgaatcaaacaaaacccgaaaagaaaaccccaaatgaaaaaagaaatcagatgatgcatgagaacgattcaaaaatcaccttttttttgaattgatttcgtgtttttgatacaatatgcgtgggtattccccctttcaatttttcgtaatggctttatatagccaaaaaggaaatacaaaatccctatttttgtttttcttttttctctgctattacaattttcgctcaatttgttgtgctattttttttcatctgtttctgcgtgtgctgctgctttggtctgcctttgttgcgttgctgctct

SEQ ID NO: 3962 - DNA, 219 bp, Gossypium hirsutum
  Clone ID: uC-gsronu33B138h02b1
ttgttattatcaagtgagaaaacgggccattggaaaagggaagatacagttaggcttggacactaacaaaagcttgggagatggtcccccccatcgttatcaccggccttataaatggtgcgattgttacttccagcttaaatacccgccgacaaaaactcgctgctatgctgcgtcgcctacacccgatcaccccagatcttaaataaaagggggggg

SEQ ID NO: 3963 - DNA, 109 bp, Gossypium hirsutum
  Clone ID: uC-gsronu33B138h03b1
ttctttattttccatggaccgcagagaacctgtggtgaaacaaatagctctggaggcagataatctctcatggctgcttgagattttggctgacaggccatcagcagct

SEQ ID NO: 3964 - DNA, 222 bp, Gossypium hirsutum
  Clone ID: uC-gsronu33B138h04b1
tgttgtcaactgtgtcgaaccattttatgttttcttttggggaagggagggggtgtttttttcttaaaaggaatttgtcattgtgctttggatatgggaagatatgtacattctttttatttattccgcgctttataacttgtgtgaaacccttgtttcgttctcgaagtcgctgtgaaaccctttgtttcgttcaatgtaacaaaaaggtctttggttctt

SEQ ID NO: 3965 - DNA, 475 bp, Gossypium hirsutum
  Clone ID: uC-gsronu33B138h05b1
tttgtagatcaagtggaaaaagaaagcagaacaagaaaatggcaaatgcagacccaagccagaaggttgactacgttttcaaagtagtgttgatcggtgattcaggtgtgggtaagtctcaaattcttgctcgttttgctagaaacgacttcagcttagattccaagtctaccatcggagttgagtttcagactagaaccctcctcattgagcacaagagtgttaaggctcagatctgggacactgctggtcaagaacgatacagggctgttacgagtgcatactataggggtgctgccggggcaatgctggtttatgatgtaacgaaacgccagaccttcaatcacatcgcacgctggctagaagagttgcgtggtcatgctgacaagaacattgttataatgctggttgggaacaaaagtgacctcgaaaagcagcgggatgtctcaacagaggatgccaccgaatttgctca

SEQ ID NO: 3966 - DNA, 415 bp, Gossypium hirsutum
  Clone ID: uC-gsronu33B138h06b1
tcgctctgccatccgaaagtgtgctagagttcaattgatcaaaaacggcaagaagattgctgcttttgttccaaatgatggttgcttaaactacattgaagagaatgatgaggtgttgattgctggatttggacgaaagggtcatgcggttggtgatattcctggtgttagattcaaggttgtgaaggtgtctggtgtttcactcttggcactcttcaaagagaaaaaagagaagcctagatcttaagtttgcaatgaggaaaagatggctttcatgatctttctatagtttttcttaaaactgagagcgttctgttgcctggtagcttttctggacttttgtttattttctggctattattgtattgaatttttggtgtcatcgtttgatcaaaaagattttggggctttaaaa

SEQ ID NO: 3967 - DNA, 427 bp, Gossypium hirsutum
  Clone ID: uC-gsronu33B138h10b1
gtctgatgactgggatgatgaagaggatggtatttggaaaccacctaagatcccaaacccagcatacaaaggaccatggaagcgtaagaaaatcaagaaccccaactacaagggaaagtggaagactccatggattgataacccagagttcgaagatgatccggacctctatgtgctgagaccaataaaatatgtgggtattgaagtctggcaggtaaaggctggttcggtttttgacaacatattgatttgtgatgacccacaatatgcaagagaagttgtagaagatatatgggccaggaatagggaggccgaaaaggaagcctttgaagaagcagagaaagaacgaagagcccgggaagaggaagaagccaaaagagctagagaggaaagtgaaaagcggagaagagagagggaccaccgacat

SEQ ID NO: 3968 - DNA, 423 bp, Gossypium hirsutum
  Clone ID: uC-gsronu33B138h11b1
ctcacgcgtccgcgttcacttactcaccaaaacaccacacaatcaccccatttcaccacaagaacatcactttaatctcccaacatgtctctttaatcataaaacaaatcgattcatctcaaaaaaagcttgctcgaattgaaaaccaactccttggttaccaaacacttaatgtttcaagacccaaccttgcaaatgaactcaaattgttcttacaacaccaccagcttccattagggaaagattcaaggacagggataactgaaatggtggcttcagtaggacattcatgtgagaaatcagctggtttgttgtctcaatacatgacatacaaggtttctggtccttgtcctgatgattggagtcttgcacagaagctaattttaagagggtgtgaaccattaccaagaagaagatgctttg

SEQ ID NO: 3969 - DNA, 500 bp, Gossypium hirsutum
  unsure (1)..(500): unsure at all n locations
  Clone ID: uC-gsronu33B138h12b1
tttatgggatgttcagtttagtcctgtaggacactattttgccagctcttcacatgatcgaacagcaaggatttggtcaatggatagaatacaacctttgagaataatggcaggacacttgtctgatgttgactgcgtgcaatggcatgccaactgcaactatattgctacaggctctagtgacagaacagtaagattgtgggatgtacaaagtggagaatgtgttcggattttcattggtcataggagtatgatattgtcactagcaatgtcacctgacggccgctatatggcttctggtgatgaagatggcacaatcatgatgtgggacctttcaagtggaccggtgtgttacgcctttgatgggtcacacctttgcgtgtggtcacttgctttcagntgtgaaggtaccgctctagcatctggatcagctgattgcactgtaaaattgtgggatgtcacaacaagcacaaaggcccccgaaaatgaagacaagagtg

SEQ ID NO: 3970 - DNA, 589 bp, Gossypium hirsutum
  Clone ID: uC-gsronu33B139a02b1
cctttacatctgggaatgaccgtggtccctgcaaatttgacaagaccaaaatcgctgcctctgtttctaacttcagtgtcatttctgttgatgaggatcaaatcgctgctaatttggtgaagcatggtccccttgctgtgggtatcaatgcagttttcatgcagacatatatgggaggggtttcatgtccttatatttgctttagaactttggatcatggagttcttctggtagggtatggagctgctggttactccccaatccgctttaaggacaagcctttctggatcataaagaattcatggggagcaaactggggagaggacggatattacaaaatatgcagaggtcgcaatgtttgtggagtagactccatggtctcaagttggcggctttgcatacaaagtctcagtagcattgccctgtaaatgactgatataagtaacggtaatattagtttccgccagtatgtcttatctctggatttatgccatctgctagaacgggtttattccaatcctgtttatgcagccacctttaaggctgctttagtacctttagaatttgatctagcatatgaacctctttt

SEQ ID NO: 3971 - DNA, 392 bp, Gossypium hirsutum
  Clone ID: uC-gsronu33B139a04b1
gttaatcttagattgagtactatgccatgctttgtaaagttggggtgcatcattataatggaaacaatactgatctgggaactgcttgtgggaagtacttccgcgtatgctgcttgagtatagttgatccaggtgattccgacatcatcaagtctctacctgttagacagctgtgtcgtttgacagcagaacaatgttcgtttcttattatattgttcctcgtagccttcttatccttagttaaagaacaattactgtggatgctcttagcaaaatttgtagctttaaaatacaaaattttgtctggtaaatgaagacactgctggtgggctttcgtattatgttacatccgtctcttttgaatccttttaggaggcattttggtcatgtac

SEQ ID NO: 3972 - DNA, 351 bp, Gossypium hirsutum
  Clone ID: uC-gsronu33B139a05b1
acggtttggttttgaatgcccacaaggtacgagaatgaccgatttaggtggttgactgcgtacttgcttcctaggattagaacgccctacaatgggggtgaccatgtgagtgggaaatataagattgtgtacagtaacctactaccgcatgagacgaggtaatggaggtagagaaaaaccatgagatatgaccagattcatgagagctggcttacgagctgttgatgctgtagaagggatccgcaaaagaatgtgatgctctggaatcagggaacaacagcgcatcggaaacagaggctagattaagatgggccactgagtgtgaagaagaccctaaaccggtaatatcaa

SEQ ID NO: 3973 - DNA, 388 bp, Gossypium hirsutum
  Clone ID: uC-gsronu33B139a06b1
acggtctagactgcaaagaaaatacataaccagaaattcgcagtgctatgcggaaacgacatatgtaagggtgatgttcctgcgggttctgctgaaaaaccactcagtgtagcgaaactgctagagatgtgcggtagcaacatctttgctgaagggaaggtcgagtctcgagtcagtaacggccgctgaccccctggcggggaaaggacgacagcttctgttctacttcataggtggaacactggttccgattaccgtgtttttctgttatcttcagtgggggtgagtgattatggactctgggaattctgttttaagatcaacatgttaacttgacctaagagcgaatatgctaattaccagatttataattttgtgcattaccgag

SEQ ID NO: 3974 - DNA, 439 bp, Gossypium hirsutum
  unsure (1)..(439): unsure at all n locations
  Clone ID: uC-gsronu33B139a08b1
tcgtttaaaacaaaaaaagggagatagagagttctctttgctctcccttcactccctatgtccggcgataggatttcccggtgtccattgcgcagccgttgtgggccagtggccggcgttgcgcgaatggatttcttccgacgccgaggaggccaacgaaggtcttcaaggaggtgatgggagcaggtggaggagaggcgatgcaagtgaaggcacctagggtttgctgcttccttattttttttctgctggtggtttgggctagggtagggttgttttaggtttagtgggccgggtaagattgggcttgtacattaacaatagttcataagatgtaattacaataatcacatgatttaatatcaatattagcantctatacattaaaattttatcctattattttattggtgtcttgtataaacttccatctgctctt

SEQ ID NO: 3975 - DNA, 375 bp, Gossypium hirsutum
  Clone ID: uC-gsronu33B139b02b1
gtcgacccatcgcgtccggtttggattcaagatgttccctgacataatagagaagactacaactgagactattgttcttggtgtgacaactcagaaaatgcactttgagggatctgagatgggagttggggttgagaatggatgcaagtgtggagacaactgcacttgcaacccttgcaattgtaaataagagggggggaaaatgaacaacaaagagaagcagagaggcctttgtctttttaactaaataaattctattactttagtatgtatcagcaaatcttcatgaggatttggttcttaattatgtgtaatgtgggcttttctgctatgtcagaatgtattatgatatttaagaaagtttgttttcaattg

SEQ ID NO: 3976 - DNA, 342 bp, Gossypium hirsutum
  Clone ID: uC-gsronu33B139b03b1
ctcccctaacccgattccttttatttttcccccaatttccctaaatcggcagccctccgcatctcctcaaagggttgtagcagaaggaggtctcgaactagcaggtcaagtggtacagattcatggagaccttatggatgataactaccagacattggaccaagctgtttgtgttttattctatttttgttctaagatctattaaatctaacttaattttcacgcattctgttgtgcaagtagatcattcttctcttatgtagaatccattcattagtatatttcaaggctgccagattcattctaggtaaaagttttcatggaagccaaatttttagatct

SEQ ID NO: 3977 - DNA, 620 bp, Gossypium hirsutum
  Clone ID: uC-gsronu33B139b04b1
ttttatctttctttgtcgcaggtcgaagaagcttatgattagaacgggacagtgttttcttttaaatggcttcatattcttaggaagtttgtttgtcctaaattcagtagttatcccaacactacaatggatattgcctgatcattactcacaaaccaattgtgaagcgatgtctgaattccatggtgtcttcaaattttattccttcttacgtggcttcctcatacaactattctatgtattttggttctatcccttatacgtattcagctttattctgagcaatctatggtacaatgacattgctacacatggttttgctgcaatggggagatccgggccttctacggtggaatcctcgaaacaaaatgatacattgacctcagacagcaaagtgcatgcagctaggcctgctggccttggagggatcatgatcggaataggggagcaggtgtattcgttgcttctttgacttttttttcttcaggtttatgccgcggattataccttacgttgggaggcactcatttcgtcctttttcttggagtcgctattactgtttgagtcaatgaacttaccgatggggccggaaaagattgatttttgaaactatggctttt

SEQ ID NO: 3978 - DNA, 398 bp, Gossypium hirsutum
  Clone ID: uC-gsronu33B139b05b1
tttacgcttgggtttcgctcgtgcatttaacaggattatacatatattatattaacattgtatatacatgcattcattcatagtagttttacatcattattttgtaatgggattttgagtaacagtcccaatatgcatatgtgtgtgtatatatatatatacacaaatgtgaatcggatttattttctctatatatttgcataagtagaggaagctagaggagaaaagagcaaaagccctagaaaagatgcataacgacgtcgcaaaagcacacagaaaagcagaagaaagaagggcatcagctgagtccaagagagggaccaaagttgcaaaaatccttgaaattgccaatttaatgagagctgttgggagaccacctgcttaaccggtcttttttt

SEQ ID NO: 3979 - DNA, 373 bp, Gossypium hirsutum
  Clone ID: uC-gsronu33B139b07b1
ctcacgcgtccgcccacgcgtccgcccacgcgtccgaacattgtcactggtgatgacaatcagactcagtttgtgattgacaacaaggtgctccctcatctctatcaacttcttgtacaaaatcacaaaaaaagtatcaagaaagaagcctgctggacaatctccaatataacagctgggaataaagctcaaatacaggcagttattgaggccaatattattcttcctcttgtacaccttcttcaacttgcggagtttgacattaagaaggaggctgcatgggccatctcgaatgccacctctggaggatctcatgagcagattcaattccttgtgagccaaggttgcattaagccactctgtgacctactaa

SEQ ID NO: 3980 - DNA, 191 bp, Gossypium hirsutum
  Clone ID: uC-gsronu33B139b08b1
tttacgcgtccggtttataggcatgagattatatattccttttatgacctttaacatggaactcagttgagttctttcatggagttttggttgggtttactttgtttaattgcatgtttgtggagaataaagatggtggagtgtagtaacaaagcatgagcagttaaaagtatggtgattttattgctttg

SEQ ID NO: 3981 - DNA, 190 bp, Gossypium hirsutum
  Clone ID: uC-gsronu33B139c01b1
tctttctatgtctgaggatttatggtgcatcaaaaagcttaattacggatcagacgaaaaatgtggactgtctgattggttgaactctcgaccttcttcaccattgatttttgtcgaccctcgtgatatttgacattttcctttttaaacttttgataatgattatcttaaatgatcatagtttcattat

SEQ ID NO: 3982 - DNA, 300 bp, Gossypium hirsutum
  Clone ID: uC-gsronu33B139c03b1
cttacgcttccgggcacttgcacatgggttagtcgatcctaagagacgggggaagcccgtccgacagcgcgtccagcgcgagcttcgaaagggaatcgggttaaaattcctgaaccgggacgcggcggctgacggcaacgttagggagtccggagacgtcggcgggggcctcgggaagagttatcttttctgtttaacggcctgcccaccctggaaacggctcagccggaggtagggtccagcggccggaagagcaccgcacgtcgcgtggtgtccggtgcgcccccggcggccctttga

SEQ ID NO: 3983 - DNA, 440 bp, Gossypium hirsutum
  Clone ID: uC-gsronu33B139c04b1
tttgtggtttgcttaagacttacgagtcggcgcttgataaagggttgaccgtttttgctccgtccgatgaagcttttaaagctgaaggtgtccctgatttgagcaagctcaccaatgcagaacaagtctcacttctagagtatcacgcctcgccggattacaaacctaagggaacgttgaagacgacgaaggacccgatcagtacattggcgactaacggcgctggaaagtacgatctgacagttacaaccgtcggcgactcgatgacactacacacaggggttggcccatccagggtcgccgaagcagtttttgactcaccgccggtcgccattttcaccgttgacaacgttttgctcccttctgagctgttcggcatgtcaccgtcgccagcaccagccccggaaccagtttttttggctttaccgacaccattttta

SEQ ID NO: 3984 - DNA, 354 bp, Gossypium hirsutum
  Clone ID: uC-gsronu33B139c05b1
cttacgcttgggcccagacagacaaggactacaaggagccaccagcagcacccttctttgagcctggtgaactcaaatcatggtctttttacagagctggtattgccgagtttgtagccaccttcttgttcctttacatcaccgtcttgactgtcatgggtgtgtctcagtctaaaaccaaatgtgcaaccgttggtattcaaggcattgcttgggcttttggtggcatgatcttttgccttgtttactgtactgccggcatttcaggtggtcatattaaccctgctgtgacctttggattgtttctagcaaggaaactgtcacttacaagggcattggtctatatgatcatgc

SEQ ID NO: 3985 - DNA, 273 bp, Gossypium hirsutum
  Clone ID: uC-gsronu33B139c06b1
cttacgcttccgggaagtggtcctagccttccccatcaagttcattcaaaaggtttggtcactaatgcatcatatcgagctggatgtgagtgggcaatgttcgtaaacagtgactggtctttctcatgtggagactacggaagggatctgattgaaccatgttttgaggatagtgtttggggaactgcaggactttcagctggtcttattgccgggcaagctgattcggcactccggatgacagagaatgcagaggttaacacggtcgtccta

SEQ ID NO: 3986 - DNA, 578 bp, Gossypium hirsutum
  Clone ID: uC-gsronu33B139c08b1
tttcgttacgcgtccgcccacgcgtccgtccacgcgtccgtccacgcgtccgaaaaaaaaaaaaaaaaaaaaaaaaaacatctttgcagtcggaggttttccctgatcagggtccagagctcaagcatggcgaaaccggttgtgcagtttctggtgaaacagtttctgttccttcaaatgaaacaaccacccttgaaggggctggtgcgggaagttaaatgttgtgtacagttgatgcttgaaaagggtttgtaattgccagcatatagagtcgcacacaatacattgctatttctcgaggttatccgcattgagacattaggacacattaggttatgctgccgctgatattccgcaaatcctagtatcgtttggaggtattgggtgcaaattggtaaaaaaagtgagccttccttagaaatgtggataagatttttcagttataattaccagttattctagatctggcttggtcttccatctcattgctgccttcatggaaccttgccaaaatgttgtgttaaaaataactaagttctagtctttgcattggtgtttttttggcttttttttttttg

SEQ ID NO: 3987 - DNA, 85 bp, Gossypium hirsutum
  Clone ID: uC-gsronu33B139c09b1
aatcaaaagcttggaaagagaaatgaatctttgtatataattcatagagaaaaatatatgatgtgagccttgatttgctgctgct

SEQ ID NO: 3988 - DNA, 466 bp, Gossypium hirsutum
  Clone ID: uC-gsronu33B139c11b1
ttttcgataaaccaggccagacagaatgcaagtactacctaagaactggtggatgtaagtttggttaggcctgtagatacaaccactcaagggcaaaatcttcaacagatccgattttagaacttaactttctggggctgccgatccgacagggagagaaagagtgcccctattacatgcgtaatgggtcctgcaagtatggagccaactgcaggtttaatcatcctgatcctacaactactggagcttgtgccccacctgctgcatatggtaatggtggatctgtttcatcacaagctgcatcacaagtgaatatggcttcctggtcatcgccaagggcgtttaatgagactgctactgctacttttatgccaattatgttttcaccaactccaggtgttccaacctcaaattctgaatggaatgggtattaagccactatttattccccaccaaaaaggatttt

SEQ ID NO: 3989 - DNA, 428 bp, Gossypium hirsutum
  Clone ID: uC-gsronu33B139c12b1
ttcaaccaaaacacatgccgagtccaagaccatgagccatggtgtccatgctcagcaacatgtggctcaaggcacggctgtgcccgcaatttgccatggaaagaaggaaaagaagatgaaagacaagaaggagaaagacaaggacaagaaggaaaagaaagaaaagaaggaaaagaaggaaaagaagaccgagagcaagaagaagcccgagaaggagaagagtaagcacaaaaaagagcaaagacgacagtcgcagtgacagtgacttaagagatggctggccctggcacgtatagtgtgctgcactacactaaataaaaccatgtgcagtctcaacagcagtctaatacagtgtctcgagcaatgtaagactataaattatcatatctcctattaaatataagggaaaatagatatatttttatgga

SEQ ID NO: 3990 - DNA, 518 bp, Gossypium hirsutum
  Clone ID: uC-gsronu33B139d05b1
tccacgcttccgcccacgcgtccgctctctttcacccttcaaagtccagcctaggtccggccgatctccggcatcgggccaccacccgtacgctgccgtatacggcggccggagttccaaaatagcctcccttttagtcgatttgaccttctcaacctagatccaagggtaaaatacccgaatcacccaccaaaaatcgaaaataaaagaaaaaagaaggaaaaaaataaaataaaataaagggacccctcggttccctatcaacgctggcgatatttccgacgaaccaaaaggctcggccactccgttgcctggagaaggaggctccaaccaccgcgttaaaggtgacgtgaatggccagacgcgtgcgaggaggcgtgcgacggtggtgcccgaggtggccaatagtgaggagcggcggctgcaaaaagggataaggtttcagctttgctgaaactagtttaggttttgggccaacgggcctattttgcatttgggttagggtttggtaataaaat

SEQ ID NO: 3991 - DNA, 189 bp, Gossypium hirsutum
  Clone ID: uC-gsronu33B139d07b1
ttctcgttaggcgtcagcccacgcgatcacgttgatggcttgaacgagggtggggaccttggcaaccgtgctgcgccagcccttgactgcgctaccgacgacacagcggatgacttgatcaaactggtgaccaagggagagaggaacgctgtaaaagagttagcgaaggttcaacagtcattgcagagg

SEQ ID NO: 3992 - DNA, 513 bp, Gossypium hirsutum
  Clone ID: uC-gsronu33B139d11b1
gttgaatcaagacaatgaacaagacaataaccctgatgcgttagatgattttctgctaaagcgcaaacgtggtcgcccaagaaagcacccaaaacatgatttaaatcagggggagaatgctcagatgccttggaatcagaacctgaaccatgctgagaatgcccatgtcccacctggatttggagcagtgaatggaaaccgaccccaccaagtgaatcctgatgcaaatgacgtaatggttggtcaggctgctagtggtgttattgaggcagcattcgatgccggatatttgcttactgttagggttggcaactctgacaccactttaaggggcgtggtcttcaggcctgggcattatgttcccatttcagctgaaaatgatgttgctcctaatctccaaatgattagacgaaacgagattcccttgccacgggagaggtttggaacagctcatccactcaacggaccagctcttaccaaccaggtgccacgagcccgggcttcgaatcttgg

SEQ ID NO: 3993 - DNA, 469 bp, Gossypium hirsutum
  Clone ID: uC-gsronu33B139d12b1
ttaacgactcgaaaccgccatgggtaattcgcctgcagatttctctcaacttgcctccgatgctatactctataacccttctgatctggcctgctgggtcgactcgctgctaactgagttcgctgagcctcctcccacttgctcctccgacttcatcgtggatcccgtaaacaatcaaacggtggtaaacagcgcgtggaccaccgccgaacctcatacaccgcaggtgcaccagaatattacttatgacgagcaacagagtttggataatcagttgacggttgtcacggccatggaagaagattcgggtataaggctggtccacatgttgatgacttgtgctgagtgcgtccaaagtggagacctctcattggctacttcattgatcggcgacatgcaagggttactgactcatgtcaacaccgtttgcggtatcggttaagttgccggacattttatcgacgcttta

SEQ ID NO: 3994 - DNA, 68 bp, Gossypium hirsutum
  Clone ID: uC-gsronu33B139e02b1
ttcacgcgtccgcccacgcgtccggtattcatatattttatttaattgataaactctaattgtagttg

SEQ ID NO: 3995 - DNA, 478 bp, Gossypium hirsutum
  Clone ID: uC-gsronu33B139e04b1
gttgagcttcctttctttcttttctctccttttccaccggcgtcgatctcgatccttatcctcgttttcaaacaagctcgaaaaagatggccaacgctgcatcgggaatggctgtgcatgatgattgcacgttgaagttcttggagctcaaggcaaaaagaacccaccgtttcattgttttcaaaattgtggagaaccaacatcacgttattgtggagaagcttggtgaaccaaccgaaagctatgaggattttactaaatgtctccccgctgatgaatgccgatatgctgcgaacgattttgattttctaacggccgagaacgtaccgaagagcataatgctgttaattgcatggtctcccgacacgtcaaggatcaggagcaagatgatctacgccagctccaaagatagattcacgcgagaactggatggaattcaagtggaattgcatgcaacagatgcaactgagatgggtct

SEQ ID NO: 3996 - DNA, 75 bp, Gossypium hirsutum
  Clone ID: uC-gsronu33B139e05b1
acgcttacgctcctcgaaaaaaaaaaaaaaaaaaaaagaaagagataatttaaagcgctagatctgcaactactg

SEQ ID NO: 3997 - DNA, 496 bp, Gossypium hirsutum
  Clone ID: uC-gsronu33B139e07b1
ttctcgttacgcgtccgagctactctaccttttctttttatatttatttaaaaaaattcaaacgtatatatacatttatgaaaatccatgaaaatttaaacgaaaaggaaaagggtgagatcgaatttcaaagcaaaaggcacaaaaagaaagttccagatcaagagattttcaagtgtttcgacagttttgagagtgggagggaaaaaaatggagaggagcactccagttaggaagccacatacttctacagcagatctgctcacttggtctgagactcctcagccggaccccgacaccttcgccgctcgctccgtccgacctcaccagccgtcggatgggatcagaaaagtggtgtttggaggtcaagtaactgatgaagaatttgaaagcttaaacaaacggaaacctccttctggatataaaatgaaggagatgactggtagtggtatttttgcagccaatgtagaaaatgatgagtccgaaccaggcagtg

SEQ ID NO: 3998 - DNA, 173 bp, Gossypium hirsutum
  Clone ID: uC-gsronu33B139e09b1
ttcacgcgtccgattctatataacgcataacccctagccctcactcccctccccactatcattccatttgctttgcctttaatcctccttgctatcgaactctaccaagtatgagacctccaagaggccgtggtggtggtggtgggcttaggggcagaggtgatggggggaga

SEQ ID NO: 3999 - DNA, 536 bp, Gossypium hirsutum
  Clone ID: uC-gsronu33B139e10b1
tttacgcgtccggccatcaccaagggtgactagctatacgtctcgaggtccttcctatagttgtccattggttttaaagcctgatattatggcacctggtgactcagtcctcgctgcatggcctccaaatgttgcagcagctcttgtaaatcaagaccttgtgttcaccaatttcaacttattgtcgggaacatccatggcatgtccccatgtttcgggtatagcagcacttttaaaagctgtttatcctaattggagccctgcggcaattcgatcggctttgatgacaacatctgatcaaatcgataacacaggtagtccgataaaggatataggcggaaatctccgaccggctgatcctttagccatgggagctggtcatgttaaccccaatagacctttaaatcccggacttatatacgatgctacggttcaagattacgttgatctcctttgtggtctaaaattcacacaacatcaaattaaaaccatcacgaaaacattatcaaacaactgttccaaccctttttttgatc

SEQ ID NO: 4000 - DNA, 406 bp, Gossypium hirsutum
  Clone ID: uC-gsronu33B139e11b1
gttgagacaaaattcgccgacgaagaggaaaaaaaaaattcaaagcgatgggtttgcaactatgggagactttgaaggaggaaataacggcgtatacgggtctatctccggccactttcttcacggttgttgctctgttgtgggccatttactatgtagtaacgggtctattcgggtcgtccgatgatcaccatcaacgttccagggctttcgaggagcagatggagccgctcccacctccggttcaggtaggcgaaatttccgagaaggaacttaaacagtatgatgggtcggatcccaagaagccactccttatggccatcaagggtcagatttatgatgtttctcatagcagaatgttttatggacctggtggaccttatgcattgtttgctggaaaggatgc

SEQ ID NO: 4001 - DNA, 326 bp, Gossypium hirsutum
  Clone ID: uC-gsronu33B139f01b1
tttacttgtgcacgcctcttcaaatcagaagtacagtttggtcatgctggagctaagagtggtggtgagatggagtctgcacagggaaagaatcaagcgctaagggaagctggagctgttgttcccacttcatatgaagctctggaagctacaatcaaggaaacatttgagaaactggttgaagaagggaagattacaccggtcaaggaagttaagcctccacaaatcccagaagatcttaacagtgctattaagagcgggaaaagttcgtgctccaacacatattatttcgacccatctctgatgacagaagggagggaccatgc

SEQ ID NO: 4002 - DNA, 176 bp, Gossypium hirsutum
  Clone ID: uC-gsronu33B139f02b1
tttcttttttagatatctacattttcatcttcttcctgtttctttctgcactttgttttcttcaaatactgccctttcattttgcttagttcttgttaaaaagaaaatgtgtgggattttagctgatctgggctgttctgatgattctcaggcaaataagtggttcgtagtgcctg

SEQ ID NO: 4003 - DNA, 381 bp, Gossypium hirsutum
  Clone ID: uC-gsronu33B139f05b1
ttttaattttaaaagaagcgtaagtgaagaaggagaagatgaaaaaagaaaatggcggaccagcttaccgatgagcagatctctgagttcaaggaggcctttagcctctttgacaaggatggctatggttgcattactaccaaggaactgggtactgtaatgcggtcactcggacagaaccctactgaggcagaactccaagatatgattaatgaagttgacgctgacggaaatgggaccatttatttgcctgaattgttcaaccttatggataggaaaatgaaagacaccggtagtgacaaataacatgcaggatctatactgaagtttgttagtgggttccatggtacaatatccagtgataaacgtatgaacgttttg

SEQ ID NO: 4004 - DNA, 292 bp, Gossypium hirsutum
  Clone ID: uC-gsronu33B139f07b1
tgtgttaaattcaaatgaatcggatttgaattctaaagaatacaaaaaaaaaatagtgttggaaggattgttggaaaggaatcacagggttggataatgaaacttttgtatagagtattttttttttatttacgatgagcaagttagatgtaatcatacgtgttttgctaaagttagcctgttggtcattttgtgtaaaatagaattgaaaaaagggtcaatatattctagaatcatagttcagtttggtttaatttaaaaaaaataaaataacattttttatcttggggcg

SEQ ID NO: 4005 - DNA, 162 bp, Gossypium hirsutum
  Clone ID: uC-gsronu33B139f09b1
tttcgtgttaataaaattaaaaattattattattcaaaaaaaaaaagtgagatgaaaatgttgtggttggcttctttagagctcaaagtttatcaatatttgtctaatttcagtgaatatttgtgaagaatttcatatttgactaatgaattatcatgagtt

SEQ ID NO: 4006 - DNA, 282 bp, Gossypium hirsutum
  Clone ID: uC-gsronu33B139f10b1
gtaattttgggaagactatccttcagtcctctttcgaatgggttcggaaaataatcagtcatcatatctcataattaagttatttcatttttttttggggggttgttgtaaagattattcgcttggttcttcctatagaaatgtataattcgtagtacgaggaaccataatgatgagttgtctgaaataaatgagaatttgtttgatgcctattaaaaaaaaaaaaaaaaaaatatgaaaattaatatttatccaataaaaacaattggggcgtggggtctt

SEQ ID NO: 4007 - DNA, 521 bp, Gossypium hirsutum
  Clone ID: uC-gsronu33B139f12b1
tttatgcggcagcatatgagaggattgtggagttgcagggagaagccctgaaggttcttaaagctcttgaagaagtggtggggcacctgagaaaatttttggttgatcacagtgttcttcctctttttgaaaaaatggatcttcaagcagagacgcaggctgaaaagtcgtctctgcttacggcttctcaaagtggaattggtatcgatcttcctgttacagcaagaggggattctttgttccttgaacatgaaacacagttggagtcacgaattccatcttctggaatttctttctatacacaggatcccacgctttcggcaatatattcttcttctggacttgttcgatctgttgttcctattgtcacacagattgctcaaacaatgcaaataccattttcttatgccgaggacatcattgggataggaggagctaatattgcacatattcgctgcactagtggagctgtcataactgtgcaagagagtaggggcatgtctgatgaaataactgtggaa

SEQ ID NO: 4008 - DNA, 232 bp, Gossypium hirsutum
  Clone ID: uC-gsronu33B139g01b1
cttcacgcttccggaaattttctgtattgatgattttgggggttttccgtttcttctcatggaatttaggttgtgaaatcagaccgtttcttctcatggaatttaggttgtgaaatcagactcaaataagcttggggggccttagttctcgctgagtgttcatggttttttgtttgcttcagtttaaaacaatattttctgcatatacaactgagtgtgctttgcacttttt

SEQ ID NO: 4009 - DNA, 405 bp, Gossypium hirsutum
  Clone ID: uC-gsronu33B139g04b1
cttttatttcctttgccgcccctagggttttattacattccccacatggcttctgcagatgtcgagtaccagtgcttcgtcggaggtctcgcatggaccatcaacgaccgtgctctcgaagaagccttcagtgcttacggcgagatcgtcgattcgaagatcattaacgatcgtgagactggaagatccagaggctttggcttcgttactttccgtgatgagaaatctatgaaagatgctattgaaggaatgaacggtcggagtctcgatggaaggaatataaccgtcaacgaagcacaatctcgccgaagcggcggcggcggtggtggtggaggatttggaggaaacggtgggtacaaccgtggaggcggcggatatggtggtcgccgtgaaagtggatatgga

SEQ ID NO: 4010 - DNA, 528 bp, Gossypium hirsutum
  unsure (1)..(528): unsure at all n locations
  Clone ID: uC-gsronu33B139g05b1
cttgtcgcttggggaagcagctaagaaagatcccgagaaaggtgaggttatcgcgaagaagcattcatggaaggcagcaatggatagagctgccgggattaaggttcacgatgatccaaaattgttgaaacaaagtatacagaaggagaaaaagaggcataagaagaatgctgagaagtggagcgagagagttgaaacaacccataagttgaaagtggagaaacaacagaagagatcggagaatatagcggacaagattcaccagaagaagatgcgacgcatcgcgaagagggagaagaagctgttgcgacctgtgtttgaaggtcgcaaagagggttttattaatgaagggtcaagtcaaggttcctggttttttttgaatctttgcataggctgtggntataactaagcagctgcttttctgatgggaagattacatcgtaggaatgctgttttagcaatgcttccattgtgttcaatttttccacctagagaaaatgggtgaatgttgttcacaaaactgatttg

SEQ ID NO: 4011 - DNA, 429 bp, Gossypium hirsutum
  Clone ID: uC-gsronu33B139g08b1
tttcgttcacgcgtccgggtgtcagaggtggatgggacagtttacttgcagttatacctggaggttcatctgttccacttttacccaagcacatatgtgatgatgtcttgatggattacgatgcactcaaggctgtccagtcaggactgggaactgctgcagtaattgtgatggataaatcaactgatgttgtagatgcaatcgcaaggctttcatacttctacaagcatgagagttgtggacagtgcacaccctgcagggaagggactggatggctctggatgatcatggaaagattgaaagttgggaatgcaaagttggaagagattgacatgcttcaggaggtgaccaagcagattgaagggcacacaatttgcgctttgggtgatgcagcagcttggcctgtgcaggggttttatacggcatttt

SEQ ID NO: 4012 - DNA, 374 bp, Gossypium hirsutum
  Clone ID: uC-gsronu33B139g09b1
tatctctacgcgtccggatggccagccaccgcagtggtgtaacggaggatacttttattgctgatctttcagtcggtttggccacgggccaaattaagaccggagctccatgcaggtctgagcgtttagccaagtacaatcagcttctgcgaattgaggaggagcttggtgcggaagctgtctatgctggagccagcttccgtgctccagttgcaccctattaagatgcttgtttagatgataatttgctgagactggatgcgtgcggcagagcttcagtggtttattgtgaccctaaaacatgtttcaataattttgatagcaattttgtacttgttcagaattatatcaatcttcgtgttatttttgttgga

SEQ ID NO: 4013 - DNA, 436 bp, Gossypium hirsutum
  Clone ID: uC-gsronu33B139g10b1
tttcgaaaagatgatactgcagcagttctcaagtcaaggcttgatgcatttcacaagcaaacccaaccggtgattgattattattccgagaagggaatagtcgcaaagcttcatgcggaaaagcctcagaaagaggttacggacgaagttaagaaagtactttcatgacgaaaccctcattacggacgagattcgtataaggtgatttacacatgaacattggttcttttgcaaacagggaccccccaaaaaattgagaaatttcatggatttttactcgtgtttcgagtacatattcggattcattgttatgtcattgcttttttggcccaaatatcagctgttgtttgttcaagtattggtgatgattatgatacttgaaataatgatatacttatagattgacaactgattaatactttgtgtattataactg

SEQ ID NO: 4014 - DNA, 548 bp, Gossypium hirsutum
  Clone ID: uC-gsronu33B139g12b1
gttcgagcatggcttatactggactcgacatgccaaacccagatggtggaagccggaaaacatgctatcatgagacgtacgggtttgcctgctcgagatcttcggatcttggacccgctgttgtcgtacccatcgacgattcttggtcgagaaagggcgatcgtgattaatttggagcatatcaaggcaatcatcacggcgcaagaggttttgcttttgaattctaaggatcctgcagttactccctttgttgatgagatacagagccgaattttgtgccattatcaagctactaaagaccaggaaggtggagttgatgattccagctacataattcgatcaagttctcaaaatttgtcgtcaaggttttcacagactcaaactcaggatgatgaaggtaaatcagaagagaaacagagtcttgaaaacccaaatggctcgaagattctcccatttgaatttgttgcattggaagcatgccttgaagctgcttgcagctgcttagaaaatgaaacaaagacattggagcaagagggccatccggcctt

SEQ ID NO: 4015 - DNA, 264 bp, Gossypium hirsutum
  Clone ID: uC-gsronu33B139h03b1
cttacgctttcgtccacgcgtccgtgcaattgctggaaagaatctgtatattagattcacttgcagtacaggtgatgctatggggatgaacatggtttccaagggagtgcaaaacgttttggatttccttcaaactgatttccctgacatggatgtcattggcatctctggaaactattgttccgacaaaaaaccggctgcggtaaattggattgaaggacgaggcaaatctgatgtctgtgaagccaccattaaaggtgatgt

SEQ ID NO: 4016 - DNA, 410 bp, Gossypium hirsutum
  Clone ID: uC-gsronu33B139h04b1
atttaaactaaatacaggagtcatttgttttgggggaatgcctgagaaaatggcttgttttcaatatatagtagctgctctatgctttgcagttttacttgagggatcgttatcaaaagctcaactgaccccgacattttacgatgaaacatgcccaaacgtgacagccattatccgacatgtgctcgtgaatgcttcgttttcagatccaaggattggtgccagtctcatcaggcttcacttccatgattgttttgttcaaggatgtgatgcgtcgattttattggacgatcctgtgaatggtgagaaagaagctattccaaataataattcagctaggggttatgaagttattgatgccatgaaagctgccttagagagtgcttgccccaacactgtttcctgcgctg

SEQ ID NO: 4017 - DNA, 425 bp, Gossypium hirsutum
  Clone ID: uC-gsronu33B139h06b1
ttatcattttacttactctaagaatataaacttgttagagtattttttaaaaaatcaagcacatgggtgttgatgctgaacttgcgatcccggtcatcgagtttcggaccggttcgcgggatttggagcgagggactgaaggatggcaccatttgtgcaagagggttcgagaggcttgcgagacctacggttgtttcgaggtggtgtacgaaaagatatcgagagaagtccgagaggagacgtttgagttgttgaatgaactggttgaggtcccgttagagaggaaacaattgaacgttaatcccaagccttaccatagctattttggaccatgtagccaagcttttttgtatgagggcttcggcattgaagatgcccccaactacgactctgttaacaattttgctcaacttatgtggtcggat

SEQ ID NO: 4018 - DNA, 420 bp, Gossypium hirsutum
  unsure (1)..(420): unsure at all n locations
  Clone ID: uC-gsronu33B139h07b1
ttcgttctcgaagtaatgtttaaacccaatgattcaaggcaaagataaaagatcctagaacaaggaaatacccttttccattttctcaacaactagattaaaacgaagaatcgaaatagattctaagcgagacaaacaaaaaaggggttagagaccactcaataaaagaatgcctaaggtttttttttgagcattttgagagttatttgacttgagttatgagagtacgaatgcttttttcttcttttttttttcgaaaaaaaagacgaggttaaatgtctaattgatttgctggtttatggatctttttgacatgctaattccatacattataattccatacatagacataactntaaattaatcatttttttctcgagccgtacgaggagaaaacttcttatacgtttctaggggggg

SEQ ID NO: 4019 - DNA, 415 bp, Gossypium hirsutum
  Clone ID: uC-gsronu33B139h08b1
cttgggttgagtgtagagatgaggaaaatcatgggtgccaaagttcttttcttctttgctttgctttcctttctagctgtctcggcatttgcacaggatgaggaagaccaaggtcttgttatgaacttctacaaggattcttgtcctcaggctgaagacattatcaaggagcaagttaagctactgtaccagcgacacaaaaacactgctttttcttggctgagaaacattttccatgactgtgctgtccagtcatgtgatgcttcactgctgctggactccacaagaaggagcttgtctgagaaggagacagacaggagctttggccctaaggatttcaggtacattgagaccatcaaaagaagcttgagaaagggaatgtcccggagttggttcctgggctgatatccctggt

SEQ ID NO: 4020 - DNA, 455 bp, Gossypium hirsutum
  Clone ID: uC-gsronu33B139h11b1
gtcttgaagaagtaagtggccctttcattgatgatccctgcgcccacttcctttgttcctggtgctgcttaccatactttaatcgaagcttttggggaaagggttaccttgtcgggacacctgacgaattaaaatctgccctttctgaatccttctctgcaaggaagccggttgtgataaatgtgataatcgatccctttgccggtgcagaaagtgggagaatgcagcacaagaattgagggagtttcggttttgtttcgttaaatttcttttttcaccacttaccgagctggtctttttatgtcaatgaataatcggatttgtgcttacttgtgatagaacagaaagggatcatgtcttttgacttttgtagtcaaatgcagtgtgcactgtgttgtatatgacattgataaaatatttcctagtagtaaatgttctcacagttgaatttttaa

SEQ ID NO: 4021 - DNA, 213 bp, Gossypium hirsutum
  Clone ID: uC-gsronu33B143a01b1
ggcgcaagaaacactagccaaggaccaagccagggcgcaaggacagaccagccacgcgcctaaaaaaacgacggcgccgagagccacaggcaggcagaacgagcaaaggccaactcacactgcgaaagccaaaccggaaccccaccacaaaccaggcgcaaagacagggatacaagcagcgacgctgccagggcgccaagcactggctgcaca

SEQ ID NO: 4022 - DNA, 362 bp, Gossypium hirsutum
  Clone ID: uC-gsronu33B143a03b1
ggatagagaaggatcaggatccatcgctttggggtggcattctattaagaccttggtcgggaaaacaacgacggagctatgactgatatgattccgagaaacactaccattgccaccaagaaggagcaggcgctatcaactgaccctgataaccaacccgggggctggatccaagcctatgagggtgagagagctcgaaccctggacaacaatttggagggtaaatgcgagctctcatggcataccaccagcacccagaggagttacccaaattacagtttgcttagacattgatgctaatggtaaattgaatgcctctgctgaggacatgactactggccagaagaacaagattacgatca

SEQ ID NO: 4023 - DNA, 393 bp, Gossypium hirsutum
  Clone ID: uC-gsronu33B143a04b1
agtagtatgcagcaagagcagcaactccccacggggggcgttacaaaaacaccttgggtcaacaaccaaccacagccccccccaaacaaccatcccactacaacaacttaaacccctctcccatcccatcaccccaaaaacccaaactgtaaccagaaaaaaagaacccactatcccccctccataatgttattaaactctccccctctaccaaagaacccaagagtatggatccaagtacgaaacccaaactctcaccctgggcttaacgaaaaagggcctatcagaacggatcccccattgatcaatgagtcatctctttcagcagccaatccctcagcttacagcctagctgagatatggcccaacctgaacaacccaggctctgaccca

SEQ ID NO: 4024 - DNA, 423 bp, Gossypium hirsutum
  Clone ID: uC-gsronu33B143a06b1
cggatcgcgtgggcccacgcgtccggtcagcggaggggggttttttcaatgtcgtggtgggagacccaaacgaacactatggactcggagtcaccaggaacggggaatgatgcgacggctatcacagggccaatcatgttggctaagatgtcagggagaccggagccaaaaagccactggggaaataagatcggaaaacctcatactgggccatgcaaggataccgggaaacgtgtagcccgacaccaacaggatggtgccggcatctacaggtgctggcattggggatgataggacaaccgaaaacctgctaaacaatggcttcaatggaagcatctatccttcatagaggaaatccagccaccctacagctatggatgtcaaggacaactcactatgacgtgagaaaacagatatcaattt

SEQ ID NO: 4025 - DNA, 496 bp, Gossypium hirsutum
  Clone ID: uC-gsronu33B143a07b1
ctaacctgcaagtgttccatgtttacagtcgggggtcatttttgaaaccctcggagaccactctcatgggaagaggatgtgctgcaaacgctagccaaggaccaagccagggtgcagtttttgtccagcctcgtggctaagaaatctgtggtgcctatagcttcaggcaggcagattgtgcaaagtccaacttacattgtgaaggccaatattggaaccccacctcaaaccatgcttatggccatggatacaagcagtgatgctgcttgggtgccttgcactggctgcattggctgctcttctactgcttttgactttgctaaatccaccactttcaagacccttggctgcaagctgttcaatgcaagcagatgccaaaccccacttgcggtggaagcgcgtgcacattcaacatgacctacggtggctcaaccatagccggtaacctttcacaggacaccacaaccttagccactgacccaatcccaaactacac

SEQ ID NO: 4026 - DNA, 432 bp, Gossypium hirsutum
  Clone ID: uC-gsronu33B143a09b1
gttagcttcataaagcggctggctgttttcaagggggtttttaatagcattttgtgttacaatcgccctgttttgtcatcaaaactgaagcttggggttgctcgttgcgataagaatggatttccgattgtagcgccgtctccgaaggagtcttctgcagatagtgagagtgattatggtgatgatgatgcagttgatacaagtaataagaaggagaagcatcacgggccaagtaaggttgtacttggttttgcaattggtatttcttcaatcgttttcctcattattttcttggttctgatcgcaaaatgctgtcgttgaagtgggggaaaagacttttggctatgagttggatctatagatggggaaattggttattccgttgccatttatttattattcatatttaatacacttgatttgggaaaattt

SEQ ID NO: 4027 - DNA, 461 bp, Gossypium hirsutum
  Clone ID: uC-gsronu33B143a10b1
tcacgcgtccgttctttctttggcaatggggaggatttattacacatcttgtgttgtgcaaaaccctgtcgccatgttcaacaccctttgttatcttcttcttcttcttcttcttctccacttttctctatctcagggcctgactttcccgcaggatatttcagctcttaaagccttcaaggcctctatcaagccaacctcaatcccttcatggtcttgtctcgcttcatgggacttcgccgctgccgacccttgcgctctccctcgccgcactcacttcacctgcggcattatttgctccattgactcaactcgtgtcacccaaatcacccttgatcctgctggttactccggccaactcacccctcttctttcccaactcacccaactcactattcttgatctttctgataacagcttcttcgggtctataccttcttccatttcttccctacgtagtc

SEQ ID NO: 4028 - DNA, 125 bp, Gossypium hirsutum
  Clone ID: uC-gsronu33B143a11b1
ctgacgcgtgggttgattcaaaagctgctaggtgggctttcttaacaagattgcttaattatcgaccgcgccttttgattctttggagtaaattttatagtatgataattgattattagagctct

SEQ ID NO: 4029 - DNA, 290 bp, Gossypium hirsutum
  Clone ID: uC-gsronu33B143b01b1
ccaccccgcaatacccttctcgatccacccccccggactaataacccccggccacaaacccaaaaaaggggcgcctttaagaaccatatgcggtacaacaccccccaaccacgaacccaaagacaaaccaacccaaagacaacaacacaaaccaacacccaacacccccaacacccacaaaaccacggcaaaacccaaaacaatacccacccaagacaccacccatcacccaaccacagaaaaaaccaacacacccggaccaacccccggaaccaacacaaacaccaaac

SEQ ID NO: 4030 - DNA, 477 bp, Gossypium hirsutum
  Clone ID: uC-gsronu33B143b02b1
ccctcgcgtccgccaaaaaaaaaaaaaaaaaaaagaggaattaaaaaaaaaatgggggaaaaacccccccacccaaacaaaaaacaggccccgccccccaaaaggaccccgcaccccccccgggccccaccgccacacccaggcgaccgggaacccccaggcagtcccccgcccaaccgccaccaccccaggccccccacaccctcgggccgcccaaccaaaaagccccggccgcaccgcccccccaacccattgcgcagcctgaagggcgaacgggacccgcccggcaacgccgccaaaagcgcggccgggcaggggaaaccccccccccccccccctccacctcccacgccccggagggggggcccacccgcatcctgccctcccacctcgccacgtccccggccccccccgtcaagcccaaaaccggggcgccccttccggggccccccccagcccccccccgcccccagaccc

SEQ ID NO: 4031 - DNA, 321 bp, Gossypium hirsutum
  Clone ID: uC-gsronu33B143b04b1
ccattcggaaggtgaagagaaactggctgaagggaggatttaaagagaggttgggttgcatgacgcctcgcctaattaggagaatcaaaaagacgagactaactagtcactagattcccagattgcagctctcagccaggatattgtcaagaaggtgcttcctctctaaaaacccacttcatatttggtttaactacgagtcaataatgttaatataggcctgaaaccatctgtgtatttaatatgatctggcattgtacaacaagggacaactctctgtactccaatgaaatctgaaccctgtattcggtatttatggat

SEQ ID NO: 4032 - DNA, 271 bp, Gossypium hirsutum
  Clone ID: uC-gsronu33B143b05b1
ccgtgagtaaattgatcactctaatgttggtgggagggttcctactctgtttattacagccaatcctctagtggaaatgtaatcctcaaacttcagtttgattacagttgtggttttccaattgcatatttttatagtaaaagttatagaaatcaagttcggttctatatcattcatttttgtatttctcccaaaaatgaactctttcttggaaaagaaagggttctttcttaatctatcaaaatagtctcttcttttctttaaagaaaaa

SEQ ID NO: 4033 - DNA, 497 bp, Gossypium hirsutum
  unsure (1)..(497): unsure at all n locations
  Clone ID: uC-gsronu33B143b06b1
gttgtgcttatcttctggttctgcaccaactcggtgtgacttttatagnttatgtctggtacaataacgacacggaaaagaaagaatttggtcttctttttacaaagtgttcacagaacttgacgctgttaggggcattgctgttcttcattggcatgaagaactcaatccccacaagacaactgaagaaaaaggctccgaaaaccaaaacagtttgaagacgtaacacatccggttaaaaccgaagagggtctggtttttctcgttcgatcttaatttgtatacctcggtgtaactagatctgtttctgtatgcttgtaccaaggctttgttgtcctgtcgaagttcatagctatttaatttgagttccacaaaaggatttcataatttttcccttcaatctgctgtttacctttatggattttgccattctcatggaacttttaatcatggaatcgtggtggatctagatgatatattaggaaatatacttatga

SEQ ID NO: 4034 - DNA, 430 bp, Gossypium hirsutum
  Clone ID: uC-gsronu33B143b08b1
atccatagaaagcaagccattaaggttttgaggagggattttatatggattcaaagtgatcagctcccacagccctccttttagccctcaacattctcttcttttccctagtcagtgctaattgtggatcttgttcttcttctggctctaacccaaggccaactcccacccctactccatctgcacgaggtaggtgccctagggatgccctcaaattaggtgtatgtgccaatgtgcttaacttagtcaatgtcaccgttggttcacccccggtgatgccatgttgttcccttctcaacggtcttgtggacctcgaagccgctgcttgcctttgcaccgctatcagagctaacatcttaggcatcaaccttaacatcccaagttcccttagcttgcttctcaacgtttgctcaggaatgttcctactggt

SEQ ID NO: 4035 - DNA, 380 bp, Gossypium hirsutum
  unsure (1)..(380): unsure at all n locations
  Clone ID: uC-gsronu33B143b10b1
tggtaaaagaagcctaaactaggaggctcgggaggtttcaactagtgttgttgcagagcaaagcggattctgaaatttatttgagaaatgaactgccagtgacgagtggtagaaacattacgatgatagattgatgatgatcatgtatttttggcagtttatcaaaggataaaaagcatgtattaggggtttgccggctgaccttaacaatgctttggtgatacgatctggtgtggactgtaaattttgtaattgagccaagtctataacagatacttactgttgagtcaatctgaggttgtaacccaaccagacattgtatgagaattcaattttcagttttaataatttctctgaaaataaaccaacttactttccna

SEQ ID NO: 4036 - DNA, 470 bp, Gossypium hirsutum
  Clone ID: uC-gsronu33B143c01b1
gggtacaatggttcgcattacgggtggtatgagggtgaatgctgatagggatgagtcttccccttatgccgccatgcttgcagcacaagatgtttctcaacgctgcaaggagtttgggtattacagcccttcatataaagcttcgagctactggagggaacaaaaccaagacacctggtcctggtgcccagtcagcacttagagccctcgctcgttctggcatgaaaattggacgcatagaggatgtcacccccattcccaccgatagtactcgtagaaagggtggcagacgcggaagaaggctgtgattctttgcttcatatctgctactcagccgctgctgctggcggcctgacattaggaattctctttgcttttgaaacaatcttctgattagattcaagtatgctttgctctggtcttatgttgcacacttgtagttcctggatggattctgatccttgaatctt

SEQ ID NO: 4037 - DNA, 482 bp, Gossypium hirsutum
  Clone ID: uC-gsronu33B143c03b1
caaataagtgtttaagttccatcaatttgattgggaggttataaaagatgccttggatggcaagttacctagcttgagtgtgattgaaccaaggtattttgatcttaaagggttacctgctaatgatgatcatccatcacatgatgtggctaatggtcaaaagttggtcaaagaagtgtatgagacattgagggcaagccctcaatggaacgaaacattgttggtgattacttatgatgaacatggtgggttttatgatcatgttaagacaccatttgttaatgttccaaaccctgatgggaacactggtcctgctccttctttcttcaagcttgatagacttggtgttcgtgttcctactattatggtctctccttggatcaagacaggcactgtgataagtggtccaaaaggaccaacaccaaactcaaaatttgagcactcatcaatccctgcaacataaagaaaatcttcaacctttc

SEQ ID NO: 4038 - DNA, 414 bp, Gossypium hirsutum
  Clone ID: uC-gsronu33B143c04b1
ccatgtgtccgcccacgcgtccgatccccttcggggggtcttttgaacattctccaatggcagacaccaagatgtatatttctcaaacagagcttgaaaaccacaaaaaacccaggagatctatggatctctatacagggaaagatctacaacgtcactgaatggagtcgagaacaccctggaggagcacttcctttgctgaatctggctggccaagatgccaccgatgcctttgtagcctatcatcctggcttagcttggcaatatcttgacaagttctctactgggtattatctcaaagattactctgtctgcgaggtatccaaagatttcagaaaacttgctgctgagttttcaaaaatgggtctctctgaaaagaaggaacacgggacaggcattctgctttgcattata

SEQ ID NO: 4039 - DNA, 455 bp, Gossypium hirsutum
  unsure (1)..(455): unsure at all n locations
  Clone ID: uC-gsronu33B143c05b1
cttattttccgttttgggcaatcaataanngaaggtgttatgtctaaagacttttagggtgacgcccagccccaagccaaggactaccatgatcctccaccagctccattagtggacggggaggagctgacaaagtggtcattttatagggctgtaatagccgagtttattgccacgctcttatttttatacatcactgtgttgacagtgatcggatacaagagtcaggttgaccctgataagggcagtgacgaatgcggcggtgttggcattcttggcattgcttgggcttttggtgggatgatctttatccttgtttactgcactgctggtatctctggaggacacatcaacccagcagtgacctttgggcttttcttggctaggaaggtgtccttagatcgagccatattttatatggctgctcaatgattgggagccatatggggatgtgg

SEQ ID NO: 4040 - DNA, 415 bp, Gossypium hirsutum
  unsure (1)..(415): unsure at all n locations
  Clone ID: uC-gsronu33B143c06b1
tgttgtatcaaacagnggaaaccccctnngcgnnataggtaaattgaaccaatactccgaacaaccccacaaagcaagngactctttcccctttaagtggataaacaaaaaatgggagagagggtttttatgtcacctcgatgacaactgctggaagccgatggggcgttgttatgtctcgcaatgcaggcttcagtgatcaggttgtggaacttgattttctctatccaagtgaaggaatccacagacgttgggatagtggttatagaatcacatcgacagctgcaactntggatcaagctgctctaatcttgagcatccctaagcgcaaacccggtgatgaaactcaagaaactttacgcacatctcagtttccagcattcatgtaagggaaaatgggcaaaaatctctatct

SEQ ID NO: 4041 - DNA, 512 bp, Gossypium hirsutum
  Clone ID: uC-gsronu33B143c07b1
gtcacaccaggatcagacacagctgctcgctgtaaacttaactcaacttgccatgtatgacatgaggaaaatggcgtgcataaagcagctggctctaggagaagcttcagcataaatctaccatgcaacattttcatgtgatagccagctagtgaacaccagtcacgcggatggaacagtgcgcatatttggcgcctcaaatcttcaattacaacgccagataaatcccgccgcttatctcccatccaatgccagctcaactgattatccgcttgtggttgctgcacatccccaagaacccaaccagtttgccataggcctaactgatggccgcgcttacgtgttggaaccacttgagtctgaaggagaaggggatgtgagtgccccaacctcaacgcattgagaatggatccacaagtaccatttctactcaagttgcagacttggatcaacccataccccaaccccagggctaatatttcaaaccaatgcagacttaggttatttagagc

SEQ ID NO: 4042 - DNA, 430 bp, Gossypium hirsutum
  Clone ID: uC-gsronu33B143c10b1
ttaacttctacaagccggcgaggaaaggaagagcggatagggtgaaaaatgccaggtggtcacggtctccgatctcggactagggatctgttttccagacccttcagaaaagaagggttacatcccattgtccacttacctcaggacctacaagatcggtgactatgttgacgtcaaggtaaatggtgccgttcacaagggtatgccccacaagttctaccatggccgcactggtcgtgtctggaacgttaccaagcgcgccatcggcgttgaggtcaacacagcaggttggtaaccggattataaggaagaggattcatgtcagagtggagcatgttcaaccttcaaggtgcactgaggaattcaagctgaggaagctgaaaaatgatcagcttaaggcagaggccaaggcaggggtgaggtgattagc

SEQ ID NO: 4043 - DNA, 472 bp, Gossypium hirsutum
  unsure (1)..(472): unsure at all n locations
  Clone ID: uC-gsronu33B143c12b1
tcntgttcgacatctacaagaatatcgacagaagctcatttgtgaagtgtcctgtgctgataatccatggaactaatgatgacgttgttgactgctctcatgggaaggcaactctgggaactgtgccaagaaaaatatgaaccgttatgggtgaaaggaggaaatcactgtgatttggaactgtacccggattatattaggcatctcaagaaattcatctcaacagttgagaagtcaccttctcgaagaaatgcttctcggaaaagtacagatggtattgaacagtctaggcaaagtactgaatattttgaggctccgagaagaagtatcgaccgcagggagaaaccaaggaaaagcaccgatacccgggacaagccaaggaaaagcaccgatcccgggaaaaaccaaggaaaagcatcgataggcctgaaaagctgaaagttcatgagcacaacanattcaataacatgga

SEQ ID NO: 4044 - DNA, 387 bp, Gossypium hirsutum
  unsure (1)..(387): unsure at all n locations
  Clone ID: uC-gsronu33B143d02b1
gcgtcgagaagaagaaatgcaggaactgaacaaagggacaacttccaaaatgttctggttgtcgcacctctcactgattctttgcctatcagcagcgggatgacaattttggcattggaaaactttctacgagaagaagaagcttatttaagtttgtaagaccataggtttctttacctgtactgttgcaaaatattctgacacaaataattttctaggtctcatagctggaataggtctctgtcatgtgaactgtgtaatatctgtggggctaccttctataatggatgaagcttggggagagagtgaggtcaggggatacacaatgacaagcttggcagtagtcatcattacctatgttattcatactcttcattntttttaaag

SEQ ID NO: 4045 - DNA, 379 bp, Gossypium hirsutum
  Clone ID: uC-gsronu33B143d03b1
cccatgcgtccgcggacgcgtggggagaatacggggggtttcattgaactcaccgggggcagcacccgccggcaagcggtaaacatacccccgggagctttatgaaatcaacgagacaggagagggaggagtgatcatagactgcgggactgccatcactcggctgcaaactcaggcatataacgcgctgcgagacgcgattgagaaacagacacaggggttgccgagcgcgagcggggaggcgttgggcgacacgtgatacgactaggcgactaagagcaccgtgaaggtgccaacgggtggcgttccatttggggggagggaaaacactcgatataccggctacaaatacttgaagcacccgggactcctcgggaac

SEQ ID NO: 4046 - DNA, 356 bp, Gossypium hirsutum
  Clone ID: uC-gsronu33B143d05b1
ggaaccccgcccacccccgaatggagtccagcagccattaaatgtgcccgcaggaccacagctcatacagcttataaaacggacggagagatcgaagatgttgccactggaggagcagctgctaccgtttgattatggtgccggacatgccgacccattggcagcccttgatcccggccttgtataccaagccacattgggtgacgggcctaggattactttgtgctgtgcactacacaccaaattgctcgaagacgcgtaactggaacagagtaaagacccagagcacgaaagagctcagcctgacagagcctagacatctacggtgctttgcttctttgatagtgcgacaggca

SEQ ID NO: 4047 - DNA, 438 bp, Gossypium hirsutum
  Clone ID: uC-gsronu33B143d09b1
tgactctcaggcaaaaagggttcgggtgctgggggttttctaaaagctcatggtgcgttgaccagactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgcgatgttatttcccatctgtatgaggagtatggtgaagactttgaggacatgttagatggaatcttctcatttgcgctgctggatacccgagacaacagctatctcgttgcacgcgatgctattggtgtcacctccctctatattggctggggacttgatggttcggtttggatatc

SEQ ID NO: 4048 - DNA, 463 bp, Gossypium hirsutum
  unsure (1)..(463): unsure at all n locations
  Clone ID: uC-gsronu33B143d10b1
atcatttcaggcacatcaatgtcttgcccgggtgttagtggcttagctgcaattgtcaaggctgctcatcctgaatggagtccagcagccattaaatctgccctcatgaccacagcttatacagcttataaaactggtcaaaagatcgaagatgttgccactggaggaccagcaacgccgtttgattatggtgccggacatgccgacccagttgcagcccttgatcccggccttgtatacgatgccactatcgatgactacctcggttttctttgtgctttgaactacacaccaaatcaaattaagagcactacccacagagacttcacttgccagacaagtaaaaagtacaccttgggagattntaactacccatccttctctgttcctctggaaactgcgtcaggcagaaggggtggtgctgacctctcaagcatcatcaaatatactaggacccttacta

SEQ ID NO: 4049 - DNA, 484 bp, Gossypium hirsutum
  Clone ID: uC-gsronu33B143d11b1
ttctctccgcagcagttctcctccgccgttggaggccttttccatgtccgaccagaggacgacgaaatgaggacgctctccgacgaatctcgcaacggtacaagcgtgtggcgtgcgcggagtgttgaacgtgggacggtgtggagactgccgaacgtggggcatgtggcgctgctaattgttgctagggtttttgctgttttaggccaattgggccctgtaattgggtttagcttggcccaagttttattgggtttgggcccaggtatatttgggcttgtacagttgtccctctttgctcgttgtcgtgtaactggaacagagtaaagactaaaagtccaattgtgctcggtcttactaagccttgacttcttcggtgcttttcttctttaaatagcctgattccttcctattgcatcttcagaggtataggaactgggggctctatgtactctactgcaatgtcggggtgatagggattcta

SEQ ID NO: 4050 - DNA, 506 bp, Gossypium hirsutum
  Clone ID: uC-gsronu33B143e01b1
gaataaataaacttaaaaaggtgatggctggtgggttcgattaaaacccgttcgctgtagaaggagaagaagaagttaatcctttctcggatccagctgtgagagggaaggcatctggccagcctaaatttggtggaggtctattttcaaagaatgttccaagtgctccacctgcatcaaactcaagactttcaccactacctcctgaacctgctggtttcaattatggtcatgaggcaacaattgacatccctcttgatacagcttcaggaggatcaagttatcaggatttgaagaagaaggagaaggaacttcaggctaaggaggctgaactgagaaggcgggagcaggaagtgagacggaaagaagaggcagcagcaagagctggaattactttggaagagaaaaattggcccccattttttccaatcattcatcatgatattgcaaatgacataccagttcatctacaaagattgcagtatgttgcattttcaacattttta

SEQ ID NO: 4051 - DNA, 333 bp, Gossypium hirsutum
  Clone ID: uC-gsronu33B143e02b1
taatgctcccataagggtagggttaaaggcccatgctcgctcgaccgccgatactgcaccgcagatgatggccgaggcgtaaaccgacggttctcttagtcacggggagaccgcgagtagaggcctggtgctttgtctgagacaaccggacgactaaggaggacttgggtgcgatcagaccagccttaggctgctgcaagggcaccatcgccggagaaacatccgcaccgacagaggaggtgaggctcctcaggtacgtctagttctgccgccgataaagggaaagcaggattgctaggagcagagatcgaacacgaaagaggcacgaggcca

SEQ ID NO: 4052 - DNA, 402 bp, Gossypium hirsutum
  Clone ID: uC-gsronu33B143e03b1
cccatgcttccgataggcatatgaattacactcgggggtcttaattgaccttacgttgggtgacatccaacagacgcttattcttaacggctgtcacccacttccacggcggcgttgctatactagaaccccatcgaaaccgccttcttcacttccgctaactggtttgccgacttcactccccgattccggcgctatatgggacaaatactcgtgttaatgtttcgcttgcttgacctaaaacaaccccactgggttggatctcaacgctcaacgctctgaccttctaaaatacacttcggaactcgatcttcccttgacgcaattcatgcaattggccaaatcggctaactcaccgatccgtctcgagattgacataggcggaggaaccggaactttcgc

SEQ ID NO: 4053 - DNA, 466 bp, Gossypium hirsutum
  Clone ID: uC-gsronu33B143e04b1
cccatgcttccgcttttttttttggggggggggtatggatttgttataaaattcttgggctgcttctacttcgtctcgtatgtatcaacatggatttttcagtgccaaaatccaaattaccatcagactatactgctggaatagtcgttgccttctatgtaagttttttattttttttcttttcccgttttggtcttgaattttgattcatcgtcacaataaaaacttaaaattccagattaacaaatcctttctaaaagctattcatacaaagaacggggaattgaatatgaatcatggcggcggctaacggaattgaattgttttatttgtgtctggtgctatggtcaaatcagacatcaaacggtgacgtattcgagaaaaaccacgatgaattagacatcgagtttttaggaaatattgaaggtaaaccatggagattcagacatatgtgtatgggaatggc

SEQ ID NO: 4054 - DNA, 446 bp, Gossypium hirsutum
  Clone ID: uC-gsronu33B143e05b1
gaaatactgacagataaatcattttctctctccccgggccccctttaaccaaattttagatctcacgccgagaaaaagagaatcagctcagacttcgatcatcacctttagggatttctaaatttcataatcagattcttagttattcgaaaccctaatattcagatcagggtgaccggttagtgtttgcagaaaatgatcttgcttgaaaggtaggaagttccgaactgaatcgatctagtatacgaaatatctgatcaagatttgacctttccgtcagctaagtttcatgtctgatcttgacatccaaattcctactgcctttgatccgtttgctgatgcaaatgctgaggactctggtgctggtaccaaggagtacgtgtacattcgtatccaacaacggaatggtaggaaaagcttgactactgtccaagggttgaagaaag

SEQ ID NO: 4055 - DNA, 426 bp, Gossypium hirsutum
  Clone ID: uC-gsronu33B143e07b1
tcacgcgtccgattgctttactccccctagggttaattttaaaggaatagcgtcgtttggatttttcatagtttttatcatttcatttccgagacaaaaaccgagtttctccttattcacagggttataacgagttgtatcgagttgcattgcctgagataaccgaggttctaagatccatctgtaagagatatgaactgcctttggctctaacatgggcaccatcccggcattccgataagaacttctattgttgcgtttcgacctcgggttcctcttgtttcgtagctgatgaaggccttacaggattcctagaagcgtgttccgaacaccagttgtttcgaggccaaggtattgttggtagagcttacgacgaacaaaccatgtttcgcaactgatataacgagcttcagcaagacaatttat

SEQ ID NO: 4056 - DNA, 467 bp, Gossypium hirsutum
  Clone ID: uC-gsronu33B143e09b1
tgataaataaaaagaaaagaaaaattcaggttgggggtattacacagctttgttttggttaactccttttcgtccaccatatttgcccccaatatgaagatcttgttctcgaaagttctaacgaacaccgatatacagaaaagattggcggttcccaacaattcactgaagcatttcgagcttgaaaatggtaattgctccaaatcatttgaagttaaagatgaaaacggattcacatggccttttcgttgctatgttcgtaacgacggtgcctacaagaagcctgttttatccagcggttggcgtcaatttgtccttaataaaggagttcaccagggggatttgattacactctataaggatgttgaagcagaagcttcgtataagatcgaagttcagagaaaaatcaagttattaggcaaggagtgctggtataatctggaaccagaccaacctacaggcgcaac

SEQ ID NO: 4057 - DNA, 459 bp, Gossypium hirsutum
  Clone ID: uC-gsronu33B143e10b1
ctcacgcgtccgcccacgcgtccgcatcactaaggagaggtttaatcttgtttctggtgctgctccatttgctaaggatccaggacagatagtgggacttagagaggggggcttctctacttgaagtggttaaaaaggtcaaacctgatgtgcttcttggtttgtctggagttggcggtgtgttcagtgaagaggtgctcaaggctttgcgtgaatctggttcaactagacctgctatttttgcaatgtcaaatcccaccatgaatgctgaatgcactgcagcagatgcttttaagcatgctggagaaaacatagtgttcgccagtggaagccctttcgaaaatatcaatcttggtaatggaaaagtgggctatgtaaatcaagcatataacatgtacctgttcccagggattggttgggaaagtttgtctcaagtgctcgctttataactgatggaat

SEQ ID NO: 4058 - DNA, 427 bp, Gossypium hirsutum
  Clone ID: uC-gsronu33B143e11b1
tcctcgcgtccggtttgatgaaattgtcaagggggtctcttttaatcttattttggttggctacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaagttaagtctgttgagatgcaccatgaatccctcccggaagctttccctggtgacaatgttgggttcaacgttaagacgttgctg

SEQ ID NO: 4059 - DNA, 416 bp, Gossypium hirsutum
  Clone ID: uC-gsronu33B143e12b1
tgatggcaaatggaggaaactcgaaagcgccggggatcctttagaacaaggtaacgccgacttcggcggtgttacgaggatgtgggaaggtgaagttgttcttgcatgtcatggaggaccgccgcctcgctctagaatctggctgttgcccctgctatagatttgggaagaacatgcggcgggctggtttaggaatttgtttgcttcagggaactgtttatttcatcctcgcagtcactgctattctcaactttgttgccttcttcgttaccaagcggcattgctttctgtatttgggtgttactttcatcttgtctattggagcatatttgggcttcttgcgtagacagataaaaagaaaattcaatattaggggcaatgatagcttattggatgactgcgtctaccatctgatc

SEQ ID NO: 4060 - DNA, 440 bp, Gossypium hirsutum
  Clone ID: uC-gsronu33B143f03b1
acgtagaaaaaacgtgatctttctgtgaaagaggggcatgtttttcaaatggagtgctgtgaggagaggcccatacttgagagcaatgtggggatgggtgcgaacttgtgcacctaccatcagaaaaaatctcttggtgaccaaactagtggatcgatatgcaatggaaacgaaacctagggaaatgttctgcttctagagccagctgataaatcaccttttattggagatatcaaagctggctatagccagtcatctctagaaacaaacatgcacaaggctgacatattaacccacaaggtgccatcaactgacttactattggctaggacaccaaaaggaaagctgtccatacgacgtatggataggattgctggtgcaggacaacaggagcctctcatggaggtatctgctcctggatcaagaatatcagacatatc

SEQ ID NO: 4061 - DNA, 432 bp, Gossypium hirsutum
  unsure (1)..(432): unsure at all n locations
  Clone ID: uC-gsronu33B143f05b1
caggtanttggatctggctcacattgaagagcatgggaaatctttcaaggccattggtggtgatgtctcatggcacatccatgatgagagatctcttctagctctccagggtcctcttgctgcccctgttcttcaacacctgacaaaggatgatttgagtaagttatattttggggaattccgaatattggatatcaacggtgcaacatgttttctcactcggacagggtacaccggtgaggatgggtttgaaatctcagttccttcagaaaatgctctggatcttgcccaagcaatcttggagaaatcggaaggaaaggtaaggttgacaggacttggagctcgagacagtcttcgactcgaagctggcctatgtttatatggccatgacatgggacaacacatttcaccagtcgaagctggactgacatg

SEQ ID NO: 4062 - DNA, 277 bp, Gossypium hirsutum
  Clone ID: uC-gsronu33B143f06b1
gcgtcacgatgccgaacggcttgtgattgactgggtggagtttcataatagccttttctgtgtgtttcgacaaacttattcaacatgttttgtgtttatttttggtttgcttaagatggtgtatgaaataagacaatcagcattttgtttacacatattttcttctctcaaggatttttacttaaatttgaagattttggataatcattcattttttgggaatctattgtcatctttggtctaaaaaaaaaaaaaaaaaaaataaaatggacatact

SEQ ID NO: 4063 - DNA, 499 bp, Gossypium hirsutum
  Clone ID: uC-gsronu33B143f08b1
gcggtaattgcccatttttaggactttctttatgcggagtgtttttaaaatgattgtaggtgaaaccgaattccataatgggatcgtcagtcaccgacggcgagatcgtgtgcgtaacaggcggctctgggttcattggttcatggctcatcaagctgctcttggaacgcggttatgtcgtccgagccactgtgcgcgaccctggcaactcgaagaaggtgaagcatttactagagctacctaaagcagagacgcacttgactctttggaaagcagatttagctgaagagggaagctttgatgatgcaattcaagcttgtacgggtgtgttccatgtggccacgcctatggacttcgagtccgaggaccctgagaatgaagtcataaaaccaacaatcaatggagtgctaagcatcatgaaagcttgcgccaaaagccaaacttgtagaaggttagtgttcacatcatcagctggaactattgaatgtgcagaacaaca

SEQ ID NO: 4064 - DNA, 416 bp, Gossypium hirsutum
  Clone ID: uC-gsronu33B143f09b1
tccacgcgtacgcccacgcgaacgcccacgggtgcgcttatatccagggttgggcattctcaccggtgaacatgctgaggatcatggatatactgcctgagcttcctgcatcgatctctacactggtgactctctgcgtcttcgtcctgaagacgaagatacagtaaaacttaagctcaatgacattggattagacttttcatggacagtcggaagaatcaaggaagtgctatcccacttaggttctccattttcttcgacacccacataatgctctttggagaccattaaatctctcgccactattgttgatgagcaaagttgccccgagacaaagattggactcgctactggggattatgcgtttctttggttgtacacctctatattaggggttaagccggctacagtcaccg

SEQ ID NO: 4065 - DNA, 478 bp, Gossypium hirsutum
  Clone ID: uC-gsronu33B143f10b1
tcgtcatttctgtccctgaacttattttcaggctgtgattttcaacgtgtccacttgtcaattgatccattccttttatttttaaaaatgttttttctagtcatatttgattctcaatatgtgtgcacattctgtctgctttcttcagttactttaattgtatttcttttttaaaaaatttggttacttccatatgattccttatggtttcccaaaggttgacaagtctcttactgctgtccactaatatgttccatttctcttcacaagctaactggattgagtattacgttgaatacctaattgctgacatcacttatattatccagaaatcactattgtaaacaatcttccatagaactttcgggttcaaaatagttctttcattcacatgattatatgtatgcattttgcaaatgttcatttctagtaagtgttaactgtaccattttatatgggaattgtttatgtagtcatg

SEQ ID NO: 4066 - DNA, 223 bp, Gossypium hirsutum
  Clone ID: uC-gsronu33B143f11b1
tcctcgcgtccggctatatacgcatatcatatggggatctttaaatattaagttggtaattaacaataataaaaggactggatgattcgaatgaagaatcgttaaaccgatggagaaaaaaactatcactgcaatttcatggagtttccgagagagaggaacgacagacgtaggaacctcttttgtacatatttcttttttttttatagataatcgtatatat

SEQ ID NO: 4067 - DNA, 473 bp, Gossypium hirsutum
  Clone ID: uC-gsronu33B143f12b1
tcgctgttgacatggtatcgatgtgtttgagcgggaattctacattgtttcctttggtgctgatatggagatatacttcccttacaccgaagagaagcggaggttgaagcaattccatcctgagatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggctgaaatgaagaaaatgtttgagctgatcgacaagtacaacttgaacggccaattcagatggatatcatctcaaatgaacagaatccgaaatggtgaactttaccgatacatttgcgacacgaaag

SEQ ID NO: 4068 - DNA, 72 bp, Gossypium hirsutum
  Clone ID: uC-gsronu33B143g01b1
aacaataaattcaaacaaaaaaaaaaaaaaaaaaaggagggttttttaaaaaatttttgtgggggccccccc

SEQ ID NO: 4069 - DNA, 208 bp, Gossypium hirsutum
  Clone ID: uC-gsronu33B143g02b1
gcctaacgcgtgcgacacaagataggaatcgcaggggcaatgtttgacatgtttgtgggcacaccccctcaagggcttactactcagatcgtgacaacccaaatcgcttcagctaccctcaatcttcagacaggtgacagaggaaaaattggcatcacttccaatgcagcactcagaccccaaagctcgctcttccctgctgcactgt

SEQ ID NO: 4070 - DNA, 387 bp, Gossypium hirsutum
  Clone ID: uC-gsronu33B143g03b1
cagtgatggacaaacctctcacaggccctcgccgggggcattttaaactacggcagggggcatggcaccaaagaaagacaaagcccctgctacttcatacaagcctgcaaagactgcaggtgccacgcagaacaagaagaagaggggcaagggaaagctaaaggagcaggcgaagaccaaggagctggtcgatcaggctaccaatgacaagctgagctatgaagccccgaaatacaaggagaggactgactctatactaacagagcgtgagaggacaaatggaccacacgcacggcaggctatcacggaactgagggccagaggatagatcaggttcggaggatgaccgttcaagccagcagatctacactagggctacaaacacct

SEQ ID NO: 4071 - DNA, 429 bp, Gossypium hirsutum
  unsure (1)..(429): unsure at all n locations
  Clone ID: uC-gsronu33B143g05b1
gcaataactcatccaccaattgaatcaggttggggaggatttatggagaatattatgggttgcaaaccataattactgatgtctccgccgctgcttggcgtggaggaagaaagggattcagagcaatgttactttactcggttcttcaggctcaatggaaagtgtgtgccagaatagtgctgacttgaaggaacggaactacatgggcttgtctgattgttcttcagtggatagctctgttttttcccctccgtccgaggaaagaaaggctagtttgaatctaaaggcgactgagcttaggctcggacttcctggattgcagtcgcctgaaagaaatccagagctttgcttgttaagttcttctcagcttgatgagaagccgnttttccctttgcatccttcaagtgatggtcactgctttgcatcaca

SEQ ID NO: 4072 - DNA, 447 bp, Gossypium hirsutum
  Clone ID: uC-gsronu33B143g08b1
agtcacgcgtccggtatgagaagaggatcaccgggctttttttggaaggaagggcgggccagcccccaagggagctaaaagaaagttgggaactcacaaaagggcaaagaagaagcgcgaagagatgtccagcgttctccgcaagatgagagcccacggcggaggtgcagaaaagaagaaataaagctctattctcttggattcttactgttgccgtgctcgagtttcttgtctaggagcagctagaggcttgtctagcatatgtttcatttttgatgttatgagactgaaatcagggctttggaactcttggctattcgagttagagatgagaaattggaagaagtaataactatcaaattttatgttgcttgaattatatttaacgccattactatgctacgcgcaaaagaaagagaaccaccaggggaagagctggattgaaac

SEQ ID NO: 4073 - DNA, 534 bp, Gossypium hirsutum
  Clone ID: uC-gsronu33B143g09b1
atcatgctcgtgcaatttcattgtctttgaagagggcatattaagagaaagctgtgcgtatgccgaaggatcattacgaacaaatgggaacttatgattcaaatgataaaactacggaaacgactaataacagctcgaagataggaaactcttcacttagacaacgaccagtgactcatgaatctgtccatgatactcaaaatcatcttctgagtaaagattccttgaattctaatgagtgggttgatatttcacagaaagagcttgatgaagcaattatgctggagacccaactttttagccagattcctgaaggcagttcgtatatcctttctcatgagcaaggtggtccgggtagaagcattaatcctggtctagaggctgtatctggtccacaaccatcctctataatggaccaatgtttactgcggcaacagcaggatgaggagtatctgatatctctattagctgacaaagaaaaggagatgaatgctcttaagaaagctgaaatcatagtttgaaagagaatctctc

SEQ ID NO: 4074 - DNA, 452 bp, Gossypium hirsutum
  unsure (1)..(452): unsure at all n locations
  Clone ID: uC-gsronu33B143g10b1
ataaaaaaccaaaaaaaaaaaaaaaaacccggagagattaaaaaaaaaaaatgggggaaaaaccccccaaaaaaaaaaaaaaaaaaaaaaaaaaaacaaaaaaaaacacaaaangggccccccccccaaaaggaccccaccttcccccccccccccgcccacacaaaacccccaaaagggggcccccaaaaaaaaatccccggcccccccttacccccccgggggccgggaaaaccccgggggtccccccccaaaaccccctaacaacaccccccccttaccccaagggcgccaaaaccaaagcgcccccccccaaccccccctcccccagaagcccccccgaaagggcaaagggacccccccccaaaccgggccaaaaacccgcccttccctgtgcacccccccccgggagcccccccccttcccaccccccaacccccccccccaggaac

SEQ ID NO: 4075 - DNA, 370 bp, Gossypium hirsutum
  Clone ID: uC-gsronu33B143h01b1
gatatgtgccgactctccaaagaagaaattgaagagaggtttcaagaagcatagggatacaaacccgaagatgaagaacataaaaagaaggtcgaggcaaagaatgcattggaaaactatgcatacaatatgaggaacacagtgaaggacgagaagattggtgctaaactcccagcagctgataaaaagaagattgaagatgctattgaacaagccattcaatggctagacagcaaccaactcgccgaagccgatgaatttgaagacaagatgaaggagttggagagtatttgcaaccccatcattgctaagatgtaccaaggtgccggcggcgacatggggtggcatggatgaggatgctccggctggt

SEQ ID NO: 4076 - DNA, 102 bp, Gossypium hirsutum
  Clone ID: uC-gsronu33B143h04b1
ccgattaattttttttttttttttttttttttttggtgtttttttataaaatttttttgtggtcaaacaccctttttttttattatatttttttttttgcgc

SEQ ID NO: 4077 - DNA, 140 bp, Gossypium hirsutum
  Clone ID: uC-gsronu33B143h06b1
gagtgacaatgtgatgtgatgatgaagtggggggtgtgatttgttaatggacagtgactcatgtctggtatagtcttgtttaaatgtgtttttgcttaatcgaaagttgctttgccacacagtagtggctttggttgttt

SEQ ID NO: 4078 - DNA, 441 bp, Gossypium hirsutum
  unsure (1)..(441): unsure at all n locations
  Clone ID: uC-gsronu33B143h08b1
tcnatcgtccactgcttcattttgtttccggcaggtttatttcacaaggaggcgcgcataccacatatgggatagctgataattcggatgacccgaaatatcaacactacaaatattggtcaaatcctctagaaacgaagttaccagatgctccagacatggagatatactcaatgtacggagttggaatccccactgaaagagcttatgtttacaaagtaactactgccactgattgctctattccgcttcagatagacacctcagctgagggtggcagtgaagatctcatgtctaaaaggtggcgttttctctgctgatggagatgaaacagcacctgttttaagcgctggtcttatggctgcaaagggttggaggggtaaaacccgattcaatccttcaggcattcctgcttacataagggagtacagtcatgcccct

SEQ ID NO: 4079 - DNA, 377 bp, Gossypium hirsutum
  Clone ID: uC-gsronu33B144a01b1
attctttttggtgatgcagtgcttgggagccataggggggtcttgtgtagttattgggttcatggcgaagacaaggtatggtgctttgggtggtggagctaactctgtgaatcatggctacaccaagggagatgggcttggtgctgaaattgttggcacctttgtgcttgtttacactgtgttctcagccactgatgccaagcgcagtgccagagactctcacgttcctattctggcaccattgccaattgggttcgcagtgttcttggtgcacttagccaccatcccaatcacaggaaccggtattaacccagcttgtagtcttggtgcagccatcattttcaacaaggacaagggctgggatgaccattggattt

SEQ ID NO: 4080 - DNA, 367 bp, Gossypium hirsutum
  Clone ID: uC-gsronu33B144a02b1
agtatgtgccggatgtgggagacagggggggagctatggatgatttcacttgacagataaccatgggaggcaagaacaccattgtgttgcacaacacatgtgaggattccctgttggctgctcccattatcctagatttggttctccttgctgaacttagcaccaggatccagctcaaggctgatggagagggcaagttccacactttccatgctgtggctacaatcctcagttacctcaccaaagcccctcttgttccaccaggcacaccggtggtgaacgcactgtccaagcagcgtgcaatgctggagaacatactaagggccagcattggcttggctcctgaaaacaacatgattttggaata

SEQ ID NO: 4081 - DNA, 382 bp, Gossypium hirsutum
  Clone ID: uC-gsronu33B144a04b1
gttttttatcaactttaagacactcaaattcaccatgtctaacacttgcggtaactgcgactgttctgacaagagccagtgcgtgaagaagggaagcagtaacaccatggtcattgagactgagaagagctacatcagcactgttgtggcagaggttccaactgagaatgattgcaagtgcggagataactgcagctgcaccaactgcacatgtggtcgttaaacagacataaagagcaatgacgttctacttcttggtaatattggggacctaagattaatgaaatttgggttgaataatttgtgtttgtgtgttttcatgtttaacagtaatgtaatggccttatctatggactttggttaatgaattactatttagcat

SEQ ID NO: 4082 - DNA, 417 bp, Gossypium hirsutum
  Clone ID: uC-gsronu33B144a08b1
ttgtttaatttgcggaggaggacaagaagctgggggaaatgattgatgcttgtagtagcctggagacttatgtttacaacatgaaaaaccagattagcgataaggacaagcttgctgacaagcttgaatccgacgagaaggagaaagttgaaacggccgtgaaagaagccctcgagtggctagatgacaaccagaatgccgaaaaggaagattttgaggagaagctcaaggaagttgaggctgtttgcaaccctatcatcacagctgtatatcaaagatccggcggaggtcctggcggtgctgcgtcaaatgaagaagaggatgattcacatgatgaactctaaaacaaaaatcttcgatggctactgccactgaaaagtgattgagtttattagagttaggtgtaatgaggatact

SEQ ID NO: 4083 - DNA, 354 bp, Gossypium hirsutum
  Clone ID: uC-gsronu33B144a09b1
ttgaaaattatgggaaggacgggatcgagaggtgaggtgactcaagtgagagtcaagtttttggatgatcagaaccgttttattatgaggaacgtgaagggaccggtcagggagggagatattctcaccttgctcgagtctgagagggaagctaggaggctccgttgataacttcctcttatctccgttttgttacgttattaatggatgagttgtttttaaagtataatcattatgtttaaatgaactaagttggtttttgagattatgattttcatgtcccgttaatttctgctatttcaaaatgttaattcttttctaaaagttgcttgaacgtgactagaaccttttcct

SEQ ID NO: 4084 - DNA, 446 bp, Gossypium hirsutum
  Clone ID: uC-gsronu33B144a11b1
ttctttcgcgtccgacactctctctcctatacggagagttctttcacttaaaagtctggtagctaactcgggttttgtgagccagagagatgggttcaaaaagaacggcatcactagccctcttctttgcactcaacatcctcttcttttccctggggagtgcttgtgggtcctgcccttgccccaaccccaaacctaaacctaaaccaaagccaaaccccactccctccccatcttcttctggcaagtgccctagagatgctcttaaactcggtgtatgtgctgatttgctcggtggcttgctcaacgtcaccattggtacgcctcctgttcaaccctgctgctctctcatccaaggtcttgctgatcttgaagctgccgtttgcctttgcacggcaatcaaagctaatattttgggcatcaaccttaatgtccccactttcctc

SEQ ID NO: 4085 - DNA, 443 bp, Gossypium hirsutum
  Clone ID: uC-gsronu33B144a12b1
tgttcttcaccaccgaggagcttttggtgttgtcaagcctgcattggaggatgaatcctgtgacaccaatatctttctttgatcatattacaaggaggcttgggctgaggacccatttgcattgggatttccttcgtaggtgtgagcatttgcttctcttcctcataactgattcaaggttcgtgacttacactccttctatcttagctgctgcaacaatgctgcatgttataaaagaggttgaaccatgccattatcctgaatatcagaaacagcttattgctgtactcaaggcatgtgaggataaagtaaatgcctgttacaagctcatctcagagttattggaaagccagtacaaaggaaaccaaggccacaaaaggaagtataaatcaataccaagcagccctaatggtgtcattgatgcatcatttggctgtgatagc

SEQ ID NO: 4086 - DNA, 491 bp, Gossypium hirsutum
  unsure (1)..(491): unsure at all n locations
  Clone ID: uC-gsronu33B144b01b1
gttatttaagggtctgcaggcacttatattggcgatggtattggttatggtgttcgctacaactgatgctcaaagcatttgcaacatgccagcttcaggtttgatggcatgcaaaccagcagtgaccccccccaaccctccgccgcccacgtcaacttgctgctccgccctctcccacgctgacatgcgttgcctttgctcatataagaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttntcctttatttctntntatgtgttgngtttcgattggtatcttatagtcgtgtgatttctcaccaataatcatatattagtattggtttcacc

SEQ ID NO: 4087 - DNA, 411 bp, Gossypium hirsutum
  Clone ID: uC-gsronu33B144b03b1
cctactcgtccgccggaatgtcctcaatgtgggagacgccaccccggagagtgtagagcaggtgaaaatgtttgtttcagatgtggagcatccgatcactttattcgggattgtcctgaaacaactaaaagagaagaaataatgagtgcgagatcaggtaatgcttctaccagaggtagaccgcagagaaacccaggagtgggggcaagtaataggggtgcattcaaagattcagcggttagatcagatgttagagcacctgcaagatcatatgctattcgagcacgtgaagaggcgtcctctcctgatgtaattgtggatcaagaagtacgaaactcgaggttagacaaagggaagaataacagttgaagactaagttggtgaatttggctataattggtaccgagtatt

SEQ ID NO: 4088 - DNA, 130 bp, Gossypium hirsutum
  Clone ID: uC-gsronu33B144b04b1
ttttttggcactccttgatgaacactcctcttggggctttttgtaagggtttgttgtgttatcgcctcgaaaggtattgccgccaatcgttgctattgtggaaatggatgaggtgggttcttttattatt

SEQ ID NO: 4089 - DNA, 465 bp, Gossypium hirsutum
  Clone ID: uC-gsronu33B144b06b1
gtttatgggcgtcttgagacaacttgggctgtcttgaggaagtttggatataatgacgagttaaagctcagggatgatattcttccagttccaaccaagcatgcccctgatcagactgtggagctgacaaatgaagctatcgactttttgcgtgggatcttccgattgtatgacagtgataatgatggatctttgcaaccttctgagtttgatgatatctttgtaactgcaccagaaagtccatggactgtggatccttatgtggacgctgcagagagaacacctcaaggaaatttaactattaatgggtttttgtctgagtgggccttgatgacaactctggatccttcatattgtttggctaacttgatttgcattggattggagggtgatccaacttcagccctttcgtgtactaggagaagatctgtagatcgtatgagaagcagacagaaaaaatgtttt

SEQ ID NO: 4090 - DNA, 407 bp, Gossypium hirsutum
  unsure (1)..(407): unsure at all n locations
  Clone ID: uC-gsronu33B144b09b1
cttacgcgtccgggaaaaccagtatggatcggttccgcaagcttgagcgccaagaatctggttgtcttcatggatactgcaactggtgatggcatagaagcttggattaatctagaggaggaagacatggctaaatttggaagtgatgaagaattgcttgcaacattcaaaagcacttttgtttgggaatgatagctactacagttgtcagagttttaggttgctttccatataatttgattaaggaataaagattatttggtcctacacctgttgtgaaatatttgtatttgatgatataatagttggattatatcaaagagattatacactntaaaattaatttagtctatggagataaggcctcttttgtatgcccaataacctctagttatgtgtgattgatc

SEQ ID NO: 4091 - DNA, 383 bp, Gossypium hirsutum
  Clone ID: uC-gsronu33B144b10b1
tttacgcgtccgctcagaaacaccaaactcgggtcaatatccacaggttgtatcaccaacctgttaaggatgttgatcaattttgtttgcctcatattcagatattagagaacaatgcatgttcggatatcggcagtcaaggacccagtgtgtcctatcaagcctacaatgaccagatttttactctggaatcatccacggcggctgctagtatcgttgcttatgattccccttctgctataagtgtctcgtcgagcaggagtcctttctctccacaaggttctcaatcgtggatgtctgatcctcatcattcccccgacaatacacatggatcaccgttcagtggatcttctgttgttgatgatagcaatggattgaagcac

SEQ ID NO: 4092 - DNA, 209 bp, Gossypium hirsutum
  Clone ID: uC-gsronu33B144c03b1
gttaatttggaacttcgaatctttttctgatatacataaagtatatagaaaaagattcgaagtggatttctcgacccgtgaaatgaaaaaatagcctctggagtttttttgttttatattcatctgaaggaaatatgagaaagaaaacaataaataaaagaaataaaatgaaggaaatatatcagactatagtaatttaatacacatag

SEQ ID NO: 4093 - DNA, 452 bp, Gossypium hirsutum
  Clone ID: uC-gsronu33B144c04b1
tttttttcgagagaaatggattgacattgagaaagccaagatcctccgtgacatggtcaggtggtgctaccgcatcgaaggggtcaaccatctccagaagtgccgccatctcgtacgccagtacctcgacgccacccgtggcatcggttggggcaaggatggccgtcatccctccctccacggtccaaaggttgaagagatcgattcagaatgaatggctgcatttggtcatgataggtgactgactttaggcagcaaagtaaggagtgtgggattcgaataattgtccacctacattgtcactattgttttttgtgttgtaagactcttataacaaagatcaaacgtaatgccatcttctttttccattctggttagcatccaaaatcttggttaattacttgggcgaagtgttcgttaacagtcatcagataaatgaataaggtccttgt

SEQ ID NO: 4094 - DNA, 330 bp, Gossypium hirsutum
  Clone ID: uC-gsronu33B144c10b1
tttttaataccagcacctgatgcccacgcgcggcaccctttacgtggacttgaaagacgtggttaccgtcgatgctctccagaccaaggacaagaaagtggccgcttgttaggcaactaaggagaggtttgaagagaggttcaagactgggaaaaacaggtggttctttactaagctcaggttttaagtgttttattggaacatgttttatgcttaagtagttttatcgaacaattttgaatttaatgacggattttgaatctgtttggataagatatttctgggttattatttttgttattttatggaacgtgatttgctcatttctat

SEQ ID NO: 4095 - DNA, 436 bp, Gossypium hirsutum
  Clone ID: uC-gsronu33B144d01b1
tgttgtggtggagagactcaaggaagaaatccggagactatgccagatccattcagatggttcttacaaggtcacattcggggtgctatttaatgatgatcgctgtgcaaacatctttgaagcactagttgggacactaagagcagcaaagaaacgaaaagttgttgcatatgatggtgaactactgctgcaaggagttcatgacaatgtggaaatcattctcaaagctacaacaccagcagcagcccagagtagcaactaatgcagttctaaacaaataattgcaattatagttttgcagcaaaagtttgatgatattctatgtaatttttcaatgtttatcatgtttgaaagcttcttcagcataagtgcataaccgtatttttgaatactcttttatgaaattttccagagtgtactacacccagatttgtat

SEQ ID NO: 4096 - DNA, 437 bp, Gossypium hirsutum
  Clone ID: uC-gsronu33B144d03b1
catatttacgcctttttcttctctttgctgagctctgtcccccaacatcaccatggcagataggatataccctaaacaagcgacaaatggcaccgccgccgcaaccaacccttcttttccagccactaaagcacaacaatacggagcctcccgccctgtctaccgtccacaacccgaacgccaccgctaccgccgctcttgctgttcttgctgcctttggaccaccatagctatcctcgttctcatcctcatagccgccgtagcttctgctatattgtacgttctttaccgccctcaccgtccgactatcacagtttcctccctcaaaatctcggcacttaacgtaacctcagcttccaagctgatcaccaacatcaacctaaacgtcacagtcaaaaacccaaacaagaaagtcgtctacagttacaacccaatca

SEQ ID NO: 4097 - DNA, 422 bp, Gossypium hirsutum
  Clone ID: uC-gsronu33B144d04b1
ctttctcgtccggtcagcagcagacttctacaaaatcactagctgcaaatgatataacaggagtatcttctgcacctagcccgggagctactgaacctttagcatcagaaggctttattcgaggaaggtcttataatatcaggatggatgatcaagttctgctaagattctctcctaagaactctgagtccacttattacttcagtgatatgataggcgggactcttactttcttccatgaagaaggagctagaagatgccttgaggtttcagtcacgcttgaaacttctgagactataagtcggcgttttgttcatccttctaggaggaattcctcaacaattaccaaggttcagagtgatcatcatgaggttggtgctgatctggtacagacagggtttctcttttctgtccccatggat

SEQ ID NO: 4098 - DNA, 79 bp, Gossypium hirsutum
  Clone ID: uC-gsronu33B144d05b1
aatattaaaaaaaaaaaaaaaaaaaaaaaaaaggggaaatttaaaaaaaatttttgggaaaagggccccctttttcgac

SEQ ID NO: 4099 - DNA, 436 bp, Gossypium hirsutum
  Clone ID: uC-gsronu33B144d08b1
ttctttgaatctatgaaaagcccatgccagggattcccccggtggagattgccgctggcctcactgatgtttctgccatctatgaatcaatgaatgatcttgatcaggcaatcaagttgctgcagaaggccttaaaaatatacaatgatgtccctggtcagcaaagcacagtagctggaattgaagctcagatgggagttatgtactacatgttggggaattattcagaatcttacaactccttcggcagtgccatttcgaagctacgcatatgtagagacaagaaatctgccttcttcggcattgctctcaatcaaatggggctggcttgtgtgcaacgctatgctataaaggaggctgttgagttgtttgaagaagccaaaagcattttagagcaagagtgtggaccgtaccaccctgatacacttagcgtata

SEQ ID NO: 4100 - DNA, 439 bp, Gossypium hirsutum
  Clone ID: uC-gsronu33B144d09b1
ttgttgcttgtatacttctcaagtatctcaccggaggattgaacactccggttcacacattagcaagtggaatggggttccttcaaggtgttatatgggagattattctcacattcgcattgctgttcacagtgtatgccaccatagtagaccccaagaaaggttccatcgatgggctaggtccaatgctcactggcttcgtcgttggggccaacatcttagccggtggagctttctcgggtgcttcaatgaatccggctcggtcattcggaccggctctagtgagctggaactggaccgatcactgggtttactgggtgggacccctaatcggaggtggccttgctggctacatatatgagaacttcttcatcgtcagaacccatgttctccttccccagaatgaagccttttaagcttttaatttcagttacattag

SEQ ID NO: 4101 - DNA, 291 bp, Gossypium hirsutum
  Clone ID: uC-gsronu33B144d10b1
gtcggatttgaaaatctggaaaattttaggggcgattagataatattccctgcttatcagtttatgcgttaaacaagtggggtttctttaaggaaaaaagaaaaatcaagggggttgatatgtaatattaggggaatagtgggcgagggttgagttttaaaatgttgagatgggaaaaatgcttttctgctccgttgtgaaaaaagtttgtaagagatttgcaatttagtcccttcgatgtaaagtaaagataaaattagggagaaatttgagcagatttctattattatt

SEQ ID NO: 4102 - DNA, 420 bp, Gossypium hirsutum
  Clone ID: uC-gsronu33B144d12b1
tgtttttttgaggctggtatctccaaggatggtcagactcgtgagcacgcattgcttgcttttacccttggtgtcaagcaaatgatttgctgttgcaacaagatggatgccactacccctaaatactcgaaggctaggtatgatgaaattgtgaaggaagtctcttcctacttgaagaaggtgggatacaaccctgacaagattccatttgttcccatttctggttttgagggtgacaacatgattgagaggtctaccaacttggactggtacaagggccctactcttcttgaggctcttgaccagatcaatgagcccaagaggccttcagacaagcctctccgtctcccacttcaggatgtgtacaagactggtggtattggaactgttcctagtggtcgtgttgaaaccggtgtcttg

SEQ ID NO: 4103 - DNA, 379 bp, Gossypium hirsutum
  Clone ID: uC-gsronu33B144e01b1
ttacttccaaggggacaaaccttatggagaaggtcgctgttgtaggatggaatgtgttggtgaccggctgtgacggcgaccctttaatcgaccgtcaggtggagctcgtaaaatcaatggaagaaaagggtgttaaggtagtgagccattttcgtatgggggatcatcatggagtggattttatgcagcctgataaggccaacgcactgtttttggtcttgaaggattttattgcatctgcaacgtcagttacaataaatgcaaatgttgaatgaatttatagctatctttatcatgcaataatggtatgtacgtatagagcagtggattatcttactagtggtcctaaaaaagtaaactcttgaaatatttttatttc

SEQ ID NO: 4104 - DNA, 293 bp, Gossypium hirsutum
  Clone ID: uC-gsronu33B144e02b1
tataggtcgagagggaagcccaagtcaaccaagggggcatttagaacgcatatggctgggcttcagcttccggaggggaggatcgctaggttcttgaaagccgcgaaatatgctgagcgagtaggagccggagctcccgtctatctctccggcggatgagagtatcttgctgttgaggctatagagcttgctggaaacacggggagagacacttaaaagaaatcgcaacgtttcaaggcacagccaactagctgcaaggaaccatgaagagctgagctagcttttggggtcag

SEQ ID NO: 4105 - DNA, 492 bp, Gossypium hirsutum
  Clone ID: uC-gsronu33B144e09b1
tttgttttgtcatctctgcaaagatgaaaactgggggtctttttttgttgctttgtaggaacctgtcacagcgcttttgcctaagattcctggccttgttttgcatgtggaaccgtcttgcagcttgttagaagcaatagatcttatacttgaaggagctcaaaaccttgtggtgccaatcaaaaccaagctcagcaacaagagaaaacagcaccagaagccatcaccgacggtcactgtccacaaaggccgtgaattctgctggttaactcaagaagatgtgattagattcctactcagctcaattggcctcttttcacctgtccctgctttctccatcgacactcttggcatcatcagctctgaaatcctcaccattgagtaccactcccctgcttctgcagccttaggagccatttctcgaacccttgtggaccaaacttcagtggctgtggatgacagtgaaagctgtctgattggagaaaattctcc

SEQ ID NO: 4106 - DNA, 461 bp, Gossypium hirsutum
  Clone ID: uC-gsronu33B144e11b1
ttttatattcctctctttctaaccttcggaagctgaccaatttctgcaaaaatggcgacgatggtgcctgacaacctaagccgtgaccagtacgtttatttagccaagttagcggaacaagccgaacgctacgaggagatggttcaattcatgcaaaagctcgtcctcggctctactcctgcttccgagctcaccgtcgaggaacggaaccttctctcggtcgcttacaaaaacgtaatcggatctctacgcgccgcgtggaggatcgtttcttctatcgagcagaaagaagaaggtcggaagaacgaggaacatgtggtgctcgtcaaggagtatagatcgaaggttgaatccgagttgtcggatgtttgcgctagtatcttgactttgttggactcgaatctgatcccatctgctgctgcgagtgagtcgaaagttttctatttgaagatgaaagggat

SEQ ID NO: 4107 - DNA, 332 bp, Gossypium hirsutum
  Clone ID: uC-gsronu33B144f03b1
tattaatacaacagaaaaaggagagttctgctagggtttcaaccttaacccttttgaacgccgccaacgaccaggccgatcttcgcccgatctccgattgcgacggagtgggcaaagccaggtatgctgctcctcctttaaccccttttcttatatatacatctatataccatagcataatagaagaacagagaaagtaaagcaaagaataattagacggaaaagaagaaggagtcacctttgttcgatttttatttctttgtggacattcgatacagtatgcgttgagtcataaaaagaggttccttaatacaaatgttagatcgctttta

SEQ ID NO: 4108 - DNA, 65 bp, Gossypium hirsutum
  Clone ID: uC-gsronu33B144f04b1
ccttctcgtccgccgacaattaatggggatgatatatgatatcatggggaattttaggtgtgggg

SEQ ID NO: 4109 - DNA, 336 bp, Gossypium hirsutum
  Clone ID: uC-gsronu33B144f09b1
taactcaatcccttgagtgattctcagaggggagaatttcatggccttgagagcgaaattatggcggatagagatcagaatgggatggttgatacttcattaggaggctctattcgaggagacattgcataagaagagaatgatccaattaaagctgttaaaaacttagtaccacgaggcttgattaattctggaaatttatgctttctgaattccactttacaggctctattgtcatgttttccttttgtccagctcttgcagcaacctaaacttggtcatataccaaaggttggctatccaatattaacttcgtttgcagagtttgtatctgac

SEQ ID NO: 4110 - DNA, 479 bp, Gossypium hirsutum
  unsure (1)..(479): unsure at all n locations
  Clone ID: uC-gsronu33B144f11b1
tcttacgcgtccggacttggcctggctttgaacttctcagttttctactatgagatattaaattctcccgagagggcttgtcatctggctaaacaagcatttgatgaggctattgctgagcttgatagccttaatgaagaatcttacaaggatagcacccttatcatgcagcttcttagggacaacctcaccttgtggacctcggatctgccagaggaaggaggtgagcaatcaaaagcagatgaacctcaggctgagagttaattggatgaaagagtattcttttaagactgggcttgtcgagataggaaaggggcttgctgctagagtgacctgctttcaactcatggtagtagtaccaggatttgttacctatgacatggttcgatttggttatcagatgttttcagactggtgctctgtgttctcttctgtttaaacataattgaatcngntacactntatagtctttatgactt

SEQ ID NO: 4111 - DNA, 440 bp, Gossypium hirsutum
  Clone ID: uC-gsronu33B144f12b1
tttcattcgtcatcggggacgctcgcaacggttgcaacggttaaatgatggtggaggcattcgctgccaaacatacagtcaaagttcccttcacatcacgtggaaaaggtgaattcaaggctgcaagtttaatgttcaaagctgatacagccaggacaagaatcacattctacagctcttactaccacacgaggagtgatgacttcgggtctctttgtggtcctgttctggatgaagttacggtttaccctattgcttagatgccaagtaaatttttttttatgaagcactagagcatataagatggtaagtgaagggttttgtaatggttttacgtttgtatatttagcggttctggtaagctgtctaaaaccagatggaggaaatgcgtgcaatgttgactttcagcaatcatggataacaatttgaagatgctatct

SEQ ID NO: 4112 - DNA, 332 bp, Gossypium hirsutum
  Clone ID: uC-gsronu33B144g02b1
tctatttttacgcggacgcgtgggaaaaataatcgctttcttaattccagatttctcgcctaattcttcgggattcattatttaaaatttcagcgaaaactagaagtaaagaaaaaagagggtgggctattttaagttttgggagctttgagtatgaattgaaggagatttagttgaagagatgaatgtgagccatgccttagtccacccagtggaagatctaccaaccacggacggaggcgtaggtataggcggtggcaacaacaacaacaacgaggtgcctagagtgaggatgaaagatattcaggggatgcctggaacggcttgagggc

SEQ ID NO: 4113 - DNA, 162 bp, Gossypium hirsutum
  Clone ID: uC-gsronu33B144g03b1
cggggcaggcaaaactccataaggcaaaagggaccagcacgggtactggaggagcaagctgtattgaaagcggatggttgcccgaacactccgcaggtgagacaaatgcagggaacgagggggagaccccacagaccgggtccaaggacaggacaaaacagg

SEQ ID NO: 4114 - DNA, 521 bp, Gossypium hirsutum
  Clone ID: uC-gsronu33B144g04b1
cttactcgtgggcggacgcgtgggcggacgcgtgggcggacgcgtgggcggacgcgtgggcggacgcgtgggcggacgcgtgggcggacgcgtgggcggacgcgtgggcggggagactctgaggagaaataatatcagatcctccttctaaactctccacaaagaaaagggaaaaaaaaagagggagatggggttgtcttttacaaagcttttcagccggcttttcgccaagaaggagatgcgtattttaatggtgggtcttgatgcagctggtaaaactactattttatacaagctcaagctcggggaaatagtcaccactatcccaaccatcgggttcaatgtcgagacagtggaatacaagaacatcaggtttactgtttgggatgtcggtggccaagacaagatccgttctttgtggaggcactattttcaaaacactcaaggtctcatttttgtggtggattagaatgacagggaccgtgttgctgagcaagggatgactgcccaggatgtgatga

SEQ ID NO: 4115 - DNA, 109 bp, Gossypium hirsutum
  Clone ID: uC-gsronu33B144g05b1
gtgatattggaaagaaaattaatcatggaggtggagatgggggtgatgatgatggagatgatgatcattatttcgatgactttgatgacgacggcgagggagatgaggc

SEQ ID NO: 4116 - DNA, 416 bp, Gossypium hirsutum
  unsure (1)..(416): unsure at all n locations
  Clone ID: uC-gsronu33B144g08b1
ttgttagatctgagcaatggcgacagattcatcaaatggggaacaaaagacaacctcaaagccaccacctttgccatctccattgcgcttttctaagttttatcaggccaacatgaggatcctggttactggaggagctggttttattggttctcacttagttgacaaattgatggaaaatgagaaaaatgaggtgattggtgctgataactacttcaccggatccaaggacaatcttagaaagtggattggccattctagatttgagcttattcgtgacgatgttactcagccgttgttggttgaggctgatcagatgtaccaccttgcctgacctgcttctccaattttctacaaatacaatcctgtgaagacaatagagacgaatgtcatnggcacactaaacatgctgggac

SEQ ID NO: 4117 - DNA, 470 bp, Gossypium hirsutum
  Clone ID: uC-gsronu33B144g09b1
tgtttcatgagtaacgagaaaccctattcccctctatttcgctctaccgctccgctgtagaccaacctcccgtcactatgagcagatcaggccagcctccagatctcaaaaagtacatggacaagaaactccagatcaagctgaatgcaaatcggatggttgttggtacgcttcgcgggtttgatcagtttatgaatctagtggttgacaacacagtagaggtgaatggcaatgagaaaactgacataggcatggtggtgatcagaggaaattgcgttgttactgttgaagcccttgaacctgttggcagaatgcagtgattctggcttttctattgatttatcactttgatgtatctcttggctttgttgcttcaatggcatcactgctagtttgggattgggaagttctatgtaattgagaattttatggcagttagatgggtctccatggaatctgcttttcggttc

SEQ ID NO: 4118 - DNA, 452 bp, Gossypium hirsutum
  Clone ID: uC-gsronu33B144g12b1
cttacgcgtgggtttgagtactatgaagaagtatgatttctgtttcagagaagtagtttctggaagaattgtatggtccttgaatgatcttggatctattcttccctctgtgcagaaaaaggaagctgttctgcttgtcagcctatttggggtgtcggagacagttactagaaaccttctttgccattttgagaggctaaatatttggaattacattttcatcggtcctgcaactgactttctgtttcatcttgctcaagggggacatcctgtgattgatgcagatggatttctcgaagatatcaaatcattcaaatcactgagaattcaagagtcaaatgctaggcttatcaaagagattctgttgaaggcttatgttgtcaaaaaggcttagaattgggttataatacttgcgtggtggatggaacatggcttttattgataatgatttt

SEQ ID NO: 4119 - DNA, 460 bp, Gossypium hirsutum
  Clone ID: uC-gsronu33B144h05b1
cttttcttatttgaactcaaagtcccagctaatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaggagctcaatgaaattctacactataggcgataatggtatcactgaagacgaaatcaggctcttattaagggagt

SEQ ID NO: 4120 - DNA, 474 bp, Gossypium hirsutum
  unsure (1)..(474): unsure at all n locations
  Clone ID: uC-gsronu33B144h08b1
ttctctcattcccctaagaaacaccccaaccacaggcgccattgtcgcctaatgctccgctcttctttcagcttcagcaaccccacccaccacgagcccgtggcttttgatcctctcgtcgccgacatcgagcgccgccgtgaagatcgacaatgggagaagcagtacttggagcacacccatcctgagcttgtaaatgaccacgctccgggtcacgagtcgcagcccgagtgggaggatttcatgaacgctgaggattacttgaatgatgaggataagttcaacgttaccaataggttggtaatgctgttccccaagattgatgcggaccctgcagatggttttgtgacggagaatgaattgaccgagtggcatctacaacaagcagcataggaagtcttgcacaggtctatgagggagatggaagttcatgacangaaccatgatggatttgtttcattggcagagtatgag

SEQ ID NO: 4121 - DNA, 438 bp, Gossypium hirsutum
  Clone ID: uC-gsronu33B144h11b1
ttcctacgcgtccgaaaactgtttttttctcatgcagagactcaactggggttccatcctgatgcaggggcttcattttatctttctcgcctacctggttacttaggggaatatttagctctaacaggagacaagcttaatggtgttgaaatgattgcctgtggccttgctacccactattgcttaaatgctaggcttgcttggattgaagaacgtcttggcaacttgatgaatgatgatccagctgtcatagattcttctcttgcacaatatggtgaccttgtttatcctgataggagcagcattcttcgcaggattgagacagttgataaatgtttcagccatgacactgttgaggaaattattgattctctggaaaatgaagcagctggagcttatgatgattggtgcaagacagtgctgagaaaaatgaaagaa

SEQ ID NO: 4122 - DNA, 507 bp, Gossypium hirsutum
  unsure (1)..(507): unsure at all n locations
  Clone ID: uC-gsronu33B144h12b1
gttatgtcgaagcgaggacgtggagggtcagctggaaacaagttcaggatgtcactgggtttaccagtggcagccacagtgaactgtgctgataacactggtgctaagaacctttatatcatctcggtgaaaggaatcaagggccgtctcaaccggttgccctctgcttgtgttggagatatggtgatggctaccgtcaagaaagggaagcctgatctcaggaagaaggttttgcctgctgtcattgtgagacaacgcaagccatggcgccgaaaggatggtgtttacatgtactttgaagacaatgccgggtgtcattgtgaatccaaaaggagaaatgaaaggttctgctataactggtccaattggaaggagtgtgctgatctttggccaaggattgcaagtgcagccaatgctattgctagngaagtcaaaatctgtgctttggactataatattatagtttggctgttcaatattttggtggatttctttttgggatttgag

SEQ ID NO: 4123 - DNA, 269 bp, Gossypium hirsutum
  Clone ID: uC-gsronu33B145a01b1
acaataataatacaaacaaaaaaaaaaaaaaaaaaaaaagaagacacctttaaaaacccccttgtgggtaaaaaaacaaaaaaaaaaccaacaatcactcccactgcccactcttaatttcaattcccctgcctaaccccctctgggttccccaccttatcgccttgaacaacctaccccttccctcacctaacctaattgcaaaaaatcccactccccccacctttcccaacatttgagcatactgaaccgcccatatctcccaccct

SEQ ID NO: 4124 - DNA, 264 bp, Gossypium hirsutum
  Clone ID: uC-gsronu33B145a02b1
cctcctacggcaactacagccacccaactatggccaacaaccaaaacgcccagcaccgaagtcacacaagcctcctgtgcatgaacttccaaagaagcctccaacgtataaacctacgcatcaatccatgaacctccaaagaaccctccaatgtataaacctaaaccaccactccatgaacttccaaagaagccaccgattcatgaacctaaaccaccaaagccaccagttcacgaacctccaaagaaagagaaaccagaacac

SEQ ID NO: 4125 - DNA, 552 bp, Gossypium hirsutum
  unsure (1)..(552): unsure at all n locations
  Clone ID: uC-gsronu33B145a05b1
gaagctgttctcttgatgattgaaaatcccgacagggggggtggtcatattttcaatgtgggcaacccaaataatgaagtcacagtgagcaacttgctgaaatgatgactaaggtctatcaaaggtaagtggagaaccttcactggagtcaccaacaattgatgtcagttccaaggaattttacggngagggatatgatgatagtgacaagagaattccagacatgaccataataaatagacaacttggttggaaccccaagacaacgctttgggacttgcttgaatcgacccttacctaccaacacaggacttatgctgaggctatcaagaaatccatggtaaaacctattgcatcctaaataggtaaagatgttcagaccatgcctaaggaaggatgcatgtaaaatttacttgttcgaaaaatgttccaattcttttttttccttttaggagtcctatatatatctgaaattgtgattctacttgtatgctacattttgggtcatcccttgtgtcaatagttaatagctcacatttagctcagcagtat

SEQ ID NO: 4126 - DNA, 484 bp, Gossypium hirsutum
  unsure (1)..(484): unsure at all n locations
  Clone ID: uC-gsronu33B145a06b1
cctgtagtgatggcccattcatctgtagccatgaaatggaggagcttttgaaactgcattggaggatcaaagcaagaagattcagacagtcttctaacaaagcaaaatcccataaaaagccgacaaaagtgggaaaaaggaagggaatgtggatgatgctgattatcagggtgccactactactactacggcagccagcaatgatgctggaatggctgctgctgtagcagtgggtgccactacagcagcatcaacgccgtcagaaccaccaccaacaaccgcagcagcaggaggcaaaagatccgaaatcaatgccatggaaaacgacccttcactcattgcaatcaatagacaagacatgccagctcaagatagtcaagaaaccctacatcaacgtcaacgaaaccctcaaatgcaccatcgaaagagacgtgcctacagttacgttctntatccgagcctacgctatggactccgacgacca

SEQ ID NO: 4127 - DNA, 443 bp, Gossypium hirsutum
  unsure (1)..(443): unsure at all n locations
  Clone ID: uC-gsronu33B145a07b1
gcggtaactttttcagccgcagccatgccaaacgtagttactttttaaaacacctttttgtggaacaaagagtgcaagaaacacacttgcacaaggtcacacagcctaataatgacacgatagctatggctgcacaggacacgcaccgttacgaccgaaaacaatccntgttacggtggtcagaccaaaccattgttccacaagaaggcaaagaccacctagaagattgtgctaaggcttcaactgccatgttacaagcacgtttcacaacatccaatcaagaggtgctagcactcttagattggtggagacaacaatgggaaaggaacatctctaatataaacgagatattcatggtatcttgttatagatgctttactttatatggagtagttagaacttacaagactgtaatggaattttgttaaacattgcttagttac

SEQ ID NO: 4128 - DNA, 506 bp, Gossypium hirsutum
  unsure (1)..(506): unsure at all n locations
  Clone ID: uC-gsronu33B145a09b1
ccttctcttccgattatcatttgctgtgggattgatgggacaggctgtcaaattggcgagggacagttttatgcgatcagccattgatattttgaagtgacaagagctaggccaacttggatggaactgttcttattacaacttggtctaaattatcttttcacaccatagattttggttggggagaacccatttaacagggcctgttgctttgcctgaaaagccagttctgcttttccttcctcatcagaaagataagaaaagcattaatttactgttggggttgcctgtttcagcaatgaatagctttgaagagctgatgcaggtttaagcagaagaaaaaaaaagacatgttttatagcaagttattttatgtcagatactcagattcatatgttgcattgcatgcagtcattatctgaggattttctgacagtgggttttcggtaaattgaagaacaaanataacctcagatcagataagactcgaattctgagtcatataa

SEQ ID NO: 4129 - DNA, 467 bp, Gossypium hirsutum
  Clone ID: uC-gsronu33B145a12b1
tgtcttatcagcttataaactaagaggtgactttgcgagactcaacttccctaaccttcgtcaccacggttcccacgtaggtgactcaagcctttgccttcctctgttgacgctaacttcaagccatttgtgagagcttggtacaaaaccctaagcaagggagcaagaagaaatcatccaaggttacggcagacaccaaaagcaggaacaacaaaaaatccgacatggcagagccaaagcccgaggagaatacagcgaaagtggagaactcctcatctttgtctacggttcaatccgagagtgagggttcggctgtatcttcacctttatcagatcttacattctcggatttcgacgaacaaccatggccggaagtcgtttcttcttcggaaacttttatgttgtccaagtacccttcagagatcgattgggattccattctaaaagccttgagggaaaaacccaag

SEQ ID NO: 4130 - DNA, 473 bp, Gossypium hirsutum
  Clone ID: uC-gsronu33B145b02b1
cccatgctatcgcccacgcgtccgtccaatttgcttttgagtagctccccaaatatccttccgcttattgcaatggagaccccttcatctcaagacgagtcaccaggtcccagactttgctgctttgaacaacagcaatatccctctttccaagggatatagggaaaagccacaagaaaggtctgctcttattgatataacagatgactcccctattgatgagcttgcaatggaaacaccgtcatctgttataggtaagcagcggagtagtagagccacgagcatgatgatgactcctggttctggtgaggctctgttgagaggtcaagtcaagactctgttgccaaaaggtgaagaggaagctgaggtttcaaaagtttcaatggaaagccgagcttttcttcgattgcaggctggatgcgggaattccccaatgggacttatggcccctactcctgcaaacacaccacact

SEQ ID NO: 4131 - DNA, 604 bp, Gossypium hirsutum
  unsure (1)..(604): unsure at all n locations
  Clone ID: uC-gsronu33B145b03b1
agagtttttatagttcttacgcttcaagttcagtctatgggggcatcttagttctctatcagtgtcacaactcaactcaatcatccacttctctcttatttgaactcaaagtcccagctatattagaatcatgggtgttgtcacttatgactatgagaatacctccccagtcgcccctgccaggcttttcaaggcctttactgttgaagctccgaaagtttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcatntaaggaagtgaggaagttaccaagcctgtgagcttacctcttggctatcccgagcctgcacta

SEQ ID NO: 4132 - DNA, 504 bp, Gossypium hirsutum
  Clone ID: uC-gsronu33B145b04b1
ctaagtctttcacgtctggaggtggaaagcacaacaggggggtctttttattatatcttatgctatatatataatggggtcgatctcttgcttttcaaaagttaaatatgaagtggggggtttttgttttgtattaacagaagtggagtaagggaaagcaaaaggagaaggtgaacaacatggtactatttgaccaagctacctatgacaagcttctctcttgagctcctaaatacaagcttatcactccttcaatcctctctgatcgtatgaggattaacggatcacttgcaaggaaggcaatacgggagttgatggcaagagggttgattaggttggtctctgcgcattcaagccagcagatttacactagggctacaaacacctagatctttagttatatctttgcaattagttctaagaagtatcgccatggttgagttctgacttggataaatgacttttcccccctataatattggtttaaaacttctctttgctact

SEQ ID NO: 4133 - DNA, 493 bp, Gossypium hirsutum
  unsure (1)..(493): unsure at all n locations
  Clone ID: uC-gsronu33B145b06b1
ggagtttattaagctcgttggctgctttctggtgtttcttgctgttctaggcattgccttgcttaatgttgcagtaggagctggtgaagtgggagatcatcccctgatagggaagcctggaagttagctccttgtgcaatggctgcacaagattctaacgctccagtttccagcagttgctgccaacaggtgaagaaaataggccagaatccgcgatgcctatgcgccgtcatgctttccaacacggctaagagttctgggatcaagccggaaattgctatcactattccaaaacgctgcaacattgctgatcgtcctgttggttatcagtgtggagaatacactctgccttgagcacgaaggctgaagtcatggttcccagtttcgtcgtttgctggattctgtgctttccgttagctagttcatctagctgatgaataacagtgaaatctagcngtttgaatgataaataaaagtttantgttatgacttc

SEQ ID NO: 4134 - DNA, 483 bp, Gossypium hirsutum
  unsure (1)..(483): unsure at all n locations
  Clone ID: uC-gsronu33B145b08b1
gcaaataagtcagttaaggagataattgaagagcttaaaaaacatcaacaaagtacagaagcttcagtggtcgagtgggcaatgaagctctgcagggtctcggaaaggggctccattttctcttttcttaacacacaactatttctctagagttgcatctggatatggtaaacagaacaacgaatttacgatgctaaaaggcgtcatgaaaactgaataccgcgttgcgctacggtcttctctgcggaatgattttgctgaaggcgtccgtgcagtcttgattgacaaggatcagaatccgaagtggaaccctgccaccgtagacgaagttgaccaaaaggaagtggaggcagtttttgaacctttaggtccgggaatcgaagagttgaaagtttaaggttcacacttccacataatcaagttcgctttccttgttttncgttgcgaagatgaatgaaaggctcgtggttgtagaaatatgaa

SEQ ID NO: 4135 - DNA, 518 bp, Gossypium hirsutum
  Clone ID: uC-gsronu33B145b11b1
ctgttcttcgtatgccaatgtacccacctggtggtccaggtcttgggcagcaaatattttatggtcaagcacctacggcaatgtttcgcagcctggatttgggtatcaacagcagccatccctggtatgaggcctggtggagctcccatgccaaatttctttgtaccaatggttcaacaaggccaacagggtcagcgtcccggtggcagaagggctggggctggtcagcaaagtcagcaaccagttccattaatgcagcagcagatgctaccgcgagggcgggtctatcgctatccaccagggcgtggtctacctgatgtttcaatgcctaacattgctggaggcatgctttctgttccatatgatatgggtggcatgccaatgcgtgatgcgtcaatttctcagccaattccgataggagccttggcctcagccctagcaaatgctacaccagatcagcagagaacgatgctgggagagaatctttatcccctagttgaacagctggagcctgatgc

SEQ ID NO: 4136 - DNA, 228 bp, Gossypium hirsutum
  Clone ID: uC-gsronu33B145b12b1
cggatgcgtgggttttttttttttttttttcttggttgctagtttctaaagttaatgttgtgcttaaaaacatatttgaccatttaatgatatggttcctgcacattttctagataaaaaaaaaaaaaaaaaaaaaaataaataaaaaaataaatgttacaaccgccccctatataaagaaagggtgggcgtcgaaaaaaaaatccaggactccgaaaagaaaattct

SEQ ID NO: 4137 - DNA, 515 bp, Gossypium hirsutum
  unsure (1)..(515): unsure at all n locations
  Clone ID: uC-gsronu33B145c02b1
cccacttttccgccaaatctctcaaaaccttcattccatgccactcaccccgaacaacctctgtccaccaacatggggaaaacacgtggatgggagcggggcgcaagctgaggacccacgcaggaggcagaggtgggctgataaggcatacaagaagtctaaccttggaaatgaatggaagaagccatttgccggttcttcccatgctaaaggaattgtccttgagaagataggtatcgaggctaagcagccgaactctgccatccgaaagtgtgctagagttcaattgatcaaaaacggcaagaagattgctgcttttgttccaaatgatggttgcttaaactacattgaagagaatgatgaggtgttgattgctggatttggacggaagggtcatgcggctggtgatattcctggtgttaggctcaaggctgtgaaggtgtctggtgtctcactcttggcactcttcaaagagaaaaaagagaagcctagatcttaagttngcaatgaggaaa

SEQ ID NO: 4138 - DNA, 435 bp, Gossypium hirsutum
  Clone ID: uC-gsronu33B145c03b1
gctgaatatgcagcattgaaagaaagaaacaagtccatggaagattaattgaagtatatgcgagatcggtattccgagataagcctcaattcgcagaggtggaaggtgaacgacaacggcttctgatgacggtacgtaaaataaagaatgccaagaagagctgaaaggtattcatttcttcgtatacaagttactacaatgtatagttgaagtagcagctggatttgtacccacacggaaattgcaggtgagacagtttcctctttagaatgaaaaagaaattaagttgtacaaaaaaatcaaaaacgcattcacctcacctagtagtttccatatatagtttattttttataaaaaaaattactttgcatgtttgattcttgctcttatattaaagattgtcatgaacatttccacaaatatatatatattgac

SEQ ID NO: 4139 - DNA, 497 bp, Gossypium hirsutum
  Clone ID: uC-gsronu33B145c04b1
cccacttgttcgttccttttttttttttctctcctttggcagccgccgtcgatctcgatccgtatcctcgttttcaaacaagctcgaaaagatggccaacgctgcatcgggaatggctggcatgatgattgcaagctgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatccaactgagatgggtctcgatgtgttcaaaag

SEQ ID NO: 4140 - DNA, 527 bp, Gossypium hirsutum
  Clone ID: uC-gsronu33B145c05b1
acgatttcttccatttcaaatcaaaacctttccatcacccgcagtgaagagaatcgacagaaagtgctccgccttatctctcgcagagcgctgcttttctctccttaatctccctcttccttccctactccatacccctcatgcttctgccttctccattggaatttcaggaccaaaggattggcttaaagagcaaaagaggaagtcttcgaaattcctattggcaccaatcgatgcttctcgacaaagccttcgctctgtttatcttttgctcatggacaaggaatcaactatttcgaatactgatttagaggaagtgcaaaagctcttgaaatctgccgctagggattgtgttgcacaggagaggaattcctttgttgcatttcaagccaacaccggagtcgaggtttgcacatttcgtttgattgtgaaaaatgcttcttctctgcttgagaataagaatcctgttaagctggaagcttgagctatgctagatgatcttataagctcatttacctcgcttaata

SEQ ID NO: 4141 - DNA, 408 bp, Gossypium hirsutum
  Clone ID: uC-gsronu33B145c06b1
ggggatatttctatgatggggaaactggatccattggagatgaggacaatgatgagtcttcttgagatggtggttcgttttcttggcgcggcggcgtgtgaggagacggacaactccgacaatcaacaatgactaccattccttgcagtggcggcatgtaaggcgacagtggtttgatttcttggctgcgccatgtaagggatcttttttatcgtccgaacatcagagtttcaatcgcaaagtgttttccatgttcatattaatctagatcttgtacttgtttgctttgtttgtcttcatggctgtaataatttgtttctcattcaacagcagttgagggataattgtttctagttcatttgagaactgttatgatattcacgtaaagattttcattgaaatgaacaa

SEQ ID NO: 4142 - DNA, 72 bp, Gossypium hirsutum
  unsure (1)..(72): unsure at all n locations
  Clone ID: uC-gsronu33B145c07b1
cctactcgtccgatttgagcttgccatgttgtatttttaatttttagcaacataaacgaagaataattgcng

SEQ ID NO: 4143 - DNA, 468 bp, Gossypium hirsutum
  unsure (1)..(468): unsure at all n locations
  Clone ID: uC-gsronu33B145c08b1
tgatttttctgttgataatagttgtaggagtttgagtggtgattctttacaaggtgtggagttgctggtgctacggcggaggagggaatggagtgacagttgttgagatgagtgtggaaagcggagacggggaagaccatcgaggaatcaagtgagaaccacgtcgtcatcggcgctaccgccaccgcctcaaaggaaggatgaggatgatgaagaagatgtttgttttatatgcttcgatggcggcagtctcgtgctttgtgatcgacgatgagtttggaaattttttaacattcacaatggaatgctaaaacttacagaaggtggcacttcttgaggttgaatgcacatctttaaatcaagaattgcaagacgtggaagctcgttttcgtcgtggacaaaagaagtccccagaagaagcaaatcaaatgcttcagatgcangcatggcangaggaaagtgagcgtg

SEQ ID NO: 4144 - DNA, 533 bp, Gossypium hirsutum
  unsure (1)..(533): unsure at all n locations
  Clone ID: uC-gsronu33B145c10b1
atttttctcaaaatcaacagatcgaagtgaaaatggggggcgtgttcggtttagtgggcagggactttgccatagtggcggcggaccgtcggctgttcacagcatccttgttcacaatctaacgaagataagatcatgatcctcgattctcacaaactcatcgccgccagcggtgaatccggcgacagagtgcagttcacggagtatgtacagaaaaatgtggccttgtatcagttccgaaacggtattcctttgacgactgccgccgccgctaatttcactcgcggtgagcttgccactgccttaaggaagaatccatactttgtgaacatccttcttgctggctatgacaaagagacaggcccatctctgttctatatcgactacattgctacacttcataaggttgataagggagcatttggctatggatcctacttttctctcgctatgatggacaggcactacanaagtggcatgacagtggaagagccattgatttagtgataatgcatatggagacagatctagac

SEQ ID NO: 4145 - DNA, 425 bp, Gossypium hirsutum
  Clone ID: uC-gsronu33B145c11b1
tctcttcgcgtccgttaataattcctacttataaaaaaaaaaaaaaaaaaaagggacactttttaaaacaatttttggttttataaaaaaaaaaaaaaaaaaacccggccctccgctctaaatgttcctatgttccttcccgccctcctttctccctcctgggggggctcttttttgaggttccttgttttccccccccttcttttcacctctttctttttttttttccccccccttttcccttcttattgccctttttttcccccccccctttttgaactcccttgtttcccccattttttccccttgcgccctctcccctttttcccctttttttttttctaatggggccccccctcttttccccttttcatctttttgcccccttttttttgcttttggacccccttttcttttgccttttt

SEQ ID NO: 4146 - DNA, 495 bp, Gossypium hirsutum
  unsure (1)..(495): unsure at all n locations
  Clone ID: uC-gsronu33B145d05b1
cttctttattaacgctgaaggctctcagcggaaacaggttgttccagaccaaccgaaatggctagagggttaaagaaacatctgaagagctcaatgctccaaggcattggatgcttgaaaggcttggcggtgcatttgcacccaagccctcatctggaccacacaaatccagagaatgcttgccgctcattctcattctgcaaaacagattaaagtacgctctaacatatagagaagtgattgccattcttatgcaaaggcatgttatggtagatgggaaggttaggacggataaaacataccctactggtttcatggatgttgtatcaattccaaagacgaatgaggacttccgcctcctttatgacacaaaaggtcgttttcgccttcatgccatcanccgtgatgagaccaagtttaagctctgtaaagttcggtctgtccaatttggtcaaaagagtatcccctaccttaatacgtatgatggacgcacca

SEQ ID NO: 4147 - DNA, 467 bp, Gossypium hirsutum
  Clone ID: uC-gsronu33B145d06b1
gtttttgttttcattcatttgcagccatgaaattcagaagcttttgtttttgcatcccaggagcaaagcaagaagattcagacagttttctaacaaagcaaaatcccataaaaagttgacaaacagtgggaaaaaggacagggaatgtggatgatgctgattatcagggtgccactactactactacgacagccagcagtgatgctggaatggctgctgctgtagcagtgggtgccactacagcacatgcctccgctgtggaatgaagtggttgcgatggttgtcatgcaggtggtggtgttggcggctgatagccggacactatttcaaaaaagctggttcagtttttggcctttggcattcttcatcatattgatttcagaatctttctttcatcttgcatgaaagttgcttggttttttcatctttatatttttggtgttcttttttttttccccgagtctaag

SEQ ID NO: 4148 - DNA, 489 bp, Gossypium hirsutum
  Clone ID: uC-gsronu33B145d07b1
cttacttgtccgcccacgcgtccggttttccccatgtgaaaaactgggaattgcagctgagcacggttttttcatgaggtggtctctaatgatgagtgggaactttgtgggcagatagtgagtttgggtggaaacaaatagcagagcctgttatgaaattgtacacggagtccactgatggctgctctattgaaaccaaggagagtgctttggtctggcaccatcgagatgcagacccgggttttggatctagccaagcgaaggagatgttagaccatctcgagagtgtattagcaaatgaacctgtggctgtgaagagtggccagtttatcgttgaagtgaaaccgcagggagtaagtaaaggtatggttgccgaaaagatcttcacaaccatgtctgagaagggaaagcaagccgatttcgttctctgcattggtgatgacagatctgatgaggaaatgttcgagatcatcagcaatgcattttcta

SEQ ID NO: 4149 - DNA, 479 bp, Gossypium hirsutum
  Clone ID: uC-gsronu33B145d08b1
cttactcgtccgggcacaagtccatgaagcagcgggtgaatgttaccccgaaatcaagccttctgccgactactacaagtttcgacagtcaagctgacatcatgtctattttggctacaaaattatcatgtccatgtcaggttctgaagtttgaagcagtgaaagctaacatcatgtcatccatgtagtgtagaaaaatgggagtgatattttcatcttttgtccgatctgacctactgagtaccatttttgtagttaaaaagctctttgtgttgcagttgcagagtgaagagctgtaagtaggagacggcaaaaaaaagaagggtagtgatgctaatgtatttgtagcaactctttttgcctttagatctttcccaaaccagtagtgcttctcatttctttccccacttagatagctttattgtttttcatttattattggctaaatggtataaaagatcattaaacagtagcaatga

SEQ ID NO: 4150 - DNA, 432 bp, Gossypium hirsutum
  Clone ID: uC-gsronu33B145d10b1
ctttctcgtccgaaagatattaccccaattggtgggttccctcactatggtgttgtgaaaagtgattacctgatgatcaaaggaggtgtgttggacctaagaagagggtggttaccttcgtcagtctcttattaaccagacatctcgtgtggctctggaggaaatcaaactcaagttcatcgacacctcctcaaagtttgggcatggacgtttccagacaacacaggaaaaacagaagttctatggtcgactcaaggcataagtttgggaagtggtcaggaattttgggctattgtatgtttaggttttgctttacttcatgcttagtatgtcttattctctattcctttttgaaatggaacagtttgggtttcttttgttctgtcagtctggattggatgtttgaacttctgaggattctcaacagttttt

SEQ ID NO: 4151 - DNA, 542 bp, Gossypium hirsutum
  unsure (1)..(542): unsure at all n locations
  Clone ID: uC-gsronu33B145e03b1
tatctcgtccgcccactcttccgaatggatctgcgatgttggagcgaatgactgcctgtgatgcaagaatctctttgttctcgttccgtactattatacggaagccgatctaaaccccaggcgttcgaagctgcatcgaaatgaatggaggtccatccccttttatatatctgttggagattgccagatgaatggagagtaagatttcttccttttgttactgcaagttctgtaatatagacactgattttccttgctatttctgatcctgacatgagtctttttccataaatgagatgatttctgctaaaccaaatgaaccaaaggctacagcaaaaaagttgaagctgctcttcattacctcgatcaaaaacccagggcacttaataaaaatatgccagctattttcttcagcagaaccgcacctggggcaaagagtgtttatcactaccctctntattntgagattgacaaaggacgggataaaatcccaagaatcctccaaatgtcatctgaaattttggagggatatgtaacttcca

SEQ ID NO: 4152 - DNA, 504 bp, Gossypium hirsutum
  unsure (1)..(504): unsure at all n locations
  Clone ID: uC-gsronu33B145e04b1
cccactttttcgcttgggttgagtgtagagatgaggagaatcatgggtgccaaagttctttgcttctttgctttgctttccttttcagcttctcggcatttgcacaggatgaggaagacaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacacgaaggagcttgtctgagaaggagacagacaggagctctggcctaaggaatttcaggtacattgagaccatcaaagaagctgtagaaagggaatgtcctggagttgtttcttgtgctgatatcctngctctgtctgctagggaaggcatcgtttcgttgggaggcccttatattcctctcaaaactggaagaagagacggtagaaggag

SEQ ID NO: 4153 - DNA, 396 bp, Gossypium hirsutum
  Clone ID: uC-gsronu33B145e06b1
tatctcgtccgccttgttagagcccacgggtctgattaccatcccttgtggtgtattttagattaggaatgggggtgggtccctcgatggtgaaaagtccttcatcatcatcatcatcatcaccatcacgtccgggcgttttaggggttcgatgaacaagaaaaagaaaaaagtctgttattaaccacctcaaatgatagaaagaaaaaagggtttttatggtttagcaagtgccaaacaatactaggccaacttaaccataaatgaaataggcttgattgctaatcattagtgtattagctcctgaaatttacgactgttttttataattcgagagtgagatccacttgcaaattgatgacttgattaatacgaatattttatcactccaccagt

SEQ ID NO: 4154 - DNA, 352 bp, Gossypium hirsutum
  Clone ID: uC-gsronu33B145e07b1
aaataatttcccctcaatccattttttcacgtagtgtgttaatatacgatccagattcaaaacaacgtcgtttaaagttcagatggatcaacggcgaagccagcgggtggtcgaagggaggagtgaagaagaaggcagtatctaagtcggtaaatagcggggctccaatttcccgcgggtcgtatggctcaggtcctcaagaaaggtccttatgcgcagcgatacggcggaggcgctcccgattatcttgccgacgaccttgagtatcatgccgctgatgctgaggaactggccgagaatgcagcacgtgacaacaaacagaacaggatcaacccctggcacgttctactag

SEQ ID NO: 4155 - DNA, 266 bp, Gossypium hirsutum
  unsure (1)..(266): unsure at all n locations
  Clone ID: uC-gsronu33B145e10b1
aaaatcaggcccttgaaaagcttttatccagctgatctgtgctggagctgccaattgttctacatcttttagtaattcttcacctactggtgaatttgaacgccatacaatgacacattatatctgaatataagctgtttctaattactgagttctgattccataaatttccatttttcgttgaccatgcttaanaaaaaaaaaaaaaaaaaaaaaaaaaaaaaaaaaaaaaaaaaaaaaaaaaatattaaaaataaaaaataaaa

SEQ ID NO: 4156 - DNA, 331 bp, Gossypium hirsutum
  Clone ID: uC-gsronu33B145e11b1
ccttctcgtccgatttgtggcaatgggcagtgcttcaagcggcatgaaggtttcagtcgttgttcatcccctgccttcgcccactgcgcacccgctgcctcccattcatcaaacagcccaacgccgctggactggtaattttgccaaggggtataactggtttcagaactttggttgttgccttagcttctatttggtttggatctgggtgggtttagcaggactttcagttggctgcttaagcttagggaactgtatttttttaaaaatgatttgtgacacttatttttcttgtttttgtttttagtgaaattcgggtggtgtttcgttg

SEQ ID NO: 4157 - DNA, 496 bp, Gossypium hirsutum
  Clone ID: uC-gsronu33B145f02b1
cccactttttcgaacatgttcttgggcggcattaacaccggcgcgcttatagtgatctgggcagtggcggagctggcgagaaagccaaatttatgaagaaagctcaggacgaagttcaggggtggtggggaagaaaggaagagtaacagaaaccgatctggatcaacttcaatacctgaagatggttcaaaagagactctaagactgcatccacctgcgcccatgctgatcgccagagaagccatctcacacttcaacatcaatggttaccacatttatcccaaccctccgacgaccacgtcaacttgctgctccgccctctcccacgctgacatgcgttgcctatgctcatataagaactccaagctcttgccttcccttggtattgacccaaaccttgccatgaaattgcctagcttgtgcaagcttcctcatcctgcagattgatagttcctgggtctacatatttgatcttaaatgtgagggaaaatcatgc

SEQ ID NO: 4158 - DNA, 476 bp, Gossypium hirsutum
  Clone ID: uC-gsronu33B145f04b1
ataagtttttgtctcagatttttgaagatggcccgtaggaagcagacagcccgtaagtcggctggtgggaaggctccaaggaagcaacttctaccaaggctgcccgtaaatctgccccaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgtgcgatccacgccaagcgtgtcacaattatgcccaaggacatccagttggctcgtaggatcagaggagagcgtgcttaatttccatgtgtgtggatcagtcgcttagaaagaagaaact

SEQ ID NO: 4159 - DNA, 475 bp, Gossypium hirsutum
  Clone ID: uC-gsronu33B145f05b1
aaaaattcaaaccttgatgtttcttagtgtatgccaaagtatgccaaatgcaagaactaaatctacttattgtttccatgttcctattcttgttgcaccaaatatgccatagagatttgaattagaaaataccctattagatggaagtcctgcacctcgtttgaaaatctgcgattcggttactctaaggtttgggaataattaattatatatagtccatcttaagtgtcagttgctttatgattttccagtcattaagttgtttttttaacacttggtgtagtcatctctgttgcattcaagacccaaatcaacagttggaactccagcatatatagcaccggaagttctggcgcggtgagagtatgatggaaaggtattatttcaactgtataaaaaataaaagaagaagaagtcatatctgtgtgaattccaaattactaattagtaattggccttcgtatgtgaaataact

SEQ ID NO: 4160 - DNA, 411 bp, Gossypium hirsutum
  Clone ID: uC-gsronu33B145f09b1
gatgtttaacgcgctgagcgtaagcggatcaatgcgggggggaaaagagactcaccaggatgcccctagtaacggcgcgcgagccggacatgcccagcgcgagaagctgacagctcggctggcgaagggcagcctggagaagcgttctcagagacggaccggacccaagtccgctgtaaaggggcgcctactagggtaagagcaccatggcgccctgaccctagaccaccaagaggcgctgactccgagtgatgttgtgtgtgaatgcagccataatctgtcgggacattgcgtccaaggctaagtactggcgagagacgaagagctaccaagacccgcgagggaaaggatctactggttgtatggttctttaaccatcggtgcttccatgagcttttcttttttatttct

SEQ ID NO: 4161 - DNA, 518 bp, Gossypium hirsutum
  unsure (1)..(518): unsure at all n locations
  Clone ID: uC-gsronu33B145f10b1
ggttttcaagggaaaaagaaaaccctagctttacgggggtgttctttgagaaacatcgggtcgcagagatggatctttcatagatttccctcagatctctttctctttgtaaaagaaatctgggtttacttatttatttgggtcggattgggttggtttggttttagaaaagaaggaaggcgatgtcaaccccagcaaggaagaggctgatgagagacttcaagaggttacagcaggatccacctgctggtattagtggggctcctcaagataataatatcatgctttggaacgctgttatttttgggcctgacgatactccttgggatggaggcacgttcaagttgactttgcagtttacagaggattatccaaataagcctccaactgtccgtttcgtctcacgaatgtttcatccgaatatctatgcagatgggagcatttgtctggatantttacanaatcagtggagtcctatatatgatgttgcagctatactcacctctatccagtctcta

SEQ ID NO: 4162 - DNA, 560 bp, Gossypium hirsutum
  unsure (1)..(560): unsure at all n locations
  Clone ID: uC-gsronu33B145f12b1
gctaattggggttttgttctcgctggattggtgggtgggaataagcccccagaaatgattggtggcaacatgacatcagctatgtgttctattctgcattattcatgaggtttgcaggatggtacaaccacgaaactatctactgttggcgtgccatgcttcaaatgagacagtacagctctaccaactctcccgttgggcaagagctcaagggtatttgtcggagaagaaagacaaagctacatcgcagtaaagcagcagcttcagttggagctagctgcttttcgattctttccattccaagtgtctgtgagttttactgtgatccgtgaagattgtagtattctgaacctactattaaagcattcattttgactgctaaaccaataatgattgttggagtgcatcttgattgaccctataatgtgttctgattcttgattttacctgttaaaaaggtaaaattagcttagagttacaatcactgttgatttgggcatcaagtcatgcttttataaactnggaatcgattagcagatcacagaatgataattttaaca

SEQ ID NO: 4163 - DNA, 511 bp, Gossypium hirsutum
  unsure (1)..(511): unsure at all n locations
  Clone ID: uC-gsronu33B145g01b1
cccacttgttcgatttgattgtgcaacatatccgcactaaggtcggtcagcatgatctctgcagaatatatcccaatgtatatgtaattagtcaacatttcagattagaggaatgcatctctgattagagaccgggacatttctaaacatgattttgtcttctattctgatcggcttattcgtctggtgggagagcatggtcttggacatctgccgttcactgagaagcaagtagtaacaccgacagcaacggtatatactggggttgatttttgcaaaaagttgtgcggcgtttccattgtccgaagtggtgaaagcatggaaaacgcattacgtgcatgttgcaaaggaataaaaattggaaaaattttgattcatcgtgagggagatgatgggaaacagcttatatatgagaagcttcccacggatatttcagaacgccatgttcttcttctcgatccagntcttgctacagggaactcggctaaccaagccatcgaactactcatac

SEQ ID NO: 4164 - DNA, 356 bp, Gossypium hirsutum
  unsure (1)..(356): unsure at all n locations
  Clone ID: uC-gsronu33B145g02b1
cccacttgttcgcggacgcgtgggcgaaaagttagggggttcgctccttacgattatcgagagcgtccttttgaattgaagtatgggaagaggaaatcaagagcaaagcctgctcctagaagcggatggataagcttgacactgtgttcagctgccccttttgtaaccatggaaccagtgttgagtgccgccttgatatgaaaacttgattggcgaagcctcttgcagaatatgccaggaaagctntagcactgttataacagctttgactgaaccaatagacatatacagtgaatggattgatgaatgtgaacgtgttaacaaccttgaagaagaggacgatggggatcaggatg

SEQ ID NO: 4165 - DNA, 307 bp, Gossypium hirsutum
  Clone ID: uC-gsronu33B145g03b1
aaaatttatttccacaccctaaagagacaatgacaaagctgctagcctttgccttacttttgttcttcttttgggatcaaacattacctcaatagctccggcgccgccgagtaaggtggcaacatcacttacatacttgaaaaaggtggccaattcaccactttcatcaagctatttgaagccacacagggggctgatcaactaaacaaccagctaagcacaccggaccataacgacggaataacggagtttgcaccgagtgacagcgcgttctccggactcaaacccgggacgttaaactcacttt

SEQ ID NO: 4166 - DNA, 550 bp, Gossypium hirsutum
  unsure (1)..(550): unsure at all n locations
  Clone ID: uC-gsronu33B145g04b1
gctgtttatcccttcgcgccgctcttcatttttcttcggtctaaggaaagctaaatccggggtcccaatttcagctcaaaaatgtcgggagggaagttgcagttgccccaactgaggttgtgctgccattggtgagccaatggacatcaacgcagccttgcctcttgtgattaggaagtccaaagctcatggtgggcttgcacgtggtttacacgaagctgccaaggcaattgaaaagcacaatgcacatctttgtgttttagctgatgattgtgaccagccagattatgttaaactggtcaaggcactctgtgccgatcacaatgttaaagtgctacgtgcacctagtgcaaaaactctgggcgagtgggctggtttgtgtaagatcgattctgagggaaaggcaaggaaggtagctggctgttcttgtgtagttgtcaaggattatggtgagcaacatgaggctgtcgaagttgttcagcagcacaaggattaagcanatcagaggatggttgccttggtatgctgagtttttttggtatttaacgag

SEQ ID NO: 4167 - DNA, 493 bp, Gossypium hirsutum
  unsure (1)..(493): unsure at all n locations
  Clone ID: uC-gsronu33B145g08b1
aattattgcaatgcacccactccaatcatgccttgtttaccagcctacaatgacaccaacactgtcacggccttcagccaaagcttagaagtcgagaaaaggccgaagtcccaaccatatagatgaaagcctgttcttcacaatcggcctcggactcaacaactgcccacctaatttccgaaaacgtcgttgccaggacccaacggtacacgtttcacagcgagcatgaacaatgtctcattcgtgctcccacggaacttctctctgttacaagctcatcagcaaggaattccaggtgttttcaccacagatttcccagcaaaccctccattgaaatttgactacaccggaaacctgagccgatcgctctttcaacctgttccgggaaccaagttgtacaaattgaagtatggctcaagggtacaaattgtgctncaagacacaagcatagtgacccctgagaatcatccaattcatcttcatggatacgatt

SEQ ID NO: 4168 - DNA, 347 bp, Gossypium hirsutum
  Clone ID: uC-gsronu33B145g09b1
acctccccgtaagcaaaccacaaaggagagcttggtgagagacccaaaaacaatgtctaaggaagttagtgaagaaggaagggtcgtaaggactatgtggaccctccacggcacctctgattgacatggctgaactcaagtcatggtctttttacagagccctcatagctgagttcatagccactctcctcttcctctatgtcactgttgctactgtaattggtcacaagaaacaacaagatgcatgtgatggtgttggtctcttgggtattgcatgggctctcggtggcatgatctttatcctttgttactgcactgccggtatctcaagtggacacaataaccct

SEQ ID NO: 4169 - DNA, 476 bp, Gossypium hirsutum
  Clone ID: uC-gsronu33B145h04b1
gcgatgtactgatcgggaacggaacgttgccggcattggtgagcttctgcaaagaggagtggggtttcaggggggttacggtggcgtcgtctcggatttggacgcggagacggtgaacacttgagaccggaactgaagacagggaatggagtgtcgttgaaagttgagatggatactaaagtgacagcaaaaatgggtggattgatgagcaagaaagttgggattagaattacgtgcgatgggattaaaggggttgtcccgaaaggtaagttgccggcggcggccaatgtctccggcgccaaatgtaaggttgatctccgtatcaagatctggaaatggacgttttgagacgagggataaaggttttccattctgatgaattttctattatggctttggtgttgaaatttgagtgtgaaattggaatttttttttcatttaaaaaatgtaacgtcatataccaattctatcaatca

SEQ ID NO: 4170 - DNA, 485 bp, Gossypium hirsutum
  unsure (1)..(485): unsure at all n locations
  Clone ID: uC-gsronu33B145h07b1
ccgagaataatcaatgagcctactgctggtgccctttcatatggaatgaacgacaaggagggtctcattgcagtctttatcttggtggcggtacatttgatatctcattttggagatttcaaatggtgtctttgaggtcaaagcaacaaatggtgatactttcttgggaggagaggattttgacaatgcattgctggatttcttggtgagtgaattcaagaagactgagggaattgatctttcgaaggataggctcgcacttcagaggcttcgggaagctgctgagaaagctaaaattgaactctcatcaacatcgcagactgaaattaatcttccatttataacagctgatgcttctggggcaaaacacttgaatatcacattgaccagatcaaagtttgaatctttagtaaatcacttgattgagaggaccaaagctccctgtaagaattgcttgaaagatgctggcatttccacanatgatg

SEQ ID NO: 4171 - DNA, 472 bp, Gossypium hirsutum
  unsure (1)..(472): unsure at all n locations
  Clone ID: uC-gsronu33B145h08b1
atcaggggaatgtctgatcactctaccatggggatgaataagattcttgagacgtgggatggctttgagggactcaaaacatggtcgatgttggcggcggtactggagctcgcttaacatgattgtcaccaagcacccttctataaagggcatcaactttgatttgcctcatgtcattggggatgctcctgcttatcctggtgtggagcatgttggtggagacatgtttgaaagtgttccaaaaggagacgccatcttcatgaagtggatatgccacgattggagtgatgagcactgctccaagtttttgaagaagtgctacgaagctttgccggacagcggaaaagtaattgttgcagaatgtattctcccagattacccagatcctaaccttgccacaaagntagttgtccatattgattgcatcatgttggctcacaatccttgtgggaaagagaagactgagaaagaa

SEQ ID NO: 4172 - DNA, 425 bp, Gossypium hirsutum
  Clone ID: uC-gsronu33B145h09b1
ccttctcgtccgcccacgcgtccggaaaaacacaggaggggatagaagcaaggcgatgatgatggcagtggcagctgtcggattggtttagtgctaatggtgcctcaggccgatgtacaaggtacattgctggagggggaggcatcggctggactactaatgtcaattacactgtctgggctcgaggaaagcacttctacaatggcgactggctttattttgtatatgatcggaaccagatgaatgtgctagaggtgaacaagactgactacgagtcatgcaatgctgatcatcctcttcacaactggacaaccggagctggaagggatgtggttccgcttaatgtgactcgccactactatttcattagtggcaaaggattctgctacggcggcatgaagctagcagtgcgtgttgagaaccct

SEQ ID NO: 4173 - DNA, 571 bp, Gossypium hirsutum
  unsure (1)..(571): unsure at all n locations
  Clone ID: uC-gsronu33B145h10b1
cctatgtgtccgcccacgcgtccgcccacgcgtccgggttcttcttcttcaaacaagcggaaaaacaagaggaaaaaaatgggtggagaagaaaggtctacactttggctgaggtttccaacacaaccatgctaaagactgttggcttgtcattgagggcaaggtatttgatgtgactaaattcttggaggaccaccctggtggcgatgatgtcttgctgtcttccacagggaaggatgcaactgatgattttgaagatgttggtcatagtagcagtgctcgagcaatgatggatgagttttatgtgggtgacatcgatacatcgaccatcccctctaagaggaagtacactcctccaaagcagcctcactacgaacaagacaagacctcagaatttgtcataaagcttctccaatccttgttcccctgctaatcttgggattggcctcngtgtccgcttctataccaaaacaccagcttcatcttaagcattgagactccccaagagnataattgaacaatcttcacaataagattatgctagntnaaattngtttggaattttcacata

SEQ ID NO: 4174 - DNA, 222 bp, Gossypium hirsutum
  Clone ID: uC-gsronu33B145h11b1
aatttttgtaggctgtgatagtgtttgatcaaaaccttatgttaatgctttagatgttgccatgttattcttttagatgcgcatgccactaagggagaaatgtacctctgaatcctgtggttccttttgaccttcagaaattaatagttgtagatgggataatctgcttctatatgtacttttgatttaaagttgaatggcttagataaatcctttttgtag

SEQ ID NO: 4175 - DNA, 529 bp, Gossypium hirsutum
  unsure (1)..(529): unsure at all n locations
  Clone ID: uC-gsronu33B146a01b1
ttcgtccgacactattttcaatgttaaggctaagatccaggacaggggaggtatcccgccggaccagcagaggttgatcttcgccggaaagcagcttgaggatggtcgtacacttgccgactacaatatccagaaagaatcaacattgcatctggttctgaggcttcgtggtggcattatcgagccatctttgatggcattggctaggaaatacaaccaggacaagatgatctgccgcaagtgctatgctcgtctacacccccgtgctgtgaactgcaggaaaaagaagtgtgggcatagcaatcagctgaggccaaagaagaagatcaagtagattggatatcttgatggagttttaaagtcattcaatttcagatgttctgtttggaatttgaatggtgtagtgctaataacagatcttaattaccttctaagttggctttgatttctttaagcttgaacctctnccttgtttatgtcattaattttgaaatttatgatatgatatcggagttctctaattatggnt

SEQ ID NO: 4176 - DNA, 367 bp, Gossypium hirsutum
  Clone ID: uC-gsronu33B146a04b1
cccactcgttcgcgatcactctcgaggtcgagagctgtgagactatctacaacgtgagtgccgaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatctttgtcaagactttgaccggtaagaccattactttagaagtggagagctcggatacgattgataacgtgaaagcgaagattcaggacatagaaggaattccaccagatcagccaaggttgatttttgctgggaaacaagttggaagatggaa

SEQ ID NO: 4177 - DNA, 233 bp, Gossypium hirsutum
  Clone ID: uC-gsronu33B146a05b1
ggcataatttcagtggcgagtgtagtagcatgcatgttgctgtttatctcctccacagtgtggatgggtgaagctagaattccaggagtttattctggtggcgcatggcaaaacgcccatgctacgttctatggtggttctgacgcttcgggcaccatgggaggagcttgtgggtatggaaacttgttcagccaaggatatggagttaacaccggtgcattgagcactgcctt

SEQ ID NO: 4178 - DNA, 318 bp, Gossypium hirsutum
  Clone ID: uC-gsronu33B146a06b1
gggcttggtatgcagggttgtgcgtcccgcttttaatgacgcgcttgtaaacaacctacctgtctaggcaatgtacccggttccaaagtatgtatttgtagatatgttggggtgtgatttgagtgacacattgatcccaatttcaagggctacttgcattggtttgatgtgtcgtatattgtcacttttaagcatagttatactgaactgagatccggacaagaatatcttgtatggtgatcttaatgtgttgggtgggggaagtatttaatttagaatagatttgttgagaagccgcaggcatgggggcatgcctat

SEQ ID NO: 4179 - DNA, 334 bp, Gossypium hirsutum
  Clone ID: uC-gsronu33B146a09b1
ctcatgcgtacggtgtttgtctattgaattctggggggtgtttttttaaagattttggggggtccccacgttgcaattgcggatctagctgcagctgcggcgacagctgctcatgcagcaggaaccttaaccttggatactcggagaagacaaccagcactcagaccatcatctccggagttgcgccagtgaagatgaccttcgagggaccagagatgagcactactgaatcaggacatggatgcaagtgtggatcaaactgctcttgtgatccatgcaactgttgaaaagcttgattaaagccctagattatgaaaaaagaaagcagccaaat

SEQ ID NO: 4180 - DNA, 121 bp, Gossypium hirsutum
  Clone ID: uC-gsronu33B146a12b1
ccggttccaaagtatgtatttgtagatatgctgcggtgtgatttgagtgacacattgaccccaatttcaagggctacttgcatcggcttgaagtgtggtatattgtcacttttaagcatat

SEQ ID NO: 4181 - DNA, 295 bp, Gossypium hirsutum
  Clone ID: uC-gsronu33B146b04b1
tacttcgtccggcaattcctgttcttgagcgctcgatcgagattccagtggttgtggatggccaaactgatgcacttgctaaatttgctggatgcatgcagttaggtgatacctatgcaatgcagggccaaatcgagaactcaatattgtgttatacagcaggtttggagatccaaagacaagttcttggagaaactgatcctcgagtaggcgagacatgtcggtatgtggctgaagcacacggacaagcactgcagtttgatgaggctgagaagctttttcaaatagctcttga

SEQ ID NO: 4182 - DNA, 276 bp, Gossypium hirsutum
  Clone ID: uC-gsronu33B146b07b1
ttcatgcgtccgcccacgcgtccgcgcagctggcattttcgtaagtctaccaccgctgctctcaatcccttccacttcgccatggcatcagagaagaagctttcgaacccaatgagggagatcaaagtccagaaacttgtcctcaacatctccgttggtgagagcggcgatcgtgttacacatgcggccaaggtcttggaacagctcagcggtcaaaccccagtctattccaaggctagatacactgtgagatctttaggaaatcggcgtaatgag

SEQ ID NO: 4183 - DNA, 415 bp, Gossypium hirsutum
  unsure (1)..(415): unsure at all n locations
  Clone ID: uC-gsronu33B146b09b1
caaatataaagcacaacgcggcaccaccgcgccggaacttgccggaccgacccacgcgaccgctttatcaaacccaaagngaagaaccaaaacggggagggaaaaaagaacggaccagggagaagaaacacaccacgccaggaaagcaaaactgaggaaggacgaacacctgccgactacaatatccagaaagaatcaacattgcatctggccccgaggctccgtggtggcaatatcgagccacctctgatggcactggctaggaaatacaaccaggacaagatgatctgccgcaagtgctatgctcgtctacacccccgtgccgcgaactgcaggaaaaagaagtgcgggcacagcaaccagctgaggccaaagaagaagaccaagaagaccggatatctcgacggagatctaa

SEQ ID NO: 4184 - DNA, 328 bp, Gossypium hirsutum
  Clone ID: uC-gsronu33B146b10b1
tggatgcgtgggcaaagttcttggccggagctgtgtgcaataggaagcattgctatgccagctatcttaaaacatgccggagttatcagttggggcgcattggcaatggaactttcatcgtttttcgtttttgtactggccataatgttttatattcgaatgaacaatgatgatgattacagtttcttctgaaaaatcattacagtttcttctgaaaaatcatgttgaaagcactgtaaaagtttgttcataggatgctataccttttccgttttgacaagcttcattcatgtttgttctttgtctttaacaaaaaaataactttttt

SEQ ID NO: 4185 - DNA, 169 bp, Gossypium hirsutum
  Clone ID: uC-gsronu33B146b11b1
tccatgcgtccgcccacgcgtacgaagctgatgtggtcaacaatcttggtacaggcgcaagatctggtactaaggagtttatggaagcactggctgctggtgctgacgttagtatgattggtcaacttggtgttgacgtttacttgctttactaaatttttgggatgat

SEQ ID NO: 4186 - DNA, 116 bp, Gossypium hirsutum
  Clone ID: uC-gsronu33B146b12b1
tcattcgtacgattgaccctgttgcgaccgaggaagttttatttactgatgttttgacttttgaaaccaatgccgagaggccatttgtggctgaccctgattatgtatttccgact

SEQ ID NO: 4187 - DNA, 343 bp, Gossypium hirsutum
  Clone ID: uC-gsronu33B146c01b1
cccttttatataagccaaaaaaaaaaacaaaaaaagggaaaaattaaaaaaaaaaaatggggaaaaaaaaaagccaaaaccaaagctaatacggccggcctcatcggaggacccagggttccccccgcgtccttgcgcggctccacctcatataccgggtcacgtaaccagacccccttggcctacgcgtgccgcctccgcacctggcccaacctgggagtcccccctcgtctccccctggctgtccttgcccgcttagccacttggcggatgctggtaaaggcccaaagaggtcgccctttccaaccttggccccccctgaaggggccttggtgccccccct

SEQ ID NO: 4188 - DNA, 430 bp, Gossypium hirsutum
  Clone ID: uC-gsronu33B146c02b1
gcttaattagttacaaaatctcggccaaaatgggttatttcaatggcattgctttagcatgcttgatggctttgtcgctttcaagcattgatgttggcctagcagctcgacaccttcagcagatgtcaccaatgccaacattgcctacaactacactcccaccattggcatgtatccctaatctcccgcagccaacaatgcctaggcctggggcgcttccaccacttcctaccatgcctgctttgcctacttttgctgctataccaacggccacactggctcctctgccaagcatgccttcaatcccaacaatcccaactgcaattccctcaattccattcctttctccaccaccttctccttcttctactccttgaaatacccatttcttcccgtctattgacagataaaatgtggctacatatatact

SEQ ID NO: 4189 - DNA, 378 bp, Gossypium hirsutum
  Clone ID: uC-gsronu33B146c04b1
cttgtacttcttgaggaaattggcagagcaattccagaagcaggcacctgctgccggttctggtgacggtaccggtgcagccactactcaggaagaggacgatgaggaggtaccagatcttgtacctggcgagacctttgaagctgcagcagaaggccaagctgctaaatagagtttttatctttaattttcttttgttatatgtttttgatgaatttaactatttgtttctttttccaaaatttctctatctgtggtttttgtttgctctaccttgtactcttaatggtttggttcagggtaagccttctagaattcctattattattgccaatggattagagatgcattttcccaaaggccaatagttatgtcctg

SEQ ID NO: 4190 - DNA, 511 bp, Gossypium hirsutum
  unsure (1)..(511): unsure at all n locations
  Clone ID: uC-gsronu33B146c05b1
ggcttgtgttcgatctggtctcctacgagcagcccggggcggctgctctcgtcctacggctcctcccacgcgtggcttcgcttcctcttctcatcacgatgatgcttatgaaaccgcataatgggaaaagataacatatttaggtgttgctacctgcactgttttagcgatttataacctatcaaaaggtcatccccaccatgaagagcctcctgcatacccatatttgcacattcgcaacaaggagttcccatggggtccggatggtctgtttgagagaaaggagcatcactagggatggccggatggatgcatatctttccgagttcggcgcatttttatcatttctctgagaaatcaatcagataattctgtggatcttttggaattttagcactcgatttccggtttatggactttgaattgcaagttcatcangttttctatatggttgtgcctgcctaccatacttctgttcgaaataataagattactgaatggnttgctgtgg

SEQ ID NO: 4191 - DNA, 454 bp, Gossypium hirsutum
  Clone ID: uC-gsronu33B146c06b1
ggagttgtttcatgcatagtgaggaatgctccacgcgggcttggttcaccagtttttgataagcttgaagcagagcttgctaaggctgtaatgtcactacctgcaaccaaaggctttgaatttgggagtggatttgcaggtactttcttgaccggtagtgaacataatgatgagttctatactgatgaacatggaagaataaggacaagaacaaatcgctccggtgggatacagggtggaatatccaatggggaaattataaatatgagagtagctttcaagccaacagctacaattggtaagaaacagcacacggtgactcgagaaaaacaagagatagaactactagcccgtggtcgtcatgatccttgtgttgtccctcgagcggtgccgatggttgaagcgatggtagcgttggtgcttgtggaccaattaatggcacaatatgcacaat

SEQ ID NO: 4192 - DNA, 343 bp, Gossypium hirsutum
  Clone ID: uC-gsronu33B146c07b1
ttaatggaagcctcatcttcacaccatggactggcaatcctattcattgtcctgggttcacaaatagccttaaccttagcttatccaccatttctcaacgatagaaacattgaatacatcaaatcttcatgcagcaccacaacatatcccaaattatgttaccagtccctctcagtctatgcgagcagcatcagcaccagccccaaattgttagtccacactgcactcaatgtaactcttagagccagcaaagcgacttcgaggttgatggtaaagatctggagattccacggtttggaaccaagggtagctgccgccatggctgattagatcgaggtgatcg

SEQ ID NO: 4193 - DNA, 329 bp, Gossypium hirsutum
  Clone ID: uC-gsronu33B146c12b1
tttcttttttccggttccagatgatgaaactgggcagtgtttgttaaagaacatgtttgggctacataccaatggttacaatggtttgtatcaaaatcagcagcccaacagcctcaaactagtagctttgtgtttcagagctccactgtcacttatggtggcgctgatggagcttaccatacttcatcaaaaacaaggagaacatgtgtgtttgttcccaaacgcataaccaccgattattaagcctaatcagggtttaattgatttgtctgtcactttgaaaccggattttcttctatcacatctgagtctcctatctctttacttac

SEQ ID NO: 4194 - DNA, 523 bp, Gossypium hirsutum
  unsure (1)..(523): unsure at all n locations
  Clone ID: uC-gsronu33B146d02b1
ggagagccttttttgtgtagcgattctcagttagtcttttctttaagcttacagcttctctccagagttttataatgggtaaggagaaggttcacatcaaccttgttgtcattggccatgtcgactctggcaagtcgaccactaccggtcatttgatctacaagcttggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcgaccactggtggttnctgagctggtatctctcaagatggtcagactcgtgagcatgctttgcttgcttttaccctcnngtgtaggcagatgatttg

SEQ ID NO: 4195 - DNA, 409 bp, Gossypium hirsutum
  unsure (1)..(409): unsure at all n locations
  Clone ID: uC-gsronu33B146d03b1
tactgtcgtccgaaatttatttaactttgaacaaatttcaaagattttggttttcttctgcaatttctcatccaccaattgaatcaggttgtgaagtattgagggtgtttattatttgttgnttttttataatcactgatgtctccgccgctgcttgtcgtggaggaggaagggattcagagcaatgttactttactcggttcttcaggctcaatggatagtgtgtgccagaatagtgctgacttgaaggaacggaactacatgggcttgtctgattgttcttcagtggatagctctgtttttttcccctccgttcgaggaaagaaaggctcgtctgaatctaaaggcgactgagcttaagctcggacttcctggattgcagtcgcctgaaagaaatccagagctttgc

SEQ ID NO: 4196 - DNA, 499 bp, Gossypium hirsutum
  unsure (1)..(499): unsure at all n locations
  Clone ID: uC-gsronu33B146d04b1
ggctttctttacatacccaaggacgtatgatctcatgcatgcacatggtctattcaggtggtacaaggacaaatgtaatttggaagacattttattggagatggaccgaattctgcgtccagaaggtgcggttatattccgtgatgaagttgatgttctaattaaagtgaagaagataacagcaggaatgaggtgggacactaagatggtagaccatgaagacggtcccttggttcctgagaaagtattggttgctgttaagcaatattggaccgttgggggaaacacgacatctgcacagtaaacagcagacggcgacaagcttaaaccgtggcatgaactgagtttgtggattatattcaattgatgaatttccagcctgaaaatttttgccagcaggattgttttggtgggtcacaggattaggtgaactaaagatcagnctgtattcatttgattaatttatgaacagatagctatatactatgcttccaagntt

SEQ ID NO: 4197 - DNA, 487 bp, Gossypium hirsutum
  Clone ID: uC-gsronu33B146d05b1
cggttctttggcggacgcgtgggcaactatcaatggttagtttcattgcattaaatggatcatgaaatctttcctttctttttttgcattcctctcacttctcctgtttgtagacaccattgcagcagctaggaaagatgctggagagtactggggagctgtaacgaaagatcagcctatgcctgaggcactccaagagcttgttcggattgaggctgccgttgtcagccccgatgagaaaaccaagtgccatacatcagttaatattgagcttaaggaagagaagattattgttaatgaggagttcgaaccaaggccaaacgtttcagcttatggtgatgacgctaatctaaaaggagataaatcatcatcttttgctgaagattttgaaccgagacctaacgtttcggcttacggtggcgatgatgctggtcttaaaggacagaaagaatcattcactaaagatttcgatccagagccaaatgtc

SEQ ID NO: 4198 - DNA, 212 bp, Gossypium hirsutum
  Clone ID: uC-gsronu33B146d06b1
ctctacttgtccggaagtgattaagacgtgtctgaggttagattattggaatagatgtcgatgaatccaggaacgaatcaatgtagtacgatgttgtgattttagttagttcataggatcatattaattgtgcgtgtgtgtgttatttttcttatttcaaagctaagcttgttttgtatgaactttgctttatttttatttttattttgtat

SEQ ID NO: 4199 - DNA, 472 bp, Gossypium hirsutum
  Clone ID: uC-gsronu33B146d07b1
tttaatattgaagaaaaaaaaatccatcaccgatctaagttccccaaattctgttcaaatcgccggcgaaattttgatctgaaaatctaaaaatgtcgtccacattcagcggcgatgaaactgctcctttttttggcttcctcggtgccgctgctgccctcgttttctcctgtatgggagctgcgtatgggacggctaagagcggtgttggtgtggcgtcgatgggagtgatgaggccggagctggtgatgaaatcgatcgttcccgttgttatggctggcgttttgggtatttatggtttgattattgcggctattatcagtactgggattaacccataggctaaatcttattaccttctcgatggctatgctcatctttcctctggccttgcttgtggtcttgctggtctctgcgccggcatggctattgagatcgccagcgatgctggcgttagagccaatgcccaaca

SEQ ID NO: 4200 - DNA, 130 bp, Gossypium hirsutum
  Clone ID: uC-gsronu33B146d08b1
ttcatgcgtccgcccacgcgtccgggggattgatccctatgaactttttgttcttgttatagtgtaaagatttgtaatagaattgggatgtttgataaaaatgttcttttattaaatgctttgtcaagac

SEQ ID NO: 4201 - DNA, 483 bp, Gossypium hirsutum
  Clone ID: uC-gsronu33B146d10b1
tttcattcgtccgggagaagaaagacaaggctgaggtgattaacaacaataagaaggtaactcaaaaagagggttcacccaagaaaaaacatactttttcttcagcccttactgcaagaagcaaggctgctgctcatggaatagctaaaaagccaaaggaagacattgtttatattgatggagcagatactgataatcatttggctggtgttgaatatgttgatgaaatctacaagttctataaatcagctgagcatgagagcatgccaaatgattatatgcacttgcaaactgatatcaatgagaaaatgagagctattctcattgattggctaattgatgttcatcaaaaattcgagctttcggccgaagctctttatcttacgatcaacttgatcgatcgcttcctttcagtgaaagtcgtcccgaggagagaactacaacttttaggcatgagtgctatgcttattgctaccaaatatg

SEQ ID NO: 4202 - DNA, 431 bp, Gossypium hirsutum
  unsure (1)..(431): unsure at all n locations
  Clone ID: uC-gsronu33B146d12b1
ttttgtattttccctgagaaaaaagaaaaagtgggagtgtcaccctgaaagtcattggtggtgacatatcaactattccaggactttctgatgctattgagagcacaatacgggatgctatagaagataatatcatgtggcctgtaagaaaaattataccgattttgcctggtgattatagtgatttggagttaaagccagttggaatactagaggtgaagcttgtccaggctcgggacttaacaaacaaagatattattgggaaatcggatccctatgctgtattatatgtgcgccctttacctgacaaaacaaaaaaaagtaaaacaattaacaatgagctgaatcctatatggaatgaacactatgaatntgtcattgaggatgctacaactcagcacctggtggtaagaatctatgatgatgagggg

SEQ ID NO: 4203 - DNA, 536 bp, Gossypium hirsutum
  unsure (1)..(536): unsure at all n locations
  Clone ID: uC-gsronu33B146e03b1
cccatgctttcggttttttgagagctaaataaaatgagtcagaattcacccacatcgggctcaatatcaatccatcattcccaacaacaagcagcggcgttagctcctttaaaaaaagatagctcttcgtcttcttctgtagctggtttctttggtaaaaatgggtacaaattctgggttttgactgcaatcatcttacttgctttttggtccatgtttactggttctgtttctcttaaatggtcttcggggaatctcactagtttctcctacgactctgatttctccattcgtgaagatcttgatgttcttgaattggaggaaagagagaaggtagtgaggaagatgggggatgtctatacacatagcacangcattcgtttgcctagattttggcttgatgcttttgaagctgcttatgagaatttatcaagtgaagttaatggagttcgcgataaagccatatctgaaattgctaaattatctatgcagtccctaaatcttgttcccccctcggttcaatcaaagattagcag

SEQ ID NO: 4204 - DNA, 482 bp, Gossypium hirsutum
  unsure (1)..(482): unsure at all n locations
  Clone ID: uC-gsronu33B146e04b1
atatttcttccacgtattggtgaatatgcgtttggagtcatcacttcatctgtaattctgcagagctactctggtgatgaagagctatgttgcgtctatgttcccacaaatcatctntacattggtgatattttcctcatcaataccaaggatgttattagaccgaatctatcagtccgtgaaggaattgaaatcgttgtttccgggggaatgtccatgccccagatcctgtcaacagtagacacacgtttgcctctagaaagtagatccgacagaagctaagatagtcgtagagttgtattttctctgctttcagattcgaatcaccggatcaccccacataatcaatgtgtcggctatccaggattcaatatttagattttgttactggtgtatgtttgattctggtggcatgcgtaacgtcgcttgtttgcgtagaaatgaaaactatttgctttttcaatatagtttgatcgaaaata

SEQ ID NO: 4205 - DNA, 334 bp, Gossypium hirsutum
  Clone ID: uC-gsronu33B146e07b1
tttctttctccagccacaagtttaaacaaaaagaaaaaaaaaaacggggcggttgccatggaggattggattaagttttatcaatgtggtcaagaggctttttcagaccactcaatttgtaaattataatggaggatgtcatgcttttatgtatgtggcacttattttcaatgtgccccatcattatccctgcttttctttcctatttcatggtctttcttcagtttggcttggtgtttctaagttatctttgaaaagttcataaaaatcaagtgctttgctgctgctttatacacacaagcttaattcagttcctatcctttcttctctgatg

SEQ ID NO: 4206 - DNA, 374 bp, Gossypium hirsutum
  unsure (1)..(374): unsure at all n locations
  Clone ID: uC-gsronu33B146e08b1
tcatattcattaatatgattatatatatatagatatttactcatgtatcatattacaaaaactaaaatttaaatacttatacctaataaaacatgtatctcattacaatnaaaaaaaaataattaaattaaaaaaaaaaaaaaaaaaaaaaaaaaaaaaaaaaaaaaaaaaaaaaaaaaaaataaaaaaaaaaaaaaaaaataaaaagaaaaaaaaaacagaaaaaaaaaatataaaaaaaaaaaaaaaaaaaatgggggggccttttttagaaaacaaattttctcggcccgggacgagcatgaacatgttttttttggggggcccaaaaaataaattacggggcctgtttttaaacccttgatgcggaaaaa

SEQ ID NO: 4207 - DNA, 439 bp, Gossypium hirsutum
  Clone ID: uC-gsronu33B146e09b1
tttgtatctctcttacaatctcaccttctttgtttctttttcttcctatttttggccttctcttggccactgtttcttcttttaacaacaatcaacatatataaccatattatatacatacatacacaagttctttccttctaaggaagccatgactggcaaagaaatcctccacaagatgaaggagaaagttcaagaaaaagttggcttaaacccttctagtaatgctgaatctggaaaagggaagagtaagatgtcgaagaatataacgcatggttatcatttagtgaaggggaaagcgaatcatccaatggaagactatgttttcgcggagtttaagcaagtcaatggcagtgagctcggtttatttgccatatttgatggccatttgagccatgttattcccgattatttgaaggcgaacttgtttaacaatatc

SEQ ID NO: 4208 - DNA, 476 bp, Gossypium hirsutum
  Clone ID: uC-gsronu33B146e11b1
tttttatcgaacattttcacagcttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggttaagaatactgttgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtggt

SEQ ID NO: 4209 - DNA, 435 bp, Gossypium hirsutum
  Clone ID: uC-gsronu33B146f01b1
tgtcgtccgcccattcttccgttcattcagttcttcgcgatgaccgggattttgcttttgagcgtgcgatctttgggccagaagtaccgcatccacgacctccaggaggatacagcagctctcaagcaagagcaacaatctcttaatgatcggatgagcaacataaaacgtggcctactccacgaggcctctctcgagccctctggacgctttgcctcacgccttcgcctgctctttggtgacgataattagactcttctgatcctactgtctagtatttgccttgataatatcatatctttagtgtctccaccttacgtcaagagaatgcactgaaatgttaggtttttaaattttgcacttttgctctttgcgtaataatatatatttagaacattcctgaatcatttcaagaaagtcatcgttcttgaattt

SEQ ID NO: 4210 - DNA, 456 bp, Gossypium hirsutum
  Clone ID: uC-gsronu33B146f05b1
gaatttatttacggatcaaagttcgctgacgagaacttgatcaagaagcacactggtcccggtattctctcaatggctaacgctggaccgggaactaacggatctcagttcttcatttgcacggctaagactgagtggctcgacggaaagcacgttgtgtttggacaagttgttgaaggcatggatgtggtgaaagccattgagaaagttgggtctagcagtggaagaacttccaagcccgttgttgtctgcatgatctccaactcaaccagcgttgcggaagtgttttcccgcattgatcataaatttgatctcatgtatgccaagcgtgcatttgtgcactggtactgttggtgagggcatggaggaggagaaaagttttctgaggcacgtgaagatctcgctgcactggaaaaagattatgaagaagttggcgctgagtctggtgaaggagac

SEQ ID NO: 4211 - DNA, 444 bp, Gossypium hirsutum
  Clone ID: uC-gsronu33B146f06b1
agagcgaaggaggaagtcagttcgcgggtgcattgttagtcaagatctttcagttctgaacttggttattgttaagaagggtgaaaatgatcttcctggattgaccgacactgagaagccaagaatgaggggtccaaagagagcttcgaaaatccggaagttgttcaacctctctaaggaagatgatgttcggaaatatgttaatacatatcgccgaacctttacaaccaaatctggtaaaaaagtaagcaaggctcccaaaattcagaggttggtgactccgttgaccttgcagaggaagcgtggcagaattgcagagaagaagaagagagttgcaaaggccaaggctgatgctgctgaataccagaagctccttgcccagaggttgaaggaacagcgtgagcgcaagagtgagagcttggcccagaagagatctaggctctc

SEQ ID NO: 4212 - DNA, 471 bp, Gossypium hirsutum
  Clone ID: uC-gsronu33B146f07b1
tttgtatcttcgttttcgctggatcgggctcaggaatggcttttaacaagttgaccgacaacggagcaacaaccccggccggtctcgtagccgccgctctagctcatggcttcggtcttttcgtcgctgtctccgatggcgccaacatctcaggtggccacgtcaaccccgccgtcaccttcggtgctttcgttggcgggaacatcactctcttgcgcggcattctttactggatcgcccaactcctaggctcaaccgtcgcttgcctgttgcttaagttcgctaccggcgacctggctgtaccagcttttggattgtcatcaggtgtgggcgtgtctaacgcattggttttcgaaatcgtgatgaccttcggattggtgtacacagtgtacgccacagccgttgatcccaaaagggaagcttgggaacaatcgcaccattggcaattgttttcatcgtgggggccaacat

SEQ ID NO: 4213 - DNA, 462 bp, Gossypium hirsutum
  Clone ID: uC-gsronu33B146f08b1
ttctttagtattatcggtgtatgttcgcctttgttgacactttcggtcccagctgtgtagtcccgaaagaagtttatttgtgatcgtcaagtgcttcgcatcagggattattctggctactggtttcatgcacgttttaccggactcttttgacatgttaacatctaagtgcttgaaagagaatccatggcacaagtttcccttcacagggttcgtcgccatgttatccgcaatcgtgactttatatagtggattccgtggctacatcgatatacagcaagaaaagcaacaatgaggttatcccagaagttgcatcacctgctgggggtacacaacaggacatggctgtggtgaatgttggacactctcatggtcatcatcatggtttaaagcccgcacaaggagctgtagatcaacacttgttgcggtatcgcgtgatcgccatggtgttagcattgggga

SEQ ID NO: 4214 - DNA, 478 bp, Gossypium hirsutum
  Clone ID: uC-gsronu33B146f11b1
ttttctcgtacgcccacgcgtccgcccacgcgtgcggccacgcttacgcccacgcgtgcggatgaatccactggcaccatcggcaagcgtctttcaagtattaatgtagagaatgttgaagacaacaggcgtgctctccgtgagctcctattcacaactcctggagctcttcagcacctcagtggtgttattctctttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgt

SEQ ID NO: 4215 - DNA, 499 bp, Gossypium hirsutum
  Clone ID: uC-gsronu33B146f12b1
tttgttacacgcccgcatttattttattttgagacgaatttttccttcaattgtggggtaattccctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttgttgatctggagcctactgttatcgatgaagtgaggactggtacgtaccgccagttattccaccctgagcaactcatcagtggcaaagaagatgctgccaacaatttcgctcgtggccattatacaatttgcaaagagattggtgatctctgcttggatcgtatccgatagcttgctgataactgtactgggctccaggcttctgggtttcaatgctgt

SEQ ID NO: 4216 - DNA, 327 bp, Gossypium hirsutum
  Clone ID: uC-gsronu33B146g02b1
ggctttttagaaaacacgccactatcttcccaatgggcttaagaaattcgtggtgcacaatgtccaagagctagagcttctcatgatgcacaacaggacatactgtgctgagatagcacatgatgtttcaacgaagaagaggaaggatatcgttgtgcgagcagcacacttggatgttgccgttaccaacaaattggcttggttgcgcagccaggaggactagtgaaggccggctcttgaatgatgatcttgctgtggataatatgaagttatcctgattaggaagtaagaacttttggtcccatgataaaatgattatatttgtat

SEQ ID NO: 4217 - DNA, 505 bp, Gossypium hirsutum
  Clone ID: uC-gsronu33B146g04b1
tccttaattctcttactgagcatcgcaatcctgacaggtggaataaactaaatgatggggaaaaagccaagaaagaactagagcagcaagaatattttgatccaaagatagctgatgaggaccgtgagaaagggaatgaaagtttcaaacagcagaagtatccagaggctgtgaagcattataccgagtcattgagacgaaaccccaaagatccaaaggcatacagcaatagagcagcatgctacacgaaattgggcgctttgcctgagggattgaaagatgctgagaagtgcattgagctagatccaacattttcaaagggttacacaagaaagggagctgttcagttcttcataaggagtatgacaaagctttagaaacataccaagaatggttgaagcatgatccgaataaccaggaattgcttgatggtgttagaaggtgtgtaaaacagattaacagagctagtcgaggtgatttcagccctgaagaacttgaggaaaga

SEQ ID NO: 4218 - DNA, 529 bp, Gossypium hirsutum
  unsure (1)..(529): unsure at all n locations
  Clone ID: uC-gsronu33B146g05b1
gccttattaaagaaacctatgaaccctatgtcacggctgttaaataccaccctgatgaaccctacaatagcatcccagcgtccaaaaccaacaacaaagactcttacttttatagcaagacaaatgcgtacgggaacactgagcagcaaagtgaagccaggttcaatgagaaaggatggaccaccaaggaaaccaacaactacaatggcaactattacaatggtaacaatgaggccttgttcactgagaaagggtggagtactaaggaaaaccagaatagcaacaactattacaatggtaacaatgaggccatgttcactgagaaaggatggagtactaaggaaaaccagaacaacaacaactattacaatggtaacaatgagtacaacaatgttgagaagcaaggtatgagtgatactaggtacttggagaatgggaagtactactatcgtgtgggttctgagaacaactactacccgaaccgttcgagaactcgagggagtcggntcgaggacgaagtcacgagaac

SEQ ID NO: 4219 - DNA, 520 bp, Gossypium hirsutum
  Clone ID: uC-gsronu33B146g06b1
gatgtttttaagcatgttgaagttctgattcccagggcagaaaaggatgaagttctgggagattagaggcagctagtattaacccaatcgactggaaaatacaggaaggggtagcccgcccatttttacctcgcaaattcccccacattcctggcaccgatgtagctggagaaatcgtacaagttggatcaggagtccaaagtttcaaagttggggataaagttgttgccgtacttggtaatggaggtgcactagctgaatatgctgtggctaaggaaggttccacagttccaaggcctcctgaagtatcagcccctgaagctgcagctttgccaattgctggcctcgcagctcaccagtcactcacccagcttgctgggctcaaactcgatggaaccggtccgcaagtaaatgtccttgttaccgctgcttaggtggtgtaggtcaatatgcggttcaactcgcaaagcttgcaaatgcacatgtgacagccacttgtggggctcgtaatatggattta

SEQ ID NO: 4220 - DNA, 420 bp, Gossypium hirsutum
  Clone ID: uC-gsronu33B146g08b1
ttcttgtatcttttcacaaatatcaccaaatatgccttcaaagtgcgaaatttgctgtgagctcctcatcgccattttgcttgctcctttgggtgtttgcttaaggcacggttgttgcagcgttgagttctgcatctgtctgctgttaacgattctgggttacatccctgggataatctatgccctttacgccattgtttttgtggatcgagacgagtactttgacgagtacaggcgaccactttattattcaagtgcctagtctagtcaagtcttccttaattatgtgatatgaatacgatgatgatgcagcaactccttctgggttttaattttaatctgatgttgaggtgttgctactctcgaactgatctcgatgtactttgtgatattataaattggaatggatccttggtcttt

SEQ ID NO: 4221 - DNA, 414 bp, Gossypium hirsutum
  Clone ID: uC-gsronu33B146g09b1
ttctttcgtccgtgagcccttgtctgtctttggagacagctattgaactggaaagattgctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgggaaggtgtgaagcccctcaagtgggaaaagcctcagtcttaaaatccagctttggctgtcctcgaatgtctctaatctcatacatatgatgccccccattcattttcattttcattttcttatttgttctctttcacctttaattgtgtcctgtcaatgtcgtgttgcaaaaatgtatgagaattttgcttatattgatg

SEQ ID NO: 4222 - DNA, 484 bp, Gossypium hirsutum
  Clone ID: uC-gsronu33B146g10b1
ttcttacccaatctaaagtatgtttccatcaaggatggcccccttgttggagatgagggagtcgcgagcctgttgtcttcagcctcatattccctcacaaaagtcaagctccaggccttgagcatcactgatgtctctcttgctattattggacactatggcaaggcagtgaccgacctttctctcactagccttccaaatgtgagtgaaaagggcttctgggtaatgggtaacggtcatggactacagaaattgaaatctttcacagatacatcctgccgtggagcaacagatttgggacttgaagctgttggaaaaagttgcccgaatttgaagcagttatgcctcagtaaatgccctttcttatctgataaggggttgtcgtctttagccaaagcagccagttcactagagtgcttgcaactggaggagtgccacagaatcactcagtttgtgtttttttgctcccttattaactgtggtg

SEQ ID NO: 4223 - DNA, 494 bp, Gossypium hirsutum
  unsure (1)..(494): unsure at all n locations
  Clone ID: uC-gsronu33B146g12b1
tgttgttagggtgtgcaggattaaagggtcaccattggttccatcatgatgcttaatggcaagtttttgttcttatcagctttgttttgcattgctgtagctggcgctttaggccaagctcctcctactcctagtaatcctccgacatccacgccggtgccgtcgaccccacccgcttccacacctccgtctactacccaaccacctccaacacccacaactacttctccgccaccagcttccactcctcctcctacatcatcaccacctccagtgacagcttctccaccaccagtttccactcctcctccagcgactcccccgcccgttagctccccaccaccagcttctcctccaccggctactcctcccccagctaccccaccttccgcaactcccccaccggcttctccaccgcaggctaccccaccacctgcttctcccccttctgctactcctnctncagctaccccaccaccagctcctttggcttc

SEQ ID NO: 4224 - DNA, 358 bp, Gossypium hirsutum
  Clone ID: uC-gsronu33B146h01b1
cttgtttattgttatatcttgtttaatagtgaaatgagatgaattcatcatggagatacgtgtgattatttatctggtaactataatctgtagaaaatcgaagtaacatatagaattagcgcacaaattctatgttgctgacttgttttcatccataatattgattattacaggcaggcttcgacggcaaaaattgcattgcagatgagcattacctgccaacctttttcaatatgattgatcctgggggtattgccaactggtcggtaacacatgttgactggtctgagagaaagtggcaccctaaatcatataaggctcaagatgctactgaggatcttctgaacaacattacgtc

SEQ ID NO: 4225 - DNA, 437 bp, Gossypium hirsutum
  Clone ID: uC-gsronu33B146h03b1
cggtctcgttggctctttacaaaatatctgctcctgttaggttccctttttgtcccttgttgatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacataactgtcaacgaagcccaatctcgcaaaagtggaggcggtggcggaagatttggaggaggaaacggtggttacagccgcggtggaggcggcggcggatattgtggtcgccaaggaggatat

SEQ ID NO: 4226 - DNA, 421 bp, Gossypium hirsutum
  Clone ID: uC-gsronu33B146h04b1
ttcgtccggctcttttatgtctaccacacacttgctaatctgtggacggggagtgtacgatctagccaggccctctaccggtacctatgagtctcccaactatgggaagccccctactcctgtatataagcctgctaaggtgaaacccccaccttatgaacataagccacctgtctatgaacctccaaagaaggaaaaacctgaacctaaaccaccagtttatacaccaccaaagaaagagaagccagaacccaagccaccagtatatgaatcaccaaaaaaggaaaagcccgaaccaaagccaccagtttatacacctccaaagaaagagaagcttgaacacaaaccaccagtatatgaaccaccaaagaaggaaaagcctgagcctaagccaccagtttataccccaccaaagaaagag

SEQ ID NO: 4227 - DNA, 161 bp, Gossypium hirsutum
  Clone ID: uC-gsronu33B146h05b1
aagtcactcaagcagttcctaaaagcgtggactgaagtatgttcgtccattataattggggggcccccaccccccaaccaataacttggatattagatagtttatttttatcttttatgttttgaggtatctatttcataataattgattagttttttgcc

SEQ ID NO: 4228 - DNA, 374 bp, Gossypium hirsutum
  unsure (1)..(374): unsure at all n locations
  Clone ID: uC-gsronu33B146h08b1
ctcgcccgccggcgcgtacccggacttaattgctggacctacccacgcgtccgttctttcgttcgcccacgcgtacggctaaatacaaggttggagctcctgctcgtgttggtctggttgcgcctattgatgtggtcgttccacctggaaacactggtcttgacccatcacagacctctttcttacaggtgctcaatatttccaccaagattaacaaaggtactgttgaaattatcactcccgttgagcttatcaagaagggtgagaaggttggttcttccgaggctgcacttcttgccaagctcggaattagaccattctcatacggncttgttgtcttgtctgtttatgacaatgggtcaatctttagccct

SEQ ID NO: 4229 - DNA, 305 bp, Gossypium hirsutum
  Clone ID: uC-gsronu33B146h09b1
ttctttcgtccggtcgtgtaactggaacagagtaaagactaaaagtccaattgtgctgggtcttactaagccttgacttcttcggtgcttttcttctttaaatagtctcattccttcctattgcatcttcagaggtataggaactggtgcttctatgtactctactgcaatgtcggggtgataggatttctacgttgtagctcctcaaaaaaaaataaaatttgctatctttaatttgctccaaaacaaacaagaaagatataaaggacacgatcaaatgaatgaacagacaaaattttgacggg

SEQ ID NO: 4230 - DNA, 181 bp, Gossypium hirsutum
  Clone ID: uC-gsronu33B146h11b1
ttctttcgtccgcttacatacaaatgaagtatttctagcatccgtttcttgtcaaatagtaatgttaagcattttatttctgtagtaacagttccttaagagaatcgttttccttttgttgtattttatttcctgccttttaagcttcagattctgacatgttagtatctgcagttttttg

SEQ ID NO: 4231 - DNA, 499 bp, Gossypium hirsutum
  Clone ID: uC-gsronu33B146h12b1
ttattcgtccgattggaggacatgacgacaagaattggtcatacagttatagttggatcgaaggtggacctttgggggacaagcttgagaaaatcagctatgacaacaagtttgaggcagctgcaggtggaggaagcctttgcaagagctcgatgaaattttacactgttggcgactatgtgatcactgaagatgaaatcaaggctcaaatcaaagggagtgaaggagtttacaaggctgttgaagcttacctcttggctaaccccgatgcctgcaactaagatatatgttggttgctttgaattctcttgcttgattttaaagaatggtgtgcttttggtattttcctttttactcttaaaacttaaaccgtcttccggttgtcttaataaaaatggcggtggtaattgatctttgatcatctttgatatatgatgaaataaaataaatatataaactaggaaaaaatttacctagtatatattttatagtttacatg

SEQ ID NO: 4232 - DNA, 80 bp, Gossypium hirsutum
  Clone ID: uC-gsronu33B147a05b1
aagaacttcgattcatctgcttcatttgtttcgaaatgggggatctataaaaagacctttttttattgcacccccccagc

SEQ ID NO: 4233 - DNA, 275 bp, Gossypium hirsutum
  Clone ID: uC-gsronu33B147a08b1
tttatccctgtttttagctcctctgttttctctgttcatttcgcagcaatctttcttcggaatttaaggatatccattactttatttagttcttctccttgacaagccccaaaaaagaaaaaaaggtgttcttgttttttttttttgaaagaaaaatgtgtgggattttagctgttttgggttgttctgatgattctcaggccaaacgggtccgcgtgctgaaccttttcccaagcctgaaacaccatggtacacactgtagtgcgcctcattaa

SEQ ID NO: 4234 - DNA, 249 bp, Gossypium hirsutum
  Clone ID: uC-gsronu33B147a09b1
ttgactcgtggggtaaagtcaagtgtttcaaatcttgagcttgcccttggggttgaaaggagcctttcagctcacagaaatatgcccccatctttggatcaaatatgggaatcatatgagtaatctttttcatgtgtttcagttatgacatatgtttgaagtttatttttgtagtaagttggtacttgatgatggtattaatcaattatggattgtctttgtagtggataaagtttatttttttatgct

SEQ ID NO: 4235 - DNA, 589 bp, Gossypium hirsutum
  unsure (1)..(589): unsure at all n locations
  Clone ID: uC-gsronu33B147b02b1
atgattagttaagtcaatactttgccttcttatactggaggagatcagggttttctgaattcttactactctgatttctcaaatgcacatgtttttgaccctaatatacccgaggaggtgctgaaatcccgtcctgctcctgagatggaacgactttctactctatacaatgcagatgttggtctttacatgcttgccaacaagtggatggtagatgagagtgaacttcgtgtaattcactatacacttggcccccttaaaccttgggattggtggacatcttggctcttgaaaccagtcgatgtctggcagaatgttagggaacagcttaaagagtcccttcctggaactgggggaggcaaaaatccaaatgatgagcttctaatcaaattccttttcctcttacctttctgtgctttacttttttggttctatcgntctttcgttcagacagggggttcagtttgcagaacttcattatgcaatcaggtcagacacttctaccacataattaggtcgagtgggacagttgcttacactagtgtttcttcatcttctaccattaacgcanacagtcagttttctaaca

SEQ ID NO: 4236 - DNA, 535 bp, Gossypium hirsutum
  unsure (1)..(535): unsure at all n locations
  Clone ID: uC-gsronu33B147b03b1
cccattcgttcgtttgtttttcctttatcaaaatgggggcctttttagagatcatattagcactcccaagaagaaaaagctggtatggcgatgatacttttttgtatcaaggcttttggtgtgacacattttttattgaaggattaatgagagctcaacaaaattttcgatctcaaccttctgatatcgtcatatgcagtgctatgaaaaccggaacaacatggttaaagtccctcacttttgccattgtaacaagatccaccttcgatgattccactaaccctctattcaacaatctatcacatgattgtgtaccccttttagaggttgatttagcccaatcttccaccaatcgagaccctaaaaatcctttgttagccacacatgccccttactgttctttaccaagatcaataattgattctagttgtaaaattgtttacatttgtagggaccctaaggattcattagtttcgctttatcactttcttgctaggtacttggcatccaaagacatgaagcctnctgctttaga

SEQ ID NO: 4237 - DNA, 544 bp, Gossypium hirsutum
  Clone ID: uC-gsronu33B147b06b1
cccactcgttcgcccacgcgtccgcttatatttcctgctgatgccattgcaagagcaaaacattatctttcgttgacttctggtggtctaggtgcatatagtgattccagaggtattccaggcgttaggaaggaggttgctgaattcattgagaggcgtgatgggtatcctagtgacccagagctcatatttctcactgacggtgccagcaaaggtgtgatgcagatcttgaattgtattatccgtggtcaaggggatgggtttttggttcctgttccacagtatccactttactcagctacaatatctctctttggcggttcacttgttccttactacctagaagagactgcaaactgggggctggacgtaaacaatcttcgtgaatcagttgcacaggctcgctttaaaggaataactgtgagagcaatggtaattattaaccctgggaaccctactggtcagtgtctcagtgaagctaatttaagagaaatattgaatttttgttaccaagaaaacttggtattacttgaagatgaggtta

SEQ ID NO: 4238 - DNA, 187 bp, Gossypium hirsutum
  Clone ID: uC-gsronu33B147b11b1
tccactcgtccgaccagattttccatcaacggcaggcctatctaccactttgttggaacctcgacttttagccaatatactgtcgtccatgttggccaggttgccaagatcagtccaaccgccccgcttgataaagtctgtcccattagctgtgggatatgtacaggttttggcgccaccgtaaatg

SEQ ID NO: 4239 - DNA, 421 bp, Gossypium hirsutum
  Clone ID: uC-gsronu33B147b12b1
ttacttcatggtgatgcagcgcttgggagccatatgaggggctggtgtagttaaagggttcatggggaagacaaggtatggtgctttgggtggtggagctaactctgcgaatcatggctacaccaaggcagaagtgcttgatgctgaaatcgatggcaccttagtgcttgagtacacgtgtgttctgagccactgatgccaagcgcagtgccagagactctcacgtccctattctggcaccatggccaattgggttcgcagagttcttggtgcacttagccaccataccaatcacaggaaccggtattaacccagctcgtagtcttggtgcagccatcattatcaacatggacaagggctgggatgaccattggattttctaggtgggttcattcataggaccagcactagcaagactcta

SEQ ID NO: 4240 - DNA, 554 bp, Gossypium hirsutum
  Clone ID: uC-gsronu33B147c02b1
gggttctgtttatttaaaagctgaggacaatgttaaagccaccttcgaacagtctgtggaaaatctggagatgactttggataagtcccagaatagcagtgacattagcgatacgagggatgaagattcaaattcttttgctagggaagctaaccataacaaagaagtaacggtttcaccattgccaaatgtattgaaaccctttgagactaaccaggttgctttgagttcctacaggaatggaactgtggaggtaaatgggttccatgaaaatggtctaactgaagttaaaaagttgagtaaccggagaaagcataggttaggttgcttcggcttcaattccgggtaatgtatggtctgatgcctcaaccgagatggctaggactagataacttcatcagcaagcaccactttttgaaccgcagagaaaagggaagacttgagagtggattttctaacatcgtatattgaatcatccccatgaataatataatttaatataatgtataccataaagcttttattttcttctcttatctataatggaatataat

SEQ ID NO: 4241 - DNA, 579 bp, Gossypium hirsutum
  unsure (1)..(579): unsure at all n locations
  Clone ID: uC-gsronu33B147c03b1
caaactccttactcttaagaaaaaaacagttatggcaagcaaagaacccgaacacgagcacagagaagatcaagaagctcctgccgccgaggatgaagacactggagctcaagtcgcccctattgtcaagttagaggaagtcgctgtcagtacaggcgaggaaaacgaagatccgatccttgatctgaagtcgaagctgtatcgatttgataaagaagggaatcaatggaaagagagaggtgctggtactgtgaagctgttgaagcacaaagagacaggaaaagttcgccttgttatgaggcaatctaagactctcaagatctgcgccaatcatctagtgttgccgacaatgacggtgcaagagcacgctgggaatgataaatcgtgcttatggcacgcctctgattatgcagatggtgaattgaaagatgaacttttctgcattcgttttgcatcagtggaaaattgcaaaacctttatgcaaatgttccagaagttgctgaatcacanaaaccaaaagaggaaaacagggatgcatctgatgctgctggacaacttgagaagtgagctttcaagaga

SEQ ID NO: 4242 - DNA, 433 bp, Gossypium hirsutum
  Clone ID: uC-gsronu33B147c05b1
agcactcataccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctggtgttggtaaaatcttataaaaatatatatcggttgctgctcttggtttgatc

SEQ ID NO: 4243 - DNA, 435 bp, Gossypium hirsutum
  Clone ID: uC-gsronu33B147c06b1
cccactcgttcgccgttttgagggctcagatgactgaactaagccaaaggctagactctctaaacgacatcctccattatctaaacagagagggtattgaatacactcctgactgtttcaccaaccctttcaatgtgccttatcttaaccaacaaccacccatcatggcctctgcacacatctttcaatactaattgatgaagaaagtattcatgtcatttgttggtgggttttgttttgttttgatttttcaatgtgggaatcaatgagtgggtaagtgaattggcaattctgccatggttgctttctagggttaacaagtatggttttggttttttctaggagggcctttgagaaataaaatatggtgtggaggactgtgaatgtatgtggcgtttcaagttttatctaatggcctaaatacttatttgtttt

SEQ ID NO: 4244 - DNA, 292 bp, Gossypium hirsutum
  Clone ID: uC-gsronu33B147c07b1
ttggatatacatgcagacgcaggcatattaacagtgcttctacagaaccatatgggcggcctccaagtccttcacgacagtcaatggttcgacgtccaccccactcgaggtggtttggtcataaacgtcggcgatcttcttcaagttagcttcaattcacataaactctatatgaaactgtcctaatagactagctactgactctttttatgttgtttatggtaggttttatcaaatgataagttcaagagtgtgaaacatattgcagtttccagtcatgtcggacctagaa

SEQ ID NO: 4245 - DNA, 468 bp, Gossypium hirsutum
  Clone ID: uC-gsronu33B147c10b1
attgtagtttcctttctcgattttctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactc

SEQ ID NO: 4246 - DNA, 463 bp, Gossypium hirsutum
  Clone ID: uC-gsronu33B147c11b1
ttagttgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgtcactggtggcttgacagttcctatccacggtcttggagctggagttggagctattcaaggagtggtgatggaagatcatcatcacatttgcattggtttacacagggtatgcaaccgcagctgacccaaagaagggatcactcgggaccattgcacccattgccatcggcttcattgttggtgcccacatcttggccgctggtccattctcatggatcccaaaatggtgccattgatgttgatgaatgtgccgatcttttatc

SEQ ID NO: 4247 - DNA, 529 bp, Gossypium hirsutum
  unsure (1)..(529): unsure at all n locations
  Clone ID: uC-gsronu33B147c12b1
gtcgttatgagggtgaaggagcaattggacaggtcaaggcaaaggctttaccatgagcgaacgcagataattgctgctcgactgggcttaccagcttcctcctctagagcaatgccgccaccaaatgctgcaaatagagttgcaacaaactttgcaaactcggttgcaaggcctccaatgagcatgaaagccccaagaccaccattgtcgagacccatgggttctatgacccctaccccttccaacccatatgtatccaatacagttgcagggagttcaattcgacctggtagccaagacaatctttcctccgttggaaccaagtagtctctattcatattacttgtgaatagaatttttcaatccattcttatacaagggtcatccatcttgagatgcatctggttagtaccccctttttttattggtggcagttctgttcttaacgctgccagtcatcttgggtgcatttaagaactngagaatatactcaagctgaactcatgggcatatcatatctgatggtttc

SEQ ID NO: 4248 - DNA, 534 bp, Gossypium hirsutum
  unsure (1)..(534): unsure at all n locations
  Clone ID: uC-gsronu33B147d01b1
gggtttacgtgtgattgataatgaagaagaagtgataaaggagctggcgcaaattagagggagaagacttaatatagattgttaagctgcatcactaggcccactgccataggctattgcatcaccaccctcggcgataccaaagaagtcggtttctctttctggtttggccatacagggcgagaggagtgagggttcacccgtgtcagtacccttggtaatgcccaagcacttcatttcgtcagtcataatggcaccaaatatcttaacagacggtttggcaataacatgaccatcaaccaaagtgtctgttgcaacatctggaagctccatgatggggatacctccctccagtttgattgctccatcatcaagcgcctgattaggtatccggtctgcctcgtttccggagttggttccatcgacttcatgatcattgaaagtgagaaaagaagaagaagaagaaggaagggtcctnctgtcttggttgctgcagcttctggcttctccacttcaaccctaaagtgggaacca

SEQ ID NO: 4249 - DNA, 558 bp, Gossypium hirsutum
  unsure (1)..(558): unsure at all n locations
  Clone ID: uC-gsronu33B147d03b1
cgtgtttgtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaatttttcttttgtccaaaggattttttgctgctcattcatggtgactnnggttatnggtttatctgttgttaaaatcttataaaaatatatatcga

SEQ ID NO: 4250 - DNA, 97 bp, Gossypium hirsutum
  unsure (1)..(97): unsure at all n locations
  Clone ID: uC-gsronu33B147d04b1
gctctggatagcaagtttggaccgacctgataagatggtgggcttaattatacaaatatttgtgggaagacaccgcntcatacattaagaaattagc

SEQ ID NO: 4251 - DNA, 584 bp, Gossypium hirsutum
  unsure (1)..(584): unsure at all n locations
  Clone ID: uC-gsronu33B147d07b1
cccacgcgtccgatatcgctagctgtctcacaccgtctcctacccttttcccttcctctctgctactcgatctccacactgcaacacaatttctctttcaaagagaagacaaagaaaggaagaaaagtatcagcccggattatggacggcggtgttccgtacaacccacgtacagtcgaagaaatctttcgagatttcaagggtcgtcgagctggaatgattaaagcccttactaccgatgtggaggagttttaccagcagtgtgatccagaaaaggagaatctttgcctttatggattccctagtgagcagtgggaggtgaatttacctgccgaagaggtacctccggagcttccagagcccgcattgggtattaactttgccagagatggaatgcaagaaaaggattggttgtctttggttgctgtacacagtgactcgtggttactctctgtggctntctattttggtgctaggtttggatttgataaagctgataggaaacggcttttcaatatgataaatgatcttccaacagtattcgaagtagtaacaggagcagctaagaaacagacaaaggagaa

SEQ ID NO: 4252 - DNA, 94 bp, Gossypium hirsutum
  Clone ID: uC-gsronu33B147d08b1
ttcatgcgtccgcccacgcgtccgatttcatagggagaggttaaatacttgttttggtgaaagaccaccaactgtgaaagcactcggcaaggat

SEQ ID NO: 4253 - DNA, 513 bp, Gossypium hirsutum
  Clone ID: uC-gsronu33B147d10b1
tccactcgtccggggaaggtttaaagaagttctcaaagtggccaacttttcctcaactctattgcaaaggtgaacttcttggtggatgtgatatagcaattgccatgcatgaaagtggtgaacttaaagaagttttcagagatcacggagttgatattattgggactgaacaaggaaccggtggcatcttggaaccgaccggattgactgcaaacctaaattctcggcttcaaagcttgattaattcaagcccggttatgctgtttatgaaggggaagcctggtgaacccaagtgtggttttagccacaaggtagttgaaatccttaaacaagagaaagttgattttgagagtttcgacattctctcagatgatgaagttcgtcaaggactgaaagtttattcaaattggtcaagttaccctcaattgtatattaaaggtgaacttaatcgtggatcagacatttgcgtagagatgcagaaaaagtgtgaactcataaagattttaaccgaga

SEQ ID NO: 4254 - DNA, 463 bp, Gossypium hirsutum
  Clone ID: uC-gsronu33B147d11b1
tggactcgtgggctccaggcaaattcttcgggtctcaatacaacacctctatggttccttcttttgggggaggtgtactatgtgccaaggcctcaatgctgcttcagagtgtccctcctgcattgcttgttcggtttttgagggagcatcggtccgagtgggctgattatggaatcgacacctactccgcatcttgtttgaaacctaatccttacactgtcccgtgtgctcggcctagtggtttccctagtagtcaggtcattctacctcttgcgcatacagtagaacatgaagagttccttgaagttgttcgtctagaaggccaggcattcacgcccgaagatgtagctttggcacgggatatgtacttattgcagctttgcagcggaattgatgaaaatgaagttggtgcctgtgcacagcttgtttttgcacctatcgatgaatccgttgctgataatgc

SEQ ID NO: 4255 - DNA, 552 bp, Gossypium hirsutum
  unsure (1)..(552): unsure at all n locations
  Clone ID: uC-gsronu33B147d12b1
tcattttcaattcccaatggatctccactaatagatgggacaagacaaatgacaccttcccccctccctcataactcaggaaacgacgtcgcttttcttacaagacacaacatttaaccgtccgatcttcagtcctctcatttcaaatctacttcaactcattatttcctttcttcgagttttctctgtttgcttccgtcacaactccaaaaccgtacacaaaatgggcaaggatctaagcgacgagcaagtctcatcaatgaaggaggctttcactctcttcgacaccgacggtgacggcaagatcgctccatcggagctagggatcctaatgaggtctctcggcggtaaccccacccaagcccaactcaaagctattatcgctgaagagaagctcacggcgccctttgacttccctcgctttttagatctcatgtccaagcatatgaaacctgagcccttcgataggcagctacgcgatgctntcaaggttctggataaggacaatactggctttgctccgtgcagatctgagacatatactgctagcat

SEQ ID NO: 4256 - DNA, 547 bp, Gossypium hirsutum
  Clone ID: uC-gsronu33B147e01b1
cccattcgtccgaaaaagaacgcagtcttttgatctctgccccaaagcaaaaagttgtcatcttttacaatcacaactactggttatttattttcatggctcaaggagattctaacttccagcaagacatggctaaagaggaagaagaacagaggctgaaatacttggagttcgtgcaagtagccgccgttcacgccgctttgtgcttcaccaacctttacctttacgctaaggaaagatcggggccgttgaaacctagcgtcgagaccgttgagggaacggttaagagtgtggttggaccggtttatgataaataccatgatgtccctgttgaattccttaaattcgttgattccaaggtgggtgaatcagtgaccaagcttgatcgtcgagtccctccagtcatcaaacaggtctcaaccgaagccatcttggcagcccaaaaggcttccgagggtgctcgtggcgtggcttccgagtccaccgtgctggagggtgaacaccgcctcggattagcaaaatagtgtacaccagtatgacccacagc

SEQ ID NO: 4257 - DNA, 477 bp, Gossypium hirsutum
  Clone ID: uC-gsronu33B147e03b1
cggcttttggggttccctacggagctgtaacttatcttgcaaatttatatgcaagaaactcggagaacagatgtacggcttgtatcaatcgtggagttgctcctccgaaatcgtttctgaccctgtggaatatgtgaagaaaacagtgatcgaggaaatcgtttcgacttgaaatatgaacttagtccatcggaaatatcattatccgatacctcaactgaactttttttatgcctgatttgtggatgttattgctcttttgtgcttgtaaatattggaaacaccttcctgttgaacttgggaaaattagtatgctaattagtagaatagcttactctttcgtataaaccaagaaccggcactggcatgctttgatttgtgtaactagaccttttgagctatgttatttagactcttcattttcttcgacattcatgttggaaaatataatataatcctttgaagactttacaagag

SEQ ID NO: 4258 - DNA, 392 bp, Gossypium hirsutum
  Clone ID: uC-gsronu33B147e06b1
gtcctgcattgctgttagagagaggataattcgagccttcttggtggaagagcagaaaattgtgaagaaggttctgaagatccagaagtccaaggaaaagcaagcttcaaagagctaagaaattagatgtcgaatcatcatttcaattctgatatgtgatcagcaaggctttggaaagtgccaccaatgacttcagaagattagaggttctctttttctattggcaaatggacttcaatgtttacaatgttttgataattttggattacgttttgatcatcgaatttaaaaaaaaattatggtatgatcgctaatgttattacttttttgtattttgatcattgagtcattaattgtcatttacacagacatgttatatcatcattttagac

SEQ ID NO: 4259 - DNA, 266 bp, Gossypium hirsutum
  Clone ID: uC-gsronu33B147e07b1
tccctcgtccggacccctggctgtttctataacccccatgcttatctggagatcattgtcttcacagggtggaagggtccgcattgtggtgttggagacaagagacagcagattgggacattcatgtcggaagtggaatctgaacggcggctaggaaagtcggagatcctgcaaaatgcctgcgttgacgtccgttaagtgcttagcagcagataccttttcgcctaaggaaagataattagcggagggaacctaaccgttgagac

SEQ ID NO: 4260 - DNA, 399 bp, Gossypium hirsutum
  Clone ID: uC-gsronu33B147e09b1
tttatataaacaggaaaaatggacgcaattgactcagtttttgatccgctaagggagttcgctaaggacagtgttcgtctcgtcaagagatgccacaagcccgatcgcaaagaatttacgaaggtggcgctccgtacagcgatcggattcgtggttatgggatttgtaggatttttcgtcaagctcatctttatccccattaacaacattattgttggatccggttaggtttgctttcatgttactgactcaacagcacagatcgagagataaattgtctgagatctcgaactaatttcagtatagactttggttttcctctatattcatatttgttggattttggttcagtttttagcgttgaaatggaaactacttgtagcaaatacaatccttgag

SEQ ID NO: 4261 - DNA, 544 bp, Gossypium hirsutum
  unsure (1)..(544): unsure at all n locations
  Clone ID: uC-gsronu33B147e10b1
ttcatgcgatacaaacgctttcaacactgcaggcaagcttagaatgcaagttaaaattgctcaaggagattgctactgaaaagggtatcaccttgcatttggaggaaatggctgctgaggtgaggaacttaactgagtcagccaacgatttgcctgtcggaaaagacatggatgatagcttaagtgagtcaatgaaagcacggaaaacgtacaaagatgtggcagatgctgctcaagaggctatcgtatcagcagcttatgcagcagcagcagcacgagcagctgtggagctctcaagaattgaaccccaagactttgattctccaaataatgccatggcccgaagcgaaaaccttgagctgaatgaaacggaagagactagacaaagtttatccagagaaaggacagtttctagttcaagttcagattcggatgcaaacctttcaggtgaggaaagtgatggngagaaggcaaaagaagagccacacacacagcctcatgagttgagctatgagattacccaagtgatgaaaataagtgatga

SEQ ID NO: 4262 - DNA, 274 bp, Gossypium hirsutum
  Clone ID: uC-gsronu33B147e11b1
tttttttcggtggctgtaagctatgaaactggtaatatctcagcagattaacctaccttctggtatgataaactaaaatggtgttctataaaactttgcagaagataataatggtaaatgtctgattacaattctgtatttcttaaagattagtaatttataagtaatgaacctcaagctctgcagaaattggttgatctacaccgcattgagaaagggtctgtaaatttttacaagacttcaatatcaattgtttatgctcaagctaagtttg

SEQ ID NO: 4263 - DNA, 484 bp, Gossypium hirsutum
  Clone ID: uC-gsronu33B147e12b1
ttaagttttaaagagtggaatggttacaagtgattcaggacatcaatacaaacttcaaagtgatgcaaaatgtgatacaatgggaaccttgtggcgcattctaggagtaaataatggtgctcagagagtctttggtgaagccactggattttctcttctgctaaccaccctccatagttttcagggtgatggtcactcagaagaaccttatttattagtttacatcaaagtcttcacatatttattacgccttatgacagcaggggtgtgtggtaatactattaataggacaaaactgcatgctatcatatcatcacacacattttatgatcttctatccgagtctggcttgctgtgtgtggattatgagaagcaagtgatacgtctattgttggaacctgctcaaaagtttttctctaaggcttattgctttgagttcattacaagatttccttgattaagtaaatgtatgatatcttttatt

SEQ ID NO: 4264 - DNA, 564 bp, Gossypium hirsutum
  Clone ID: uC-gsronu33B147f01b1
cccatatctattttcggcggcaacatcggagaggcaccactaccagcgccaattcccagaccttcttcttcagttatacattctcaaatcaaatcaaatcaaatcgtacactgaaaaaagcttaacgaaaatggtgcgtatagaagaaaagcaaggcacgatagtgcctagttcgatgccccagcaacaaaaccctctgcagcaattgcaagctaagttcaaggaagtggagaacggtttcagggcttggttatccaagcaacccttgccagtcgaggcgactgttgtaaccaccaccggcgcagctcagggcgctgctatcggtgctttaatgggtaccctcaccaatgatatttcgtcctctcttcaaactcctcctcaagcttccctaaatcctcaagctatggcttctttcaaacaagcccaggctctatcagggggtcctttggtacaagctcgcaactttgcggtgatgaccggtgttaatgccggcatatcttgtggtatgaaaagattgagaggggaagaggatgtgcaatctagcatggcggcagcttttggttc

SEQ ID NO: 4265 - DNA, 550 bp, Gossypium hirsutum
  Clone ID: uC-gsronu33B147f02b1
agatgatgttagttcgggacaagatagaacaaccagtacaagaagaacatggagcacaccaaattttggttcattgaaaattgtaattgctgatgagtacgcagatagaaaccaaatgaggtctggcatggaggctacacctaaggaaaaaggatccaagcctttcttcagtaagcaaaggtgtggagaactaacacaggcaaagtgtgtgtttaatttattcaatcggtgttttggctgggttggtgggttacagagacaattacgaagtccagtgcacttgcagtttagttattcattgcaactcaaactcgttttaacggtagccatctttctaatcgtaccctttgtactgtattcaagttgagagcaattggctgctatgccctgtagatcatacaacaggtgttggatgatctatgtcctcagggctcgggaatccattgttgacaacagttgtgatggtggcttcctttcccgttgtttcgagatgatgtggagcttgcttatacaaggagtggatgtcattctatatttgcttgctatatac

SEQ ID NO: 4266 - DNA, 312 bp, Gossypium hirsutum
  Clone ID: uC-gsronu33B147f06b1
ggtatttttagcgtcgcagtaatgaaagaaaaaaaggaagggaaaaccctacgagttcgcccccttgctatccggccaccgtcattccaccattgaaatcggtatatgatggcccgtagaggaaccgtcctacatccgggatttaaaccccatatcgaaagccagactttagcctcgagggtccgatctcaaccttcggtttcgacgaagaagaaaccgtctccgatggctcgtttgaaggtacggggcgtgtgctggcactaggcgtgagggggggcgtacggggctgtcgacgtggtggcacgagtggtg

SEQ ID NO: 4267 - DNA, 505 bp, Gossypium hirsutum
  unsure (1)..(505): unsure at all n locations
  Clone ID: uC-gsronu33B147f08b1
tccactcgtccgcccacgcgtccgcccagaaacccgtccctctccttctacgcagaggaatcaaaatcatgttgttcttttcgtatttcaaagacttgatgggaagagaagtgacggtggagctgaagaacgatttggctattagaggaacccttcactccgttgatcaatacctcaatatcaagctcgagaatactagggttgtcgatcaagacaagtatcctcacatgctttcggtaaggaactgtttcatcagaggctctgttgtgagatatgttcaactacctccagacggagtcgacattgaattgcttcatgatgccactagaagagaagctcgtggaggctgaaaaagcagcttttgttgacaaatttagtgtgcttttaatgatttagatattttgcttcaaagattgtgacaagttatccaggatttattcctttttgcattaatgtagacanaactggcttttgatttttgtgtatcggcaaattttattggatg

SEQ ID NO: 4268 - DNA, 509 bp, Gossypium hirsutum
  unsure (1)..(509): unsure at all n locations
  Clone ID: uC-gsronu33B147f10b1
ttcattcgtccgcccacgcgtccgcgagcagcatgcatcggataatgttaacaagatattggtagggaacaaggcagacatggatgaaagcaaaagggctgtgcctacctcaaagggacaagcactcgctgatgagtacggaatcaaattttttgaaaccagtgcaaagacaaatctaaatgtggaggaagttttcttttcgatagcgaaggacataaagcaaagactcgctgatagtgacactaaggctgagccttcgacgatcaagatcaatcaacctgacgctgcaggcggagctggtcaagctgcacaaaaattgggatgttgcggttaaacctaagatgaccaaattcggttaaaaaaggggtaaatatttgatcttagacttccattaaaacanaaaggaaaaaaaggggagggaggtgaagaaactaatcttattgactgcatgatgggtgcttgtgttttacttcatgtttagtgcgtgaatatagtattttcctatattt

SEQ ID NO: 4269 - DNA, 240 bp, Gossypium hirsutum
  Clone ID: uC-gsronu33B147f12b1
ttggttttaagatgtccgaaatgaagtacaaggattagatctaaataaccatacgatctaattgatgttattatcagcatctgccactttttgggttgcccccatttgatgtcttatgagtgaaaggaaaaagaaagggaaaagagaaggatgcaaatgccttccacgtacggttttaagtgtcttcatttactggtcaatttgatatgatatttttcaagtttttgctgttctgtcttt

SEQ ID NO: 4270 - DNA, 455 bp, Gossypium hirsutum
  Clone ID: uC-gsronu33B147g01b1
cccattcgttcggtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatt

SEQ ID NO: 4271 - DNA, 289 bp, Gossypium hirsutum
  Clone ID: uC-gsronu33B147g07b1
ccctcgcgtccgagatcgagagcacacaacctgggggtggtttttataaaataaagtctccgggacagcaccgcggaagcaactggagctgtgatgccaactgctcatgcaccaagaacccttaacctttgtgacgtcgaagaaaccaccaacactcagacgatcatctccggagtctgcgccagtgaagatgacctttgaggaaccagagatgagcactactgaatcacgacacggatgcaaagcgtggatcaaaccgctattgcgatccatgcaactgttgaaaagc

SEQ ID NO: 4272 - DNA, 389 bp, Gossypium hirsutum
  Clone ID: uC-gsronu33B147g09b1
ttcactcgtccggtggtacctctaatgaaatacaactagcattgtctctccaaagaccaaaaaatataagaatacaaaactaaaacaaataaaaaaaaaatcgtacactgaaaaaagcttaacgaaaatggtgcggatagaagaaaagcaaggcacgaaagtgcctagttcgatgccccagcaacaaaaccctctgcagcaattgcaagctaagttcaaggaagcggagaacggcttcagggcttgggtatccaagcaacccttgccagtcgaggcgactgttgtaaccaccaacggcggaagtcaaggggctggtattggtgctttaatgggtaccctcaccaatgatattttggcctctcttcaaactcctccttaagcttccctaa

SEQ ID NO: 4273 - DNA, 144 bp, Gossypium hirsutum
  Clone ID: uC-gsronu33B147g10b1
gggtgaaagacattcatatttggattactttgctgtaaatttaaactatctgtcgccaaagtatattatctgatctttctcctccttatctttctcagagtttttcttgatttttgcctttaccacatacttaaaagctttggc

SEQ ID NO: 4274 - DNA, 121 bp, Gossypium hirsutum
  Clone ID: uC-gsronu33B147h01b1
ctttttcatttcatggtctcccgacacgtcaaggatcaggagcatgatgatttacgccagctccaaagacagatccaagcgagaactggacggaattcaggtggaattgcaagcaacagat

SEQ ID NO: 4275 - DNA, 324 bp, Gossypium hirsutum
  unsure (1)..(324): unsure at all n locations
  Clone ID: uC-gsronu33B147h02b1
cccacttcgttcggaaacttgcacccaccatcggtatctcagttgatcaccgtcgtaagaaccgatctcttgaaggtcttcaagccaatgttcagaggcttaagacttacaaggccaaacttgttgtctttcctagacgtgctcgtaggtctaaggccggtgattctactgctgaggagcttgcaactgcaacccaaatgcatggaccatacatgcctatgntgcgtgagaagccatttgcttgagctgggaaggtcaccatagtgataaagtcattcaaggactacaacaggcttcgcgtctaacgtacgaatgcactacata

SEQ ID NO: 4276 - DNA, 577 bp, Gossypium hirsutum
  Clone ID: uC-gsronu33B147h04b1
gtccattgtaatgggttcaatgtatgctgctgttcttttccttggtatccaaaacgcttcttctgtgcaacctgttgtggcggtcgaaaggacagtcttttatagagaaagagctgctggaatgtactctgcaatgccatatgccattgcacaggtgttaatagagataccttatatttttgttcaagcttctgtgtatggccttatagtctatgctatgatcggattcgaatggacggttgctaagttcttctggtatctcttcttcatgttcttcaccttactttacttcaccttctacggcatgatggctgttgctgtcacaccaaaccattacattgcagccatagtttccgcggcattctacggagtatggaatctcttttcaggattcatcatcccacgacctagtatgccaatatggtggaggtggtactactggatttgtcctgtttcttggaccttgtatggaatgtgtgttcacagtttggagatataacacacatgcttgaagacgggaacattgagacaagtgggcagtacttgagaaattttatgattcaggcatgattatctg

SEQ ID NO: 4277 - DNA, 546 bp, Gossypium hirsutum
  unsure (1)..(546): unsure at all n locations
  Clone ID: uC-gsronu33B147h06b1
cccattcgttcggctgtttcgttaggatcgatgcataaggaaaggaggctgcatcaaatgatgtatgccgatcgtgactatgatatgagtgatgctaacagtggatcaacaagtgataggagtaaaccgctagtaaccgtggaaaattgtgaacataagggttacaccgttgtaaacttgaggtgccccgatcggcctaagctactatttgatacagtttgcacattgacagatatgcagtatgttgtataccatgcgaccgtcatagcagaaggacctgaagcttatcaggaatactatatccggcacatggatggttgccctattagctccaaagccgagcaacaaagggtaatccattgtttagaggcagctatcaaaagacgagcttccgagggcataagattagaactttgcagtgacgaccgagtcggccttctatcggatgtgactcgcatattcagagaaaatggtctttctgtcactcgagcggaggttaaaacaaggngttcccaagccgtaaacatattttacgtgactgatgca

SEQ ID NO: 4278 - DNA, 525 bp, Gossypium hirsutum
  Clone ID: uC-gsronu33B148a01b1
gaagaaactcattttgagattacatgtcatgataatgtcagggggggtgtcagcatgtcccacatgaaatgtgttggaagcaagatgagtgttcaaaagtacctctcaacatgagggaattcagaggtaaaactcttggaccttggttaatcagccaaaaatcaagaggattcttggtgaagtgaagcaggcagtctctctaccacctgttccttcaaagaagcctgctgcccagccaaaagaaactaaaccaaaggctgaaccaaagaaagaagccaaaaaggaggttgagaaacaggcagcaaaggcagaggccgctgaggaggaggaggcaccaaagcccaaaccaaagaatcctcttgatttgctgcctccaagtaagatggtactggatgactggaaaaggctttactctaacacgaagaccaatttccgagaggttgcgattaaaggattctgggacatgtatgatcccgagggatactcactgtggtttttgtgactacaagtacaatgaggagaata

SEQ ID NO: 4279 - DNA, 462 bp, Gossypium hirsutum
  Clone ID: uC-gsronu33B148a02b1
ctttgggatactttcatgaaatctgaagtcagttactctggggagggtactgtggagacaccagtgacagcttagattccatgttatttattacttgttttaatatttatgaagatgaaaacccatcataagatggtccccattcctctccttgttgaggtgatccagatgtctggctctcatcttcattatattaaataatattaatgtataaaatgaaaagggttcctcctgttgcggatggcttaatcaaaaaaaaaaaaaaaaaaaaaaaaaaaaaccacaaaaaactaaacaaaaaaaaataaaaaaaaaaaaaaaaaaacaaacacacccaataaaaaccaaaggcccccctcttatagggatccaaggcttaatttcgcctgaattctagggggggggtccctttttggggccccctagtttcccccccttggccggggggtaaaaaattttttt

SEQ ID NO: 4280 - DNA, 415 bp, Gossypium hirsutum
  Clone ID: uC-gsronu33B148a03b1
tgggtttgtatcattggagtccaacaccaaaatgtcagctctggttttgttttgcatgcttttgatgttcttcagtgacaccaattcttgggtgtggttcatgtgggaaagcacacaagcatcgaaagcctaagggaaagtcccctaaaggacccatcactatgccttcccttgtgaaacctccaatcaagttgccaccggttgttcctccaatagttaagccacccattgacctccctccggttacggtccctgcaattaaccttgccccagggacggttcctccagtaactaagccaccaagtgggaaaccctgcccaacaccaccaaccaaggacacttgccccattgacacactgaaattgggtgcttgtgtggatctgctgggagggttggtgcacattggactaggtga

SEQ ID NO: 4281 - DNA, 147 bp, Gossypium hirsutum
  Clone ID: uC-gsronu33B148a05b1
gcgcccacgcgttctttgtgattgctcaccaataatcatatatgtacggatgggttccaccatgcactacgcggcttcaattaactcttttagtgaaaatatgtccgacattcggcctgcccaccctggaaacggctcagccggagg

SEQ ID NO: 4282 - DNA, 393 bp, Gossypium hirsutum
  Clone ID: uC-gsronu33B148a06b1
gcgcacgtttttatcatatcactaatcattcttggcgggcttatattatccgggaccatcttcctatataaagttgagaatttaggcctagttgattcgttctactgcgtttgttctaccattacaaccttgggatatggcgataaaagcttctcaaccgaaggaggtcgtatttttgctgtgttttggatattagctagcactatctgcttggctcagttttttctctatgttgctgaggtaaatacagagaacagacaaagagcactggtgaaatgggttcttggtcgaagaacaacaaatgtagatttggaggctgctgatattgatgataatgagctctgttggagctgctgagtttgttctattcaaacgtaaagacacggagaagat

SEQ ID NO: 4283 - DNA, 383 bp, Gossypium hirsutum
  Clone ID: uC-gsronu33B148a08b1
gcgcggttactttggagtccaacaccaaaaagccaactgggggggggtttaaaatgctattggggttttcaaaaacaccaaaacttgggaggggatcatgtgggaaagcacacaagcatcgaaagcctaagggaaagtcccctaaaggacccatcactatgcctccccttgtgaaacctccaatcaagatgccaccggttgttcctccaatagttaagccacccattgacctccctccggttacggaccctccaattaaccttcccccagggaccgctgctccagtaactaagccaccaagtgggaaaccctggccaacaccaccaaccaaggacacttgccccattgacacaactgaaaatgggtgcttggggggatctgct

SEQ ID NO: 4284 - DNA, 466 bp, Gossypium hirsutum
  Clone ID: uC-gsronu33B148b02b1
ggcgtcttttattcctcaccacaagaaaagctttgttactactttaatggaagctgccactctccgctctccttttaaggaagatacctacttcatctaccatttgaagtcttccgagaagaagtccttgcaagaactcaaggacaagcttacggcctctcttggccccggcggccaatgcaccatgtggggcatccctcttctctccgatgacgaaaaagccgatgtcattttgctcaagttcttgcgagctagggacttcaaggtctccgactcctttcacatgttggagaaatgtcttgcctggagaaaagagttcaaagcagacagtgtgacggaggaggagttggggctggaggagctggaggcagtggttgcttatatgcatggctatgacagagaaggccaccctgtttgctacaatgcctatggcggttttagagacaaggacatgtgtgagagaatg

SEQ ID NO: 4285 - DNA, 526 bp, Gossypium hirsutum
  Clone ID: uC-gsronu33B148b03b1
ccgagagatatattcccaaacatgtctaaagcctgcttgcttttggttctcgttggagtggtggtttttatcatcactccttctctagctaaccaacatcatgataatgagcttcccaaggggaagcctttcccaggtgagaagcaaccacaacacaagccattccctgaacaccgaccgccaatacacagtggacctggcggtaaaggacaggagccaccacatggggaaaaacctcctcatagaaacttattgagtgtggaagttgagggcacacataaacctccacgacattcaggtggtaaacctccaagacactcggggggtaaacctccacatgttgaggggttccctaccgataaagcacccatgaagccattccctggtgaaaaaccatccaagggtaagggaaagggagcacctcatgaacccaaacctcctcatagacacttattgagtgtggaagttgagggcacacataaacctccacagcactcaggtggtaaaccttcacgacattcagggg

SEQ ID NO: 4286 - DNA, 444 bp, Gossypium hirsutum
  Clone ID: uC-gsronu33B148b05b1
atgctggcccgcctgcacgggcccggccggaatggctggaccgacgcacgcgaacgctcttttgtttcatgaaaccgagaagacaatggcagtctgagtgaatacaaagctagatctgcgcgcagttgacgcgctgacaccagacgtactggcagcggcagatagaaatgtggttaggatttgctactgtgcgaccatagttaggtgttgagcttaaggctagaattagattgagggctcagggactggcgctgagctagaagcactcaggtatgtgggggatggggccaagaggaacttgaccagttacatattgagtatcgggcaaaggaactcggcaatggcatgatttatggaatgcactatattgagagcgcgttattacaattggacaacacattggtgtggaatttagcaaccaaatattggcaacgatgttatacg

SEQ ID NO: 4287 - DNA, 538 bp, Gossypium hirsutum
  Clone ID: uC-gsronu33B148b07b1
aatttatttttatttctatcgcacttttattccccaatgcctctctccctctctcatccgtaactctaaccctagccctctatcaggattcaaacatgaaaggaggtaaatccaagtcggatgccaagagcgccaagctctccgtgaataagaaatcaatcacgaaagctggaaagaaatcggggaaggcagctaaggatccaaacaagccaaagaggcctgctagcgccttcttcgttttcatggaggagttccgcgagcaatacaagaaggagcaccctaaaaacaagtccgttgctgctgttggcaaagctggtggagataaatggaagagcctttctgaagctgaaaagcgaccttatgttgataaggcagagaaacgaaaggtcgagtatgaaaagaacatgaaagcctacaataagagacaggctgagggtccccaagaagatgaggaggaatctgagaagtctgtatctgaggtgaatgatgaagaagaagatgatgatgaaggcagtggagacgaggaagatgatgagta

SEQ ID NO: 4288 - DNA, 435 bp, Gossypium hirsutum
  Clone ID: uC-gsronu33B148b08b1
aaacttggtatttccattaaaccaacaacaacaacaaagaaccaatcacttagagttaacctataagagaaaatggtcaccaaagtctacattgtatactattccatgtatggacatgttgagaaactggcccaagagatgaagaacggagctgaatctgttgagggagcagcagccgccatttcacagtggacctggcggttaaggacaggagccaccacatggggaaaaacctcctcatagaaacttattgagtgtggaagttgagggcacacataaacctccacgacattcaggtggtaaacctccaagacactcggggggtaaaccttcacatgttgaggggttccctaccgataagcacccatgaagccattccctggtgaaaaaccattcaagggttagggaaagggagcaccttatgaaccccaacct

SEQ ID NO: 4289 - DNA, 533 bp, Gossypium hirsutum
  Clone ID: uC-gsronu33B148b10b1
cgctttcattggtgatggtagtttccaggttaccgcacaagatgtgtccacaatgctgcgatgtgggcagaagaccgtaatcttcctcataaacaatggtggctacaccattgaagtcgagattcatgatggaccatacaatgtgatcaagaattggaactacactgccttggttgatgcaattcataatggtgaaggcaagtgctggacagccaaggtattttgtgaggaagagcttatagaagcaattgagacggcaacgggagccaagaaggactgcttatgctttattgaagtgatagttcacaaggacgatactagcaaagagctgttggagtgggggtctagggtctctgctgccaatagccgacccccaaatcctcagtaaattctacagtatgctttatgctataagcttttgagtttctgaatgcagagttaaaaatctgtagttttcaacattttgcaaaatttacagagtgcttgctcatcttgtgtaaattcattttcagtaatgaaagctatattctgtt

SEQ ID NO: 4290 - DNA, 354 bp, Gossypium hirsutum
  Clone ID: uC-gsronu33B148b11b1
cccattcgttcgagtcaacggagatgaaattttccgttttggtgcatagggggctaggcctcgggcagtggacgcgctgacaccgcacgtggaggcagcggcgcagagggatgtggctagggcttgctttcctccgaaaatagttaggtgttgggcttagggtttgaatttgattttgggctttgggactggggttggtttagtttgggcttatttttatttgggtttttaggcccaggtcaaaattgacctgttacaaaatgtttatagtacaaatgagcacgaataatacataattatgtaatatttgttatattatcatgcgtaattacattatcagtaaacatttgttat

SEQ ID NO: 4291 - DNA, 361 bp, Gossypium hirsutum
  unsure (1)..(361): unsure at all n locations
  Clone ID: uC-gsronu33B148b12b1
gagtttggtacatatatttgatggatagtttgaaagttttgacggctgttcaaatttatctttttttttccttttcattttattgtcaattaggcagttcgatttatgtagaaagattaaaaaaaagaacaaaaaaccaaacatgattttctatttgttacagttttctaaatgacatttaaagttttcttcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccttttgggggtccaaggtttcctccccgggcttggaaagccaaaatttttttttgggggcc

SEQ ID NO: 4292 - DNA, 428 bp, Gossypium hirsutum
  Clone ID: uC-gsronu33B148c02b1
gctcagtgtctgttttattcagcaagtttacatgtatttcagaggtagcggtaaagctgacgagatgaagcgtgaggcggcaagaagaaccgtggcggcagcactctgataatgataaggaggccgtagcagaagatggtatttgcttgtgttggacttagatcttgtgagataagataccatgtactcaaattgcatcttcttcccatacccttcctggctggcttacttgcctattcattttattgatatgttgtttaaatatatacacatactgctgaacgaagaaggttgagaaatcagataaaagttggatacaatgaccttcaaaaaaaaaaaaaaaaaaaaaaaaaaaaaaaaaaaaaaaaataaaattaaaaaaaataaataataaaaaaaaaaaaattattaataaatatatataaggg

SEQ ID NO: 4293 - DNA, 279 bp, Gossypium hirsutum
  Clone ID: uC-gsronu33B148c03b1
cccacgcgtcctttagggctgaacgtgggcggttactgcgacgggtgtgttgtgcgactgctgattgctgtgatgtggggcgtgcacgacgttagggtagctgctgttaaccactgtttagggttagactgggatttggggtttggtttagtaatttgggccttattgggccaaatgtaattgggttagattgattaattagggccccgagaatcaattgggtattacaaatgcaaactagaattgttctccaaatccaacactttatgtaattcatac

SEQ ID NO: 4294 - DNA, 141 bp, Gossypium hirsutum
  Clone ID: uC-gsronu33B148c05b1
gccacgcttttcttttgatctatgaccaatcatgatatataaggaagggtttcaacatgcactacgtggctgcaaataacactctaaaacacaatatgtgctacatgtttgctcaaaattcttaaaatactctaatagacc

SEQ ID NO: 4295 - DNA, 394 bp, Gossypium hirsutum
  Clone ID: uC-gsronu33B148c07b1
gctgttgtttccttcacagctttgcctaaggctatagaatgcaatgtgatgtcgtctgtactctgttacatgaatcgcagcgctacttttatagttgagcacaaaccctacttaccccttccagatttcctatctttatttgttttattttagagagaaataattttgttaaaagaacaaagagccaaagacatagatagttactccagagattttgtaagagaagagcaaggagaaaatggcggcggtttttcccacctggattttgatagcggccttgctttttgaggctgcggtggttatgggcagttttcctgcacctttgaagctggagagaaaaattcctctggcgagccatgagttggggctgactcaactgagagaacgagataga

SEQ ID NO: 4296 - DNA, 532 bp, Gossypium hirsutum
  unsure (1)..(532): unsure at all n locations
  Clone ID: uC-gsronu33B148c09b1
gccatgttgttcttgcccaagaaggtcactgcaggcctggagaggttttgttagggacagattcacacacctgtactgctggagcattcggtcaatttgctacaggaattggaaatacagatgcaggctttgtcttaggcaccgggaagcttctactcaaggttccaccaacattgagatttgtgatggatggtgaaatgcctccttatctgcttgcaaaggatttgattttgcagatcattggtgaaatatctgtagccggtgcaacatataaagccatggagtttgtcggcacaacggttgaaagtctaaatatggaagaacggatgacgttatgcaacatggttgttgaagctgggggaaagaatggagtcgttcccgctgatagtactacatttaagtaccttgagggtaaaacatccctgccatatgaaccagtttacagtgatgcacangcaagttatctttccgagtacagatttgacatctcaaagttggagcccttggtggctaagccacattcttctgataa

SEQ ID NO: 4297 - DNA, 533 bp, Gossypium hirsutum
  Clone ID: uC-gsronu33B148c10b1
ccatgcgttcggttgggagagattgtcactaccattgggaccatttgattcaatgttgagaccgttgaatacaagaacatcagctttactgtttgggatgttggtggccaggacaagatccgaccattgtggagacactacttccaaaacacccaaggacttatttttgtggttgatagcaacgatcgtgatcgtgtggttgaagctagagatgagttgcacaggatgttgaatgaggatgagctgagggatgctgtgctgctagtattcgcaaacaagcaagatcttccaaatgctatgaatgctgctgagattactgacaagcttggccttcattcactccgccagcgccattggtatatccagagcacatgtgctacttccggtgaaggactgtacgaggggctggactggctctcaaacaacattgcaaacaaggcataggtgtgacatgactgagttggcagtcttgcaacccttttggattttatgaatgtctgccccccgtttatgtgttattttttatggttttt

SEQ ID NO: 4298 - DNA, 526 bp, Gossypium hirsutum
  Clone ID: uC-gsronu33B148c12b1
gacctcatttagctcaagcagccatgggagcttacaagtacgtgtcttagctatggaggaagaagcaatccgatgttatgaggttcttgcagagagtgaggtgttgggagtaccgccaacacccgtccattgtgcgagttaaccacccaactcgtcctgacaaggctcgtcgcttgggatacaaagccaagcagggttatgttgtctatcgtgtccgtgtgagacggggtggaaggaagagaccagtacctaagggtattgtgtatgggaaacccacaaaccagggtgtcactcagctgaaatttcagcgcagcaagcgatcagttgcagaggagcgagctggtcgaaagcttggaggccttagggtcgtaaactcatattggatcaacgaggattcaacatacaaatacttcgaggtcatcttggttgatactgcccacaatgctatccgcaatgacccacgaatcaactggatctgtaatccagtgcacaagcgcagggaactccgtggactcacctctgctgg

SEQ ID NO: 4299 - DNA, 537 bp, Gossypium hirsutum
  Clone ID: uC-gsronu33B148d01b1
cccacgcgttcgtttgccttcaatcttcccaaatagatctcatttcccttctctccggtcgttcttctttgatccgctaagggaatcaatcacttcgaattctctcagcatagaaaagaaagcggcaggaaattttagttatgttggggacaggattggggtttgggagagttcgtggagaagataggttttacaatccggccaaggcgagaaggtcgtaccagaaacagcaaaccgatcaactacggagggctcaaagcgattatacggtcagtcaatcgaatgtgacccgggattcagagaaggggcttggttcaactgaccctcctaagccagttttggttcccgtttcagaaccggttgtctctccattgagtaattcagagcggtttttggactctgtcattccttccgtccccgcactttacctctctaagaggacgatgagagggtggcggacgtatgacggagaatttcagccatattttgtgttgggcgatttatgggagtcattcacagaatggagtgcttatggag

SEQ ID NO: 4300 - DNA, 464 bp, Gossypium hirsutum
  Clone ID: uC-gsronu33B148d02b1
cccacgcttcctttcgaatcgatctgttatctatgtaagtttggggagcattgcgagcatgtcaagggagcaacttgttgagctttggtatggacttcttaatagtaaaacgaagttcttgcttgttgtaaggccaaattccgtgattggaaaagatggtgaaggggaggatgttgtaatggagcttatggagaagagtaaggatcgaggttacattgtaaattgggcaccacaagaggcagtcttgaaccacccggccattggcgggttctttacgcataatggatggaactcgactttagagagcgttgtcgcaggggtgcctatgatttgctggcctcagtttgctgaccaacacgtcaatagtagggttgtgagtgtggtgtggaaaataggttggatatgaaggatgtatgtgattgcatgatagtggagaaaatggtaaatgatgtgttggtggatct

SEQ ID NO: 4301 - DNA, 205 bp, Gossypium hirsutum
  Clone ID: uC-gsronu33B148d03b1
accaaattttgttataaggcgtcgtgctcaccgtaagatctacccaacattgagatggcatgtagtggatgaaacatgcaaagcaaatcaaactctcaaatgtgtaatttatatgtttcttgtttaagacggtgtgtattattattataagctttcaaagcatagacagtatgtcatattgaaaccttgaactgatacattccac

SEQ ID NO: 4302 - DNA, 308 bp, Gossypium hirsutum
  Clone ID: uC-gsronu33B148d04b1
acaggttgtaggttggccacctatcagatcatttaggaagaactcagtggcctcggcgtcgaagaacactgatgaagtcgatgggaaggcagggcctggtgctttgtttgtgaaggttagcatggatggtgctccgtatttgaggaaagttgacttgaaaaactacactaaatatcaggagctgtcttctgcacttgagaagatgttcagctgttttaccataggtcagtatggatcttatggaaccttgggcagggagctgttgtgcgaaagctagctcaaggatctactttttggatcagaatatg

SEQ ID NO: 4303 - DNA, 502 bp, Gossypium hirsutum
  Clone ID: uC-gsronu33B148d06b1
tcggggttatttatattttatagttgaaagggttatataaaaacctaagggaggaacaattccaagcacttaagatttgttgcattgttattttgccttttcgctatcgactttgcctatcaactccacggcgcagatccgaggagtctctatttctcaatccaaacaaccgctctaaacactctgttctattattgctcctactcttccagacatggcaggtttggcaccagaaggatcccaatttgatgctcgtcaatatgaccagaaaatgactgagctgctccagaccgatggagatgactttttcacaagttatgatgaagtttatgacagttttgatgcaatgggacttcaagagaaccttctgaggggtatctatgcatatggttttgagaagccttctgctattcagcacagaggaattgtaccattttgcaagggtcttgatgtgattcaacaggcacattacggaactgggaaaacagggactttctgctct

SEQ ID NO: 4304 - DNA, 224 bp, Gossypium hirsutum
  Clone ID: uC-gsronu33B148d07b1
ccgctttattaaaaaaaaaaaaaaaaaaaaaaaaaaaaggggggttaattaaaaaaaaagggggggaaaaaccgcccggccgccctggggaacaggctccgccgcggcatgggccgccagccctcccatgggcccctaagtacatccccgggccggggcctacaccgcctcgccggggaaacccctgccgttccccaactcaatcgcctggggcctcacccccc

SEQ ID NO: 4305 - DNA, 233 bp, Gossypium hirsutum
  Clone ID: uC-gsronu33B148d08b1
cctttgcttacgcccacgcgtccgacaaaatccagagggcgcggattcatatacctcttcggggttgaaacctggctccccacatatggaaacgcctgttccagccgagaacccgaagacctctacccatcattacccaaattgggagaacccgacgcataactagctcaaaggaaagaaacgttttacaagatacgctccgcatctagagttctaggccacgacatgaccct

SEQ ID NO: 4306 - DNA, 373 bp, Gossypium hirsutum
  Clone ID: uC-gsronu33B148d09b1
cccacgcgtccgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctttgtaatgatatattgtcaaggatggatgcctgcaagggctata

SEQ ID NO: 4307 - DNA, 514 bp, Gossypium hirsutum
  Clone ID: uC-gsronu33B148d12b1
gcttttattgctgtagagacagctcaacgtctgttccttggaatgataaaatctgttttccgggcaccaatttcattctttgactcaaatccctcaagtcgaatcctcaacaggtcatctacagatcaaagcacgttagacacagatattccttacagattagcggggctggcatttgctttaattcagttgttcagtatcatcatccttatgtcccatgttgcctggcaaatcttccttctcttccttgccatcctcagtatctccttctggtatcagaactattatattacgactgctagggagctagccaggatggttggaattagaaaggctcctattttacatcatttctcagaatctatcacaggcgcaacaacaattcgttgttttggccaggaagacaggttcatggagaaaaacttgagcttaatcgatgattactctcgtgtagccttccataacttcagcacaatggaatggttgtgtgttcgaatcaattttcttttcaact

SEQ ID NO: 4308 - DNA, 301 bp, Gossypium hirsutum
  unsure (1)..(301): unsure at all n locations
  Clone ID: uC-gsronu33B148e01b1
cttttttgttttttaccttttctctcttttgcaaagttttgcagggctgaaaaaaaactgaatggaaaatagattggcacggttaaatcgatctaaataacgagagcccactaacagaaaagtattaagtcccaaacatcanagagagagagagagagagagagagagctttatctttttaatatttgattttacttgagattgatgatggttttgggagtggcaaacatttataccatatttgcctgaaactctcagagactttagataggtactacttcttttgcagtaaacgaagggg

SEQ ID NO: 4309 - DNA, 295 bp, Gossypium hirsutum
  Clone ID: uC-gsronu33B148e06b1
cccacgcgtttcttctcacgcgtccgagcaactccaaggaagaaggcagctgttgctgcatcttaagttggttttggtgttttgtttttgagatttctgaatttacacaaactagaagcttttatgatttttatcatcattttgtacttttattatttcaacctaatatccatgaacagatagttgtgttttaccatgaatcttcacgacattttgatttctcacatttttctcttgtgagatagtgtcatagtggtatgtcatccatgatgttaaaattttggtttttgcccat

SEQ ID NO: 4310 - DNA, 421 bp, Gossypium hirsutum
  Clone ID: uC-gsronu33B148e08b1
ctggtacgcctgcaggggccggaccggaccgcctggacccactcatgcgccaggacgtagcttgaccacgcagggaacgacacatcgagcggggggcattcttttgactttgctggtgatgaaccgaacgatgaacttttctgcattcgttttgcatcagtggacaattgcaaaagctccatggaaacggtccgagaagttgctgaatcacaaaaatcaacagaggaaaataaagaggcatctgctgcagctggtctacttgagaagttgagtgttgaggaaaaggaagccaaggataaagtggaagagaaggatgttaaagcaaaggaagaaacggaaacaaaggaggatacaaaaaaagtagatgatagtgagaagaaagatggggagccagaatcaacttaaaaaagggggttgggtt

SEQ ID NO: 4311 - DNA, 527 bp, Gossypium hirsutum
  Clone ID: uC-gsronu33B148e09b1
gtcttttttccgtcctttatttttttccaactaaaattaggctttaaactttataacattatgggtttagcagcagccctcctcttcctcctcctagcagctccggcggcttttgccgagcaatacaccgtaggagacagcagcggttggaccacgaccggagattaccaaagttgggttcaagggaaaacattcaccgtaggcgacacacttttgtttacctacggtggcagccactcggtggaggaagtatccaagagcgactacgataattgcaacaccggcaatgctattaaatcctacagcgatgggaacactgtcatcacactgtccaatccaggggcaatgtatttcatatgccccaccataggtcactgtgctggtggcatgaagctagccatcaatgttgtagcagctagtggcaactcaccctccaccccctctactccgtctggttccaccactccttccgggacttcccccagtggggggacaacaacttcttccccgtcaacacctagcggagc

SEQ ID NO: 4312 - DNA, 110 bp, Gossypium hirsutum
  Clone ID: uC-gsronu33B148e12b1
aaatttatttaaaaaaaaaaaaaaaaaaaaaaaaaaaaaaaaaaaaaaaaaaaaaaaaaagaatataaaaaaaaaaaaaaaaaaaaaaaaagaatgaaacattataaatg

SEQ ID NO: 4313 - DNA, 345 bp, Gossypium hirsutum
  Clone ID: uC-gsronu33B148f01b1
gttttctctcaattttgttgcaggtatattagttctcgcatttggaaagatggccaccacacttcatttttgttgtgctttctgtatctagcggtagtagcacagttgatgaccttgttgtatttggagttgcatatttgaagacaaaaaaggcccccattgagcaatggttaaaatactgccttttatcatttttatgctgatttttttataatattgaattcattcagacctttccaggaccattggctcaataaataaatctcttcatttaacctttttctttttggatgtattcccattttttctcagtgtactctcgataacgggcatgtttttttattt

SEQ ID NO: 4314 - DNA, 550 bp, Gossypium hirsutum
  unsure (1)..(550): unsure at all n locations
  Clone ID: uC-gsronu33B148f02b1
tcgcccacgcgttcgttcacgcgtccgtaactttgaatgagccccctgtggtcatgccgcaagtgcctcaagctgctgtaaccatcgatttgaatgcacctgtttccacagaaactggctcaacttgtgctatttcttacggtcgagcaggtagaataagtgagagtttacacagtatcataccgtctattccttctgaagctggcatcaacctctcttcaatgaccggngatagtttccggcgctacaatatggatggcattgcagaggtgttattagctcttgagaggatcgaacaagatgaagagttgacgtatgagcaattacttgttctagagaccagcttgttccttaatggcctgaatttttacgaccaacatagagacatgagattggatatagacaatatgtcatacgaggaattactagctctagaagagaggatgggtaatgtgagcactgcactatccgaagaagcaatgtcaaaatgccttaaaaaaagcatctacgaggcaatatctatggaggatgttgcaaaggtcagctgtga

SEQ ID NO: 4315 - DNA, 179 bp, Gossypium hirsutum
  Clone ID: uC-gsronu33B148f04b1
tcgcccacgctttcgttataacaacatttgattcaacgatctgagataggcattacgacttacgagacgtaactcgcaacatgtcattgtaaaccctgtatatttcaactttgaagcaatgagtagtttgttcataaacctgatatgttcgttcccatctaatgaaccgtctttcaatc

SEQ ID NO: 4316 - DNA, 510 bp, Gossypium hirsutum
  Clone ID: uC-gsronu33B148f06b1
cccacgcgtttctctccgccccaccgatactctttcccttggccacgcttatcgccttatcacttctcaagaggtcatgaagttcatgagagccaagaaatatgcaaaaaccaaaagggaatccatgaaaaaattgcagcaccatggacaagacaacctaacttcaggaggaaagtttgacgcacacatcaccaaccaagaactaaagaatgaaagacaaatctcacggacatcatctgtgaacgctgcttcaatgaggtcaaaatcatggcggccatcattacagagcatctctgaggctgtaggctaatagttttgttttcaagtttcttttcttaagtgcagattggttttaggaatggcaatgaactgcctcttttgttcaatgaaacccgaaattagggaaaatggaaattcaccaatcgaatgaaggtgataaccaaagatttcaacttgcaatcaaagctcccaaattgaaatctgtttcaagaaaaataaacatatgtatag

SEQ ID NO: 4317 - DNA, 547 bp, Gossypium hirsutum
  Clone ID: uC-gsronu33B148f07b1
cctttgcttccgctgagtgctataacatacttaaaattgctgtgggggaaatttgatatatataatatagcattaatgatgaagagtccaaacaaaattaagagttattattattctctgtttatgatcagcttgatgctttgtttaggtgcgaggtcccaactaaccactgatttctattcacaaacatgtccatctctcctttcaacagtacggaaacaagttcagagtgcgatcaagaccgaaatgcgaatggcagcctctctgctccggcttcatttccatgattgctttgtgaatggttgtgatgcatcagttttgttggatggagacaatagtactgagaagtttgctcttgcaaatgtcaattcggcaagaggatttgaagtcatcgacgcaataaaaagcgccgtagagagctcatgcagtggagttgtatcatgtgctgatatattagccatcgctgctcgcgattctgttgttttaagtggaggtccaacatggagagttttattaggaaggagagacggactagtttccaacggga

SEQ ID NO: 4318 - DNA, 232 bp, Gossypium hirsutum
  Clone ID: uC-gsronu33B148f08b1
attgttctttatggcaaaccttaagtcccaatgaaaagaacaatccaagctgacaaaggttaatatattttacacccaagtttgcatttttggtttcttcatggtgtggtacatttgtagaggaaatgatccatttgaaaaataggccaaatgaagattgtgatagaatgaggtggatatagttttacattgattgcatttcatgccttttttgtacagaacagctatatac

SEQ ID NO: 4319 - DNA, 541 bp, Gossypium hirsutum
  Clone ID: uC-gsronu33B148f09b1
ccctctcgtccgaccgccggggatgattcccaggccttgatttgggacttgtcctccatgagtcagcctgtggagggtgggcttgaccccatccttgcctacaccgctggggctgaaatcgagcagttacagtggtcatcttcccagcctgattgggttgccatcgccttctccaccaagcttcagattctcaggttgtgagagcaaaagagctgcagactcatttttttagaacgcatgggaagcagtgatttatggaccctgaactgaaacacaagatcaagacgaccactctttgctgtttggtttatgcaacataatctttgtcgttctgttggacaagatgagtgtgttttcagtttatttggttgtctgataagtttgattagttactataaatgtgataaatgatgggcaggaagatatgggtggcttaccctgggctgctttcagatgcttgtgttgtgttaatgttataactagctttagccatagaattgttataagaatgacttagttcttgatagatcgatggaaaacc

SEQ ID NO: 4320 - DNA, 332 bp, Gossypium hirsutum
  Clone ID: uC-gsronu33B148f12b1
gctatacattgaagtcgaatgaagctgacatggacccgggggatggtaagaagcaaaagtcgggggcaagaaacaaagaaagagaatccccaggctgaagccaaagaagaccccaaaaggttgggtgcgaaatggaagacgaccacggccgcagaaaagaagccttaccaagaggtatatccagccaaaaaggaagtgtacttacaggccatcgccaaagaaaaaccccagaccgaagccctgaaaccccttgaagatgaacataaaccaaagacagccctggagtcattggaacaacacctgcagttcaaggaagaagctgagaaagaaac

SEQ ID NO: 4321 - DNA, 318 bp, Gossypium hirsutum
  Clone ID: uC-gsronu33B148g01b1
cccacgctttctttcacgcgtccgaatcccaggaaattggccaaatagtgtttgcaattttttagggtagttgtaggctccataatttcctgtaaaattatttagttttggtttgtaataaataatattaggattcaaaatagcttattgtaatagtttataagcactgcgcattgaaaatgcaccggataatactactttccaaacttgagtatcctcgtgcttagtctctgcaagagggatctgtagaattttttgagcaatttctgcttgaaaggtactattaatcaaatccgacctccatttcttgtttgtatt

SEQ ID NO: 4322 - DNA, 239 bp, Gossypium hirsutum
  Clone ID: uC-gsronu33B148g02b1
ggaagccttaatttagagatcccatcggctagcaatcccaagaaccgagctattatgactagctaaatagataaattagtatccatgcaataagagctgcttaatactcatgttctgttttcttgtatgttatgtattaatgttttcttttactagcgagagtgcttatggcagtactcattggaatgcctattttatgtcttcttatttctcaatgagcaatatcctgatttcaacac

SEQ ID NO: 4323 - DNA, 138 bp, Gossypium hirsutum
  Clone ID: uC-gsronu33B148g07b1
ccgcagggacccggaaccggaaccccccggaccgacccacgcgccacgccataattataccccccccaccggctagcaaccccaggggccgagctaaaatgactagctgggtagataaaacaccccccacgcaagaag

SEQ ID NO: 4324 - DNA, 197 bp, Gossypium hirsutum
  Clone ID: uC-gsronu33B148g08b1
cctttgcgttcgagcagaggccttgattactacgctcctacggatttgctctcaggaagatcctcagaaattacatgtccaaaacccagcccaaagctaaaaactatgtttctagtcgagtggatctacggcatactggctttcctcggcctctggcatggggagactaagatctcatttgtcggcctagataatgc

SEQ ID NO: 4325 - DNA, 130 bp, Gossypium hirsutum
  Clone ID: uC-gsronu33B148g12b1
cggacgtgaccgcccacgcgtacgcccacgcgatcgggggggtgctttagaacagaataggcggagctatacacccggaaaacaaggccatgacaagctacacgctcttgtggagaggccctacttcata

SEQ ID NO: 4326 - DNA, 458 bp, Gossypium hirsutum
  Clone ID: uC-gsronu33B148h01b1
cccacgcgtccttccacgcgtccgtttcgtgtttgtctattggattcttttcctcactttctcgaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgctctgcaggtctataattatgtctctgtctgtgtcttgtgtaatagaagctttgtttgtggtgaaaataat

SEQ ID NO: 4327 - DNA, 316 bp, Gossypium hirsutum
  Clone ID: uC-gsronu33B148h02b1
tcgcccacgcgtccgtatggattgacgagttttgagcatccgaggagcaaaatgaatgcaatgccaagaattgacagtgaaggggtgatgtgtggtgccaatttcatggccgatgctcagtcgagaacaagtaggatgccccgagttggtagcgaagccaattgggcactgcgaggctccaaagcttgaataattcaatactaaatgacccacattttattatgttttttttttttgttgggggggggggttattttcttgtttatgaaatttgtaaatgccttgtaaaaggcatgtttgataaatacattgtaat

SEQ ID NO: 4328 - DNA, 248 bp, Gossypium hirsutum
  Clone ID: uC-gsronu33B148h03b1
gcggccgcccattagtatagtggctcaacagacatgagcgtcactcggacggcttttgttgaagatacacttgccatacagagcgcaaccacggggagcgaggttattgatagtggaaagctaatggcacatcgggccaaatccatgaagttcaaagacggatacatgatttcttctggccaccccagggaacgagtacattgactctgctgctcgacatgttcttctgagacagggagtactgggca

SEQ ID NO: 4329 - DNA, 524 bp, Gossypium hirsutum
  Clone ID: uC-gsronu33B148h04b1
ctctcctttattatttcccacttgcttttgccttcaaaatgggcttggtattcctatggctactgctgaggttgcatcagatcaaactgcacttcatgaggagaaaactgaagaatcagtgaaggatcaagaagctacaacagatgaagtagttgccgaagctcctgcagcggaagcagctgccgaagagccaaaggaagcggagcctgcggcggtggcagtcgaggaacctgaagcctcggttgaagttgaaaccaaggaggtggtagaagaaccaaaggctgttactgaggagccagtagtagaggagactcctaaggaaacagtgccagaaccagttgccgaggagatcaaggaaaccactgaacaaaccgttgaaaccaaagaaactacagagtctagtgaggcagcagcagaagcacccaaagaagaagttgagaaggaagaagaagcaaaaccggctgaagtggagaaagttgaaacagaaactgatccagcagagaagactgcagtaataataaagc

SEQ ID NO: 4330 - DNA, 424 bp, Gossypium hirsutum
  Clone ID: uC-gsronu33B148h05b1
cttttacttttcattatgtgtttgcgttgggtgttgcaaggttcctcagctgtgctcactgggttctccaggttttagacagccgaggccgcttgctggtagccctgggttatggattgtggccttctatggttcttatatcggaaattgttcaaactttcattttagcagacttctgttacttttatatcaagagcttgttctccgtctaccctctggggtggtctaagtgaagatgctattttgctgtggtcgacgagcttgctgccgaaagaaaacatagcttggttactaatgtgactaggtgttcttgtttaatttctggtttttgctctcagcacatttcttgtgactgcaattagtggattgtttgtaaatttcgggatgcagaaactttgggtggatatttatagggaagcatttc

SEQ ID NO: 4331 - DNA, 198 bp, Gossypium hirsutum
  Clone ID: uC-gsronu33B148h06b1
ttttatacgcacgcttgcgtgcgatattcacagctggaaatatagagcagccgaaacagagtcatcagcaggggcaaagactatgcttgaatttttccgactatggctttgatgagagtagcagtgtgaggaatgggaattcatcttctcattgattgaaacctgaatccggagagatattgaattttggtgagagta

SEQ ID NO: 4332 - DNA, 377 bp, Gossypium hirsutum
  Clone ID: uC-gsronu33B148h08b1
cccacgcgtccggctcctcggaggtctcgccgtccgtagggcctgctatggtgtgcttagatttgtcatggagagcggagccaagggttgcgaggttattgttagtggaaagctaagggcacaacgtgccaaatccatgaagttcaaagacggatacatgatttcttctggtcacccagtgaacgagtacattgactctgctgttcgacatgttcttctgagacagggagtactgggcatcaaggtgaagatcatgcttgactgggatccaaagggtaagcaaggcccaacaactccactcccggatcttgtcaccatccaccctcccaaggaggatgaagttataaaggtggaagcacctgtgccgaccgagattg

SEQ ID NO: 4333 - DNA, 359 bp, Gossypium hirsutum
  Clone ID: uC-gsronu33B148h09b1
gaaaagttctgtttttctgcaatggcgaccattggtccaactgctatggtgaaagatgagcgtcgtcatcgtgattcccacgattaggaacttggactttttggagatgtggagacccctttttccagccttaccatctcatcattgttcaagatggtgatcctaccacgactatcaaggtccctgaaggcttcgattatgagctttacaataggaacgacatcaacaggattttgggtcctaaggattcttgtatctctttcaaggattctgcttgtaggtgatttaagtacatggttcccaagaagaaattcttaaaaaccattgatgatgactgctttgttgcttaagatccatct

SEQ ID NO: 4334 - DNA, 422 bp, Gossypium hirsutum
  Clone ID: uC-gsronu33B149a01b1
cggtcgcgtgggtggcgatagacataaaaacaagggccactaccagagcagtatttggggttctatctctcttatttggtgtaattgctgagaacaaaaagccggcatttggaaatccagaaattcagacatcaccccttcgagtaatttgcaactatccatcggatcccactgttggtcttgggttcttatccattgcatgactcactacttcaggtgcgctcggatattactctgtgtttcatccttacaattccacatatgtatcgtattatgtcttcttccgatccatccctttcttcgtcttgttcctcatcaccatgggactgtcgacgttgggagaggtatgttaacatggttaaccatcacagagctcagtcatttaactaacaagcgtcataaagacatggagaccacatgtg

SEQ ID NO: 4335 - DNA, 459 bp, Gossypium hirsutum
  Clone ID: uC-gsronu33B149a02b1
cctactcgtccgagttgatattcaaaaaccactttctaaccatactattcccagttgaccggttttccgagatgggtccttcttcacgaacatatttcagcaataacggctttacgtgtctgcagattttggattatatctattccttttatcaggagaacatgtcgagtcatgaaatagaagctgctatccacacggactcgaggcatgctgaccggcttcgagcattgtactctagcaaagagacagttgaatgcggtggaaacatgattttcaaacgaatcgatttcttaggaagtcgtagaagcttcgaaatgttaaagcgtgttagtggggataataacagtaatgtatatgagctcttgattagagcctaaaatatcatcatatatagcattactggtaaaggattgaatcttcagtcacagcatcaatactcaggtcgaccgcggaataata

SEQ ID NO: 4336 - DNA, 387 bp, Gossypium hirsutum
  Clone ID: uC-gsronu33B149a04b1
cttattcatacatatgatgcccctcattcattggcattttcctttttcttatttgttctctttcacctttaattgtgtccttctgtcaatgttgtgttccaaaaatgtatgagaattttgcttatattgatggcactggaagtaaacaatcttcctcttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccctttaaaggaaccaaattttactccccgggggttgggaagaattattttttttttggggcccccaaaataa

SEQ ID NO: 4337 - DNA, 463 bp, Gossypium hirsutum
  Clone ID: uC-gsronu33B149a06b1
cctactcgtccgggaaccattgctcgtggtacagcaccggttaatgatgaacggctcaagttacaattgcagtatagtgaaaaggatcaggctgaaaatttaatgattgtcgatcttctgaggaatgaccttggtcgtgtctgtgaaccgggcaccgttcatgtgccacatctcatggaggtggaatcttacgcaactgttcatactatggtgagtacaatccgggggaaaaagcagtcaaatgttagcgctgttgattgcgttaaggcagcatttcctggcggttcaatgacgggggccccgaagttgagatcaatggaacttttagattccatcgagagctgctcccgtggtatatactcaggctccattggattcttttcctataatcagacatttgatcttaatatcgtgataagaacagttgtcatacatgaaaatgaagcaactataggtgcaggag

SEQ ID NO: 4338 - DNA, 417 bp, Gossypium hirsutum
  Clone ID: uC-gsronu33B149a08b1
ataaaaaaaaacaaaaaaaaaaaaaaacaaagaggggggatttttaaaaaatttttgggtttcacccccccaaaaactttttatattctgattctttccttcctttccgttgcccccgctttccccttcgggtctggtctatcctcttctctcccgggggggtcccctttttggggttccctttttttccccccggccttcccgcctttttttcttttttcgggcgcccctcctctcacttccgccccccggtttgcccccgcctcgtcgtcttgacccccggcgttcccccctcctttttctttggggccccccccctttttctctgctttggtatgctcccggggggccccccccctttccctctttcctatctttctcgccccttttggctggttgcccccccctcttttggtc

SEQ ID NO: 4339 - DNA, 366 bp, Gossypium hirsutum
  unsure (1)..(366): unsure at all n locations
  Clone ID: uC-gsronu33B149a12b1
attaaaagaaagaaaagcatcaacaacaacaaaaaaaagcccatacacttaagtgaaaaaccagacaagagagaaaacaagaaaaatgggtgttctggatcatgtttcagatctgtttgactgttctcacagttccaagcacaagaaacgtaagcagttgcagacggtggaaatcaaggtgaaaatggactgcgaaggatgcgaacggaaagtgaaaaaatcagtggaagggatgaaaggggtgacacaagtggacgtggagcggaaggccagcaagttgacggtcgtcggatatgtggacccgaagaaggtcgtggcacgagtggcgcatcggacggngaagaaggtggagctatggccctatgt

SEQ ID NO: 4340 - DNA, 468 bp, Gossypium hirsutum
  unsure (1)..(468): unsure at all n locations
  Clone ID: uC-gsronu33B149b01b1
cctactcgtccgaacatttttgattgccaagtttgatggtatacttggacttggatttaaagagatttcagttggaaatgctgtgcctgtatggtacaacatggtcaatcaaggtcttgttaatgaaccagttttttcattttggctcaaccgcaatcctgaggatgatgttggcggagaagtggtttttggtgggatggatccaaaacattacaagggggaacacacttatgttcctgtaaaacagaaaggatactggcagtttgatatgggtgatgttctgattggtgaccaaacaactggactttgtgccagtggctgcagtgctattgttgattccggaacttccttgttgactggacctacngctgttattgctcaagtcaatcatgctattggtgcaacaggngttgtaagtcaagaatgcangactgtggttttcagatacggagaaatgataattgactt

SEQ ID NO: 4341 - DNA, 481 bp, Gossypium hirsutum
  unsure (1)..(481): unsure at all n locations
  Clone ID: uC-gsronu33B149b03b1
gacgaaccagagccgtccgattcgactactgtggggtccaatgtacggaaggatctgagtgaatggcaagagaggcatgccactcttgttcttactactgtgaaggtatatatgtgtgtgtgcgtgtgttacatttcactatagattttgtaactctaaggctgcgtttggctttactctgtagttgtgtttaatcctaattgctgaacttggcattgagatgaactttccctgaagtcaattctttgtgtcattataattttgtattccaaaaggaaatttcaagctagacttaagtttagtaagaattgcatgaaacatttcagattttgtactttcaataattactttatgcanaacatattattcttatgcagganatcaagaaattgagatatgaattgtgtcctcgtttgatgaaagaaaggacttcttggaggatatatttcactcttgtaagcactcatgtngcaccttatga

SEQ ID NO: 4342 - DNA, 236 bp, Gossypium hirsutum
  Clone ID: uC-gsronu33B149b05b1
cctactcgtccggccacgcaagcgtgccataccaaaactatactcttcaatgtacgtgttatccccacgtgagacctgaatgggacttgtcatgcaaagccatcagaaaatagatcaaaacgaggcttgcaagaaactaggagcctcgaaagatggggcggatattgaagagaacctaagataacctaaagcatgatgctagtatgcaccagtcatatacagtaacatagaatgaa

SEQ ID NO: 4343 - DNA, 328 bp, Gossypium hirsutum
  Clone ID: uC-gsronu33B149b07b1
tctacgcgtccgcccacgcgtccggtgagaagtagctctagaagcagttgggggtgatgaaaacctggcccttgaaaagcttttatccagctgatctgtgctggagctgccaattgttctacatcttttagtaattcttcacctacctggtgaatttgaacgccatacaatgacacaattatatctgaatataagctgtttctaattactgagttctgattccataaatttccatttttcgttgaccatgcttataacttttgttcgatgaaatgttgttacttgcattttgtttaacggcagcttcgagttgccattgctggttttc

SEQ ID NO: 4344 - DNA, 408 bp, Gossypium hirsutum
  Clone ID: uC-gsronu33B149b08b1
atcgcactatgcacactattattcaggagcgggaggatttttatacatcttttgcggattctaccgcgaagaaactccagatggacggacgatacctcagagatgtgtggtgatgggtataatttcttgtagcgttctttcaccagttcatctcagagaaaaaacgggtgggtttgatagtgatggcagaaagctaaactggattttcatattgggagaagatctgctagatgttagatcttttttttttctatttaaattctctaaatcttgaaataatactctaaatagaaggatcaattgttattggactttgccccgccattggaagttgtaataaggaacagtgtgatatagctagtttacatgcatgtgcaaacaatattaaaaaacttctcgtaggttatt

SEQ ID NO: 4345 - DNA, 371 bp, Gossypium hirsutum
  Clone ID: uC-gsronu33B149b10b1
tcctacgcgtccgcgtgtttgtctattgaattctggccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaaatacaggcctctgtaatgatatattgtcaaggatgg

SEQ ID NO: 4346 - DNA, 420 bp, Gossypium hirsutum
  Clone ID: uC-gsronu33B149b12b1
ttgttacgcgtccgacgcaacccacttagctactacaacgtttacccaaacttaccaaacctcaaataaacagtttacaggtaatttttctttcttcagatctgaccttctgttttttttcgttctttttttttggtgtcactttttctttcaattcttgtctttactatttttattttgcttttgttccttttcgttattttttttttgggtcgttaggtttcggtttccgtgtgcgttttatggaatatggtttttaattgatgggaactccaaattgggagtgttttaagatgggtttctagttttgtctcttttcctaactctaaaaatggaacaagggagggaataattgaattgcttcgatgtctcgctcttattttaaggtgttctgggtcgtttatggaatgttagatatat

SEQ ID NO: 4347 - DNA, 403 bp, Gossypium hirsutum
  Clone ID: uC-gsronu33B149c01b1
cctacgcgtccgcccacgcgtccgcttgggttgagtgtagatatgaggaaaatcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaat

SEQ ID NO: 4348 - DNA, 380 bp, Gossypium hirsutum
  Clone ID: uC-gsronu33B149c02b1
cgtttttgtagaaggcatggtctactcacccactgaaggtgtgttcatgactgggagatatgcctctaaagaagaggccaagaagaaggggaataaaattaacaatgtaggttggtggtttaaaccctggttctaccaacatgcgcaaacggccttaaagaagggagagtttgtagagtacattcctacaagagaatattaccacaggcacacaagatgtttgtattgggaggggaagctcatccttccattcggagatcaatggtggcttaggtttctcttgggctggttgatgccacccaaggtttccttgctcaaggctactcaaggtgaatctataagaaactattaccatgagatgcatgtgattcaagacatgc

SEQ ID NO: 4349 - DNA, 446 bp, Gossypium hirsutum
  Clone ID: uC-gsronu33B149c03b1
ccctctcgtccggacctcctgatcctaattttagtccttttctcaggcactttccttctatcctcttacttctcctacctgttccattccctttcccttctcctttcccctctcctctccacccaaagcgcttccttttctctccctttcgtttcctaccttttgggttgcacacttttctttgtcacaacccttatttccatcgagttctgctgcggttcacggtcccgtaaatgcgaaaagcctggttgcaaagggctgaacaaggctttggagtttgatttgcagctacaaacggaggattgtgtgaaaaatggatcacaggagattgatcgctcgccttggaaaggtgggagtgaagggaaccccgattatgagtgtttgagggctgaattaaggcagatggcaccgcctaatgggcgagctgttttgctttttcgggctcg

SEQ ID NO: 4350 - DNA, 484 bp, Gossypium hirsutum
  unsure (1)..(484): unsure at all n locations
  Clone ID: uC-gsronu33B149c04b1
cttagtttaagcataagagggtacctaaggcttcgggatctccaccagggccagtgatgcattcccctccacgtcctgttactgtgaaggatcagcaggactggaaaattccaccttgtatttcaaactggaagaatccaaaagggtatactattccgctggataagcgacttgctgctgatggaagaggtttacaggaggttcagattaacgataactttgcaaagctgtctgaggctttgtatgttgcagagcagaaggctagagaagctgtggcaatgagatcaaaggtgcagaaagagatgatgatgaaggagaaggaaaggaaggagcaggagttgcgagctttagctgctaaagcccgttctgagagaactgngacggtggcaccatctactgctgttccaatgtcatctgatagaagtgtgatggatactgatacgagagtggattatgagcctgcgagggacagagaaagggatat

SEQ ID NO: 4351 - DNA, 200 bp, Gossypium hirsutum
  Clone ID: uC-gsronu33B149c07b1
ttttcttttaactttgatctgctctggtatttgccataggtcttatgttaatcttttttgtcctaatgcattgttgggttttcttgttttgatgaaatagaaattgggtttttgcttgtttgcgattttagttagatttgcatagtgaattgaggggttgagtggatgaagatctagggtttcttaggtggttgtgattt

SEQ ID NO: 4352 - DNA, 454 bp, Gossypium hirsutum
  Clone ID: uC-gsronu33B149c08b1
tttctgcccaaaacacagatgaaggcggccgagtggaacacaaagaatacaatgatactggaagaaggagacgcatatatatgttctgcttcaaaacatggaaaggttgatgatgagtgcgtagaaaggtttatggagcaacttaaagccaaagtgaagagtgacgtagattattgagacttccaaatcttagaagaggatttagggaaggatttgagaacggctgggagatttagtgttccgctacgcctggaacatattgcatagagaatgaaagatgggtctggagatattacttcacacagttcacactgtgactgtgcagctaaggctacctatcttgtcttctgtgctgcaatcagagagatgcatgatctcaaactagaccaggtcaacaggactaagttattgttgtggcgagatgcaggtaacactgccctcaagcttcaattca

SEQ ID NO: 4353 - DNA, 489 bp, Gossypium hirsutum
  Clone ID: uC-gsronu33B149c10b1
gcttccactcgctcgttgagtgtagagatgaggaaaagcatgggtgccaaagttctcttcttctttgctttgctttccttttcagctgtgtcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtccctgaagctgttcttgtgctgatatccttgctctgtctgctagagaaggcatcgcttcgttgggaggcccttacattcctctcaaaactggaagaaga

SEQ ID NO: 4354 - DNA, 433 bp, Gossypium hirsutum
  unsure (1)..(433): unsure at all n locations
  Clone ID: uC-gsronu33B149d01b1
ctctctctctctctttcccatagtttcacccatcttttaatccatcgctcacaaaattatgggtttgaaggaggaattcgaggagcatgccgagaaagttaagaccctcccggccgccccttcgaatgatgacatgctcattctctatggactgtacaagcaagctactgttggaccagtgaataccagccgtcctggaatgttcaacatgagggaaaagtacaagtgggatgcatggaaggctgctgaagggaaatcaaaggaggaagcaatgggggattatatcaccaaagtaaaacaactgtttgaggctgctggaagttcttgatgtgtgtgtgtatgaccaatgaaactggtgtaatttcaagcccttgtcggttacttggggttttcattactatgaataaattatgtactctttttctannaaaaa

SEQ ID NO: 4355 - DNA, 73 bp, Gossypium hirsutum
  Clone ID: uC-gsronu33B149d02b1
atatataaaaaaaaaaaaaaaaaaaaaaaaaaaaggggcgtctcgatatgaggttccaggctaccaaccacgg

SEQ ID NO: 4356 - DNA, 417 bp, Gossypium hirsutum
  Clone ID: uC-gsronu33B149d03b1
gattctacgcccccatttattttatttttcaaacggaggttcccttcaattttcgtataatttcctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttgttgatctggagcctactgttatcgatgaagtgaggactggtacgtaccgccagttattccaccctgagcaactcatcagtggcaaagaagatgctgccaacaatttcgctcgtggccattatacaattggcaaagag

SEQ ID NO: 4357 - DNA, 460 bp, Gossypium hirsutum
  unsure (1)..(460): unsure at all n locations
  Clone ID: uC-gsronu33B149d04b1
cctttgtgtccggttggagactttgaaaccgtgggagctttgttaaagagagaacccagtcttttacatcataccactgtttatgatcgccattctgctcttcatatagctgctgctaatggccagatcgagattttggccatgcttttggataaatccatgaacccagatgcggtgaatcgtaacaagcagactccacttatgttggctgcaatgcatgggaagatctcctgtgtgaagaagctcattgaagcgggggccaatatcttaatgtttgattccctccatggaagaacttgcttgcactatgcagcctattatggccactttgactgccttcaagccatcctctctgctgctcaatctagccctgttgctgtttcatggngatatgcacggtttgtgaatataagagacgctaggggagccactcctttgcacttagcagctcgtcaaagac

SEQ ID NO: 4358 - DNA, 494 bp, Gossypium hirsutum
  Clone ID: uC-gsronu33B149d05b1
gatacattgattaaagggctggcactgctgccgctggtggtattcggaggaactaccatttcagaagcaagagaagtagaggtggggtcgtaccttccgccatcccccagcgacccttctttcgtcgtcttcaaggcctccacaaaagacaccccagctctacgcgcaggaaatgtgcagccataccagtttcttatcccacccacatggaagcaaagccgagtggccaacatcttgtcgggaaattactgccagcccaagtgtgcagaaccatgggtagaagtgaagtttgaagatgaaaaacaggggaaaatccaaggggtggcatctcctttgatacgtctaacaaacaagccgaatgcatcgatcgaagaaattgggaaccccgagaaagtgattgcatcacttggtccttttgtcactggaaattcctatgacccagatgaactccttgaaacatctgtcgaaaacgtgggcacagacgtactacaata

SEQ ID NO: 4359 - DNA, 489 bp, Gossypium hirsutum
  unsure (1)..(489): unsure at all n locations
  Clone ID: uC-gsronu33B149d06b1
cctactacgccgctactttctatgcagaagtatatacaaactaaattagctcggcttctctgcaacagaaatggctcccgcttgcttacatcacgagaaagcttgcgtgatggacgcctccggtcgccttggctctaccctggttgaacgcttgttggaaagaggctacactgtccatgctgctgttcaaggccatgttgatgatttgaaactgaatggggtagctactgaaagggaaaagaagctcaagattttccgggcagaccctttcgattatcagagcattaccgacgccctgaaaggctgctctggtttgttttacgcctttgagcccccacaagaccaccctgcctatgatgaatatatggcagacagggaggcacgagcagcacataatatggtagaggcatgcgctcggacggagacaatagacnaggtggtcttcacatcctncgccactggctgtctttggagagacacaattcccaa

SEQ ID NO: 4360 - DNA, 401 bp, Gossypium hirsutum
  Clone ID: uC-gsronu33B149d08b1
ctcacgcgtccgcccacgcgtccgagagaccgagcgaggtttagcatgagtttctcggtggaatcgcttagtggacccagaccggtccaaccaccgcaaaaatgggcggacttcgcggtggtttcgactaggaagtactatccgaggccgacgccagttgagtcagaggattgttatagtgactgtgatttatcattgtaggtggctgatgatggggatatactcgtaggatctgagtgggagtaacttattgtttggatctcagtgttccacccttggatgaagatgaagatctccagtgaccgctttatgtctttgatcaccatgccggtgatgaatgatgatgatcgattattggatctctttttcttttttaaaaaatgttagttttttttaagcgg

SEQ ID NO: 4361 - DNA, 331 bp, Gossypium hirsutum
  Clone ID: uC-gsronu33B149d10b1
tttacgcgtacgcttttttccttttgatacgattgtggttctgggtggctttttctcttcacatttgtttctcccgatgagcaaacgctcctttgtcgttacaattagaggctattgccactcaactcaccactattggatctgaccttggatatttctgcttcagatttttctgttataatctttctagtatcttctcgaagctgctttccaacggagaaatagatcgaagagagagggcagaacagacaagtgacaagaggaaatggctctccccacaagaagcatataaattttgccggcatgatcggatgagagatgctcttcaagt

SEQ ID NO: 4362 - DNA, 357 bp, Gossypium hirsutum
  Clone ID: uC-gsronu33B149d12b1
gtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggat

SEQ ID NO: 4363 - DNA, 481 bp, Gossypium hirsutum
  Clone ID: uC-gsronu33B149e01b1
ctttatctcaaatctcatctgcaccagccgacgacatggggaggagacctgcaaggtgttatcgccaaatcaagaataagccataccccaaatctcgatactgccgaggtgtcccagatcctaagatcagaatttatgacgttgggatgaagaaaaaaggtgttgatgagtttcctttctgtgtccatcttgtgagttgggagaaggagaacgtctcaagtgaggcattggaagctgcccgtattgcctgcaacaagtacatggccaagtttgcagggaaggatgctttccatttgagagtgcgggttcatcccttccatgttctgcgtatcaacaagatgctttcatgtgccggtgctgataggcttcagaccggaatgaggggtgcttttggaaaacctcaaggaacatgtgccagagttgacattggtcaggttctgctctctgttcgctgcaaggatagcaacagccatcatgcaca

SEQ ID NO: 4364 - DNA, 476 bp, Gossypium hirsutum
  unsure (1)..(476): unsure at all n locations
  Clone ID: uC-gsronu33B149e02b1
aaccttgcagctcgcacgctctcatcattttcctgcgggaccgtcagtctccccaaacaccttctttccgagaaaaagaaaagctcaagagagaagaccatggccgatcaacttacggacgatcagatctctgagttcaaggaggctttcagcctttttgacaaggatggcgatggttgcattactaccaaggagctggggactgtgatgcgatcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcngtgagaagcttacagatgaggaagttgatgagatgat

SEQ ID NO: 4365 - DNA, 469 bp, Gossypium hirsutum
  unsure (1)..(469): unsure at all n locations
  Clone ID: uC-gsronu33B149e03b1
gtgatgggttcgaaaagaacagcatcactagccctgctctttgcactcaacatcctcttcttttccctggtgagtgcttgtggttcctgcccttcccccaaccccaaacctaaacctaaacctaaaccaaagccaaaccctactccctccccatcttcttctggcaagtgccctagagatgctcttaaactcggtgtatgtgctgatttgctccgtggcttgctcaacgtcaccattggtacccctcctgttcaaccctgctgctctctcatccaaggtcttgctgatcttgaagctgccgtttgcctttgcacggcaatcaaagcaaatattttgggcatcaaccttaatgtcccactttccctcagtttgcttcttaatgtctgctcaaagaaagtaccctctggcttccaatgtcgctaaatcagntctctaaattctttctcttcttagtgctgcgtggcttgat

SEQ ID NO: 4366 - DNA, 491 bp, Gossypium hirsutum
  unsure (1)..(491): unsure at all n locations
  Clone ID: uC-gsronu33B149e06b1
atttttatcaagccctgttgcagagccacaagtttctgactatgccttggaggaggacttcagtgagtacgtcaactctgttcacattgaagataatccagttgacaactatagtatcccagagcaaccagagcaagaagctgttgaagatgaggatccagtggaggaagctcctacagaggaggaaacccttgtttcacatcacagtgtagtgaatactgtgcaagaacctccatctatacctttggaggaacctgttggggagcctccgaggagaacttatgcttctattttgagtgttcccaagcagcaatctgcttcatctgctcaagttcaaccttcttataacaagattccctcgagtacttcagattgggaccagacaccagaatatactaatcagcagtcacattctgcttggtcagatgttcctgaatctgcngcagagacagcagtggaggaagctttagtctctgaagaaggtgatatac

SEQ ID NO: 4367 - DNA, 274 bp, Gossypium hirsutum
  Clone ID: uC-gsronu33B149e07b1
tttccatctaatctggggaaaagtcctcttaaccgaggatcgaattagtggggatctttgtcgaatattctgataaattctgttggtataatgtgttttttaaaatggtttttcatttcccagtcttttgttttgagtgtgttaattggcttggcttaacagaactgtaaaatgttccctcttccttcttatatcccattttcatatgtaacaaaagattccatttgcttttcttgccagaaatatataatacttaaaacatattttttgcttg

SEQ ID NO: 4368 - DNA, 430 bp, Gossypium hirsutum
  Clone ID: uC-gsronu33B149e08b1
ttcttaacacaacttaccaactcaaaaaccccagggtttcactttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggctgaataatttgtgtctggtgtagtttgcgtggtgacttatatctgtcagttaacctttctctctttactatgatgtaatggctatgcttatggccctatctg

SEQ ID NO: 4369 - DNA, 362 bp, Gossypium hirsutum
  unsure (1)..(362): unsure at all n locations
  Clone ID: uC-gsronu33B149e09b1
ttctcagacaaaaccacagggtcatcagatgcagagccaagcatccaatgttcagtgtagctaactattggcctgccccatcattcagccgaataaaagccgcaaaggcccgctcaagaagtggaaggattacgacgaaaatatgaacccaacaaatgagcttggacaaaaaataaagttctttttttaaacgggttgagccttgtaagatattttccattactatttattgttgttttgttgctgtttgctgcaattttgattttgttttgatacaattttgctattatattggtactattttgctattatttggatattggaaaactcttgttttattattaattntgttactattttag

SEQ ID NO: 4370 - DNA, 460 bp, Gossypium hirsutum
  unsure (1)..(460): unsure at all n locations
  Clone ID: uC-gsronu33B149e10b1
tgttttcgattaccagaaggagaaaatggatggggaggatgaagatggatattggtcaactgctgttgaagacatcaggtgggatactatgtttcaggatttgaaaccaacttgaacgaattatttcatttttaaactcctgttgttttctgttcaaagttctccattatgtttgatttcagaggtgagagatgggatttttttagcagttcccaccggttttcttttttttggtgcttgtggtgggggaagattgataacttttatccttatcttcttgagtggtgtttcaatcattaggttgtctccccctgcttttttatctttgatagaaaaaaaaaagagaaagaaaaagtaggaatcagtcactttgggaaaaagaaagactgaaacagaggtatcgaaatatgcagagtaagaagcangcattgtattgtaaatctttaaatgattgctttat

SEQ ID NO: 4371 - DNA, 483 bp, Gossypium hirsutum
  Clone ID: uC-gsronu33B149e12b1
tctacgcgtccggaaagaagttgctgctactgagcatgattggggaagtttgtcgactcgtgaagaattacgttcttcatttaatgatttgaaaaaccaactttacggaaaagacaacaacaaagtttctgttaaagacttccatggcttacaacaagcattggataacactattgcctggggaaaacctccggactacctcgaacttattgcgatccgaatcgaaaaagctcgtggaaaagctgccgaagtttctcatatcggtattcaagttctggtttgcgctgcaatcaaagagatggaagattttcggattgaagatttagagtgggatacattgaaaaagtggggggcaactctcaatatggctaagcaacttggttttcaagtggtatttgctgataatctgttgaagaccaagttgcttgcctactttgctactcaaaaactattagatgcgacttgaaaagaagtataatttaa

SEQ ID NO: 4372 - DNA, 455 bp, Gossypium hirsutum
  Clone ID: uC-gsronu33B149f04b1
cacaatcccaaatctccaattgatctgtttcatttttcagcaaagctagaaaaacaatgactaaggatatcgagactgcagagcaacatggaggggagttctcggccaaggactaccatgatccaccacctgctccattgattgatgctgaagagttaaccaaatggtcgttttacagggcagtgattgccgagttcattgctacacttctcttcctgtatgtcactgtgttgaccgtgattggttacaaggtccaaaccgaccctgctaagaacactgttgaccccgattgcggtggcgttggtattcttggtattgcttgggctttcggtggcatgatctttattcttgtttactgcatcgctggtatctctggagggcatatcaacccggctgtgacattcggtttgttcgtgggacgcaaggtgtcactcatccgagccctgatgtacatg

SEQ ID NO: 4373 - DNA, 477 bp, Gossypium hirsutum
  Clone ID: uC-gsronu33B149f05b1
cctactcgtccgcccacgcgtccgcccacgcgtgcgcccactcgtccgcagctaccaagaaagaaggagaggaaggtgaaactgttgctgaggaggcaaagaagagcaaccatgtcttaaggaagttggaaaagcgtcagcagaaccgcaagcttgacccacatattgaggatcaattcagtagtggtcgtttactggcttgtatctcttcacggcctggtcagtgcggccgtgctgacgggtatatcttggaaggcaaagaactagagttctacatgaagaagatccagagaaggaagggaaagggagctgcctaaagttttgttacttgagatatcatatttcagaccaaatgtcccttttttaacctttctttcatcattttcagtagattttgagattgtgatagcggctacacatttagtatgaatcttcaagtagtgaagttgtgtcgtaattcaacagtattatcatata

SEQ ID NO: 4374 - DNA, 484 bp, Gossypium hirsutum
  unsure (1)..(484): unsure at all n locations
  Clone ID: uC-gsronu33B149f06b1
ctcaattagctcacaactgcctccaccgggacccaaaatcccgtcctacaatggatgaagtagtgaaagttctcactccgttgcaagaccttaatgatctcgccatcttatcctaccactctcgtctatctcaacaagggaggcgaaagaagaaaccagagggatctcagcaactctccaacactcaatctaaaagcatcagaggttctcctttgaatactggcaaacagaggtgtagatgatctgtaaccgactcctgccatcattggctcagctatcaaatgaaaacagatgttgggatgccatggtcgcattttcgattgtgtgaagacatatatgtcaggcttggttgtgcaatttcagggagtttgaaaaatttggtagaggtaaaaccaatttattacactagagagctaaccatccccactgttgtaattgaggagtatctcttgtaattagatcaaacctnccatttcaatgactg

SEQ ID NO: 4375 - DNA, 255 bp, Gossypium hirsutum
  Clone ID: uC-gsronu33B149f09b1
tctttttttctttttttgttgctatcaccatggggaagtttttaatacaatttgggcatctaacacacaagaacccccaactcacatgcacaggggagggataaagaaaaggaaccacaaacatggccggcgacaacttgacggattggaaccacgccggttatcaaaaatcaagcaaatgatcccaaagcggacgcgtattcacatgacaggatcctacatgagatgcatgaaggccgaccgtcagtccttaca

SEQ ID NO: 4376 - DNA, 509 bp, Gossypium hirsutum
  unsure (1)..(509): unsure at all n locations
  Clone ID: uC-gsronu33B149f10b1
tgtggagttcaatctctctggtttctcaaactaaagcaatatttggtgggtttttctcctattgtttgccatcaacacaatctggagcatcaggttcattagttttgggaggcaattcatcagtttacaatacttcaagccccatttcttataccagaatgatcccaaatcccaagctatcaactttttatttcctcaaccttactggtatcagtgttggtggggtgacactgcaagatttaagctttggcaaaagctcgatgcttattgattccgggacggttatcacaaggcttcctccaacaatgtacagggccttgaaggcagagtttcagaaacaattctccagttttcctactgcaccggctttctcgatcttggatacttgctttaaccttagtgcataccaagaagtggatgttcctacaataaaattgcagtttgagggtaatgctgagatgaggtggatatcaccggngtcttttactttgtaaagacagatgcatctc

SEQ ID NO: 4377 - DNA, 448 bp, Gossypium hirsutum
  unsure (1)..(448): unsure at all n locations
  Clone ID: uC-gsronu33B149f11b1
tcttgggcgacttgataattggaaattgagttttgattggatgagggatgaatttatatatacgatgaaaggggcttatccgtatgtcgttgattcatcagactgcatattcggtccgcaaggacaacattatagggatctagactttggcaatgtgttgaactgtgagaggaggccgacgattattgacctgcctctgacaaaggcaaacgatacaaccatggggatgatcccaaaacgttgccggaatggtactatcttgccaccaacaatggaccctagcaagtcaagttcagtattccaaatgcaggtctttaaaatgccaccggatctcaaccgctctgagctctctcctcctcagaattggaagatcaatggcacgttgaaccctaantacaaatgtggtcccccagtccgtgtaagccctagtcagttcccagacccaagt

SEQ ID NO: 4378 - DNA, 476 bp, Gossypium hirsutum
  unsure (1)..(476): unsure at all n locations
  Clone ID: uC-gsronu33B149f12b1
tgttttttgtgaggaaaaagaagcttcaatctttggttgttaagtgggtgaaacaaaaaaaaaaatggagggcaaagaggaggatgttaagctaggagccaacaagttctctgagagacaacctattgggacatcagctcaaacagacaaggactacaaggagccaccaccggcaccattgtttgagcctggtgagctcaagtcatggtctttctacagagccggaatcgctgagtttgttgctaccttcttgttcctttacatcactgtcttgactgtcatgggtgtctctcaatctaagaccaaatgtactactgttggtattcaaggcattgcttgggcctttggtggcatgatctttgctcttgcttattgtaccgctggcatttcaggtggccatattaacccagctgtgacctttgggttgttactggcanggaagctgtcccttacangggcagtgttctacatgatca

SEQ ID NO: 4379 - DNA, 372 bp, Gossypium hirsutum
  Clone ID: uC-gsronu33B149g01b1
gattgtttgatggggtccgacgggccagcagcagtaaccatccatgtgactggttttaagaaattccatggagtttcagagaatccaactgaaacagttgtcagtgatttaaaaagagtatacagaaaagaaaggtttgccaaaaggtgttattcttggcagctgtagtgttcttgagactgcaggtcagggagcactccctcaactataccagacattgcaatctgccttaaccggcaaggaatcttcttgttctgggagaattatttggctacattttggagtcaatagtggtgcaagtagatttgctgttgagcgtcaagctgcgaatgaagctactttccgttgccctgatgagatgggatggaaacc

SEQ ID NO: 4380 - DNA, 373 bp, Gossypium hirsutum
  Clone ID: uC-gsronu33B149g02b1
ggtgttagtacgggattttggataacttgattcgattcagcttcggggttgaagacttcgaagatttgaaggccgatatactgcaggccctggagagcatagcttaaatagcgttttgatgtgtttagtatttttcctagtttaaatggggcatgttgatctccaaaagtattttctgttgtgtttgattttggtagatccacattggttgaatgaagtcatgattttgaataatttggaactttggggtgcttgtttttagaaaattgatctaccgaaaatgttttttgtattttcttaatcttattttatgaaaataacttatcaagtggaaagtgatttattggttaaaataaataagtccattttattg

SEQ ID NO: 4381 - DNA, 442 bp, Gossypium hirsutum
  Clone ID: uC-gsronu33B149g05b1
gcatattaactgtttggcaatctgcatatcatcttggataagttctttaagacctatgctcggggcttatactttagttttcattgcgttccattattccgtccatggtctatttttaagtttcccttaccttttacttcttgttgttcacagctattcgacggtaaagatggaaggccgaagtacccccgaagatgggttattcttcctccattcctgtagaaaggatcgatgagcatcgtacttttcgagatattaaatttacgacgttgaaacatggtttccgagttcattgaaagatcaattcttgctagattatggaattttagtatgtgggcatgcattaggatgcttctttgcttatgtaaaatcattgccggtttaaactattgctgttgggtattatttcaattgatggattttcattttcttattttaaatc

SEQ ID NO: 4382 - DNA, 503 bp, Gossypium hirsutum
  Clone ID: uC-gsronu33B149g06b1
ccttgtcgtatcagacgcttttctccccttctctgaaattcccttgctatcgttttctggaagaaaattttttgagatggcccgtacgaagcaaactgctcgtaagtctaccggcggcaaggctccaaggaagcagcttgccactaaggctgctcgcaagtcggcaccgacaaccggaggcgtgaagaagcctcaccgatatcgccctggaactgtagctctgcgtgaaatccggaagtaccagaaaagcactgaactcctcatcaggaaactgcctttccaaaggctcgttcgtgaaattgcccaagactttaagaccgatctacgtttccagagccatgctgtattggcgttgcaagaggcggcagaggcataccttggtgggttgttcgaagataccaacctgtgcgccatccatgctaagcgtgtgacaatcatgcccaaggacattcaacttgctaggaggattcgtggtgaaagggcttaataaattcacctctctg

SEQ ID NO: 4383 - DNA, 451 bp, Gossypium hirsutum
  Clone ID: uC-gsronu33B149g07b1
tctacgcgtccgtaaaaacaaaggtatatgcagatcaaaattcagagtaaaagatcgacgatgagcggcttttgctcggcgatggcaatgacgatgacgatcgtcttcttcttcttgttccttcagcaaactccattaatggcggtggcggcgaaactcgaagaagatcatttcatcattaagaataagccaacgctgtacgacttttcaagcagagatgagatggtgcatttggcaggatacggcgaagagaagctctcgaccgttctcgtcaccggaactgttctttgtgaagcttgccaccaacgccgccgccgcgatccacaacctcaacttcgttcatggcctatatcaggggctttggtgtctggtaaatgtgaaactccttctaagaccaaatcaggtacaacaccagctacaaccgatgaatacggagatttcatgatcgatc

SEQ ID NO: 4384 - DNA, 172 bp, Gossypium hirsutum
  Clone ID: uC-gsronu33B149g09b1
tttacgcgtccggtccatgtctggtatcttccattctatatctagaatttttgttttcaagttcattatggtttttttgttgactatgaccttaaaagttttgaaacttgctttagaaaaatttactagtgaaatgatcccgagaaaaaaaattggatcatgtttgtcttct

SEQ ID NO: 4385 - DNA, 487 bp, Gossypium hirsutum
  unsure (1)..(487): unsure at all n locations
  Clone ID: uC-gsronu33B149g10b1
atcggttcatctcactactgttcaagaaaagttacttaaagaaaggaaaaccatggctcctagatcaaaacccagcccgattagcccgaatcccgacccgaattctaaggagatccgctaccgcggcgttaggaagcgcccatggggccgttacgcagccgagatccgagacccgaggaaaaagactcgagtctggctcggcaccttcgacaccgccgaggaagcagcgcgtgcttacgatgcgaaggcgcgagagttccgcggcgctaaggcgaaaacaaatttcgccgacaacaacgccaacgacttcacgcgcagccctagccagagcagcaccgtggagtcttcttctccgccgccacttgaccttactctggccagcccgtgttcttccctccctgtgacggcgcagcgtccggtttacttcttcgatgccttcgctactggcggntcgggttgccccgcatccggattcgctcaaagcgac

SEQ ID NO: 4386 - DNA, 301 bp, Gossypium hirsutum
  Clone ID: uC-gsronu33B149g11b1
ttttaagaaggttggacaatgcaggatggaacaccatggcctggaaacaatgtcagagaccatcctggaatgatccaggtttttcttggtcatgatggtgttcgagatattgaagggaatgaattacctcgtctaatttatgtttctcgtgaaaagagaccagggtttgatcaccacaagaaagctggggccaacagtagctactttctaaaaattgtggaattttatggatccacgcttggtatgtagccaagcccaagaaaaaaggaacgaggggaagaatcgacaaggaatccataac

SEQ ID NO: 4387 - DNA, 521 bp, Gossypium hirsutum
  unsure (1)..(521): unsure at all n locations
  Clone ID: uC-gsronu33B149g12b1
ttttatcgcgtggggcctgccttgcccaggaccctgacagcaaggttgcctgtgaaacatgcacgaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactttacaaagcgtccagaagagattggagccggtgaccagggtcatatgtttggttatgccactgatgaaacccctgaattcatgcctcttagccatgtccttgcaactaagctcggtgcacgtcttactgatgttaggaagaatggcacctgcccctggctaaggcctgatggtaaaacccaggtcactggtgagtactacaatgacaatggtgccatgngttccagtcgtgtgcacactgtcctcatctncacccaacatgat

SEQ ID NO: 4388 - DNA, 438 bp, Gossypium hirsutum
  Clone ID: uC-gsronu33B149h01b1
atttgtatggagactcgtgaatttatagcggacgtggagatgcttagccgattgcaccaccgcaatcttgtcaaacttgtcggtatatgtattgaaggacgcatacgctgcttggtgtatgaacttgttccaaatggaagtgtggaatcacacttgcatggtgttgacaaaaacaaaggacctctcgattgggatgcacggctgaagattgcccttggagctgctagaggattagcttatcttcatgaagattctaaccctcgagtgattcaccgagattttaaggctagtaatgttctattagaagatgactttaccccaaaggtctcagattttggtttagcaagggaggcaactgaaggaagccagcacatttctacccgagtcatgggaacttttggatatgttgctcccgagtatgctatgacggggcatcta

SEQ ID NO: 4389 - DNA, 406 bp, Gossypium hirsutum
  Clone ID: uC-gsronu33B149h04b1
cttgtgggtgtgcaggattaaagggtcaccatggggtccaatatgatgcttaatagtaagtttttgttcttatcagctttgttttgcattgctgtagctggcgttttaggccaagctcctcctactcctagtaatcctccgacatccacgccggcgccgccgactccacccgcttccacacctccacctactactcaaccacctccaacacccacaactacttctccgccaccagcttcctctcctcctcctacttcatcaccaccaccagtttccactcctcctccagcgactcccccgcccgttagctccccaccaccagcttctcctcccccggctactccacctcccgcaactcccccaccggcttctccacctccggctaccccaccacctgcttctcccc

SEQ ID NO: 4390 - DNA, 219 bp, Gossypium hirsutum
  Clone ID: uC-gsronu33B149h05b1
atatatgcaaaggagaagaagaaagaaaagaaggggaaggattaggaagaagatgatgaagatgaccaatcagaagagggaaagaaagaaaagaagaaagacaaagaggcaaaggagaagaagaaagaaaagaagaagaaggatgaggtagaagaagctgaagaattagaagagggaaagaaagaaaagaagaaagacaaagaggcaaaggagaagaag

SEQ ID NO: 4391 - DNA, 493 bp, Gossypium hirsutum
  Clone ID: uC-gsronu33B149h06b1
ccttctcgtccgaacgccatccttaaaaaaaaaaggtgcgatttgatctcttttagtgaaaaaaatggctgaaaatcttatgcatgctttacaatataacagctatggcggaggcgctgctgctttgaagcatgttgaagttccgatccccactccaagtaaaggtgaaattttgcttaagctggaggcaactagtctaaacccaattgactggaaaatacagaaagggattctgcgcccagttttaccaagaaaatttccccacatacctgcaagtgatgtagccggagaagtcgtaaaggttggaccaggagtcacaaattacaaagttggggataaagttgtatctcttcttgatcatttgactggtggactagctgaatatgctgtggctacggagaatctgacagttgcaaggccaccagaaatatcagttgccgaagctgctggtttacccatggctggtctcacagctcaccgagcagtcacccat

SEQ ID NO: 4392 - DNA, 292 bp, Gossypium hirsutum
  unsure (1)..(292): unsure at all n locations
  Clone ID: uC-gsronu33B149h09b1
tttgtccccattgagggtccttacaagcctggtgactacaggtactgaggagagaatacgagagagagagagggagagagttggactagaaaaaggaaccatacnaacgggatggtttgattgtttgtttttactaaaatttattgatgatttgtggttagatggttagattttgattttgataggagtttgcgtgtgggatggatggtaagttttggtggaaaagaaatgaggtctctgcttgaagaagaccaaatggggtctgaataaggtgatggggattgtgtgggag

SEQ ID NO: 4393 - DNA, 447 bp, Gossypium hirsutum
  unsure (1)..(447): unsure at all n locations
  Clone ID: uC-gsronu33B149h11b1
tgttctcgaggcagcctcaagcttacaacatgcgtgtccagcaacctagcattaatgaagcccccacagggatcccatcgagccggccgcagactccttccaatcctaccatggctcctactcatgtagcatacaaccctatgagaaatgctcctcttgctaaacctgaaatgactgctgctgctggtgtatacagaacaacaaatactggtaacccacaactggttcaagtgcaaaacagccagcatcaacaacaatatgcgggttattctcagattcatcatgcatcacaatctgttgcacctacctccagcacggctgccccatatgcatatgaattcactgatccaactcatgctcaaatgtattacactcagcctatggcacccaacatgcctnctcagtaccaaaccatgactgcagtagtcttgccagatgcacccacgc

SEQ ID NO: 4394 - DNA, 366 bp, Gossypium hirsutum
  Clone ID: uC-gsronu33B149h12b1
gatatgttgatccaggtatacttataaggaagctccaaaagtcagggaaacatgcacagctatgggggtcagctcaaaagggttcaaacaatttcccaaaccaaatgaccaaccacttcatgaacatgcatatcgatggtggcaaaggagggaaagacaacagatctcaaaagggtggtaatggtggtggtcggtggctggaaagagtcatcagcaaaaaggtgggcagcaatttggaccaccaccacaccttatgcagcaaatgatgaaagggccctaggattctaagttaccaccttccaaagaccagaaatctgtcatgtttccagttgcctgatgatgatttatatgacagtgattgtgatt

SEQ ID NO: 4395 - DNA, 566 bp, Gossypium hirsutum
  Clone ID: uC-gsronu33B150a01b1
cccacttttccgccaagagctaacatttcggatcctgtgtttgatggacaaaacaggggagggcctgaagtagctaagagaacatctgttggatcttcatctagcatgaagaaagcttcttcaactacaaatattgttgatgatctaagttctatttttggagctgctgcatcttcatctggtgagttccaagaggttgaaggggaaactgaagaaaggcgaagagccaggttggaacgccaccaacgaacgcaggagcgtgctgcaaaagcactggctgagaaaaatcaacgtgaccttcaagtgcaaagggaacaagctgagagacatagaatttctgaaacacttgatgttgagatcaagagatgggctgctgggaaagagggaaatttgcgtgctctactatcaaccatgcaatatgttctttggcctgaatgtggttggcaacctgtttctatgacggattcgattacagctgctgctgttaaaaggcttacagaaaggctactcttgcttcattctgataaggttcagcaaaaggtgccatcttcagtagaatatatttc

SEQ ID NO: 4396 - DNA, 543 bp, Gossypium hirsutum
  Clone ID: uC-gsronu33B150a03b1
gaactttttcgcctggaccctgagagctctaccccttatgtgcttttagccaatatctattcatctttaggaagatgggatgatgtaagagttataagagctgatgagtgaaaagcagattgttaaggatcctggttatagttggaccgaagataaagagcaagatacatgtctacttgttgggtgatacatttatggatggtcaatgaggcttttgacgacattactctctatgttagaaatcagtcatttaggttttgtgggctgtgccgaagatgcaactaaaatcactcaatagaaggccaagagaatgacatgggaaaccaatgatctttgctaccaaaatgatttggccatagtttgcttattgtttaacttatttatttatgtaaaaaggtggagaatgttgcagagttttgaagtggaggttcagtggcgaatcacccaagaacccgcataagagtccatgttgcccatcccctgtcgtcacaggatggtagtgcctttcttaagtgtaataaatacctatatttccctagtcat

SEQ ID NO: 4397 - DNA, 259 bp, Gossypium hirsutum
  Clone ID: uC-gsronu33B150a04b1
cccttgtttccggaagctcaagggaacaacagcttgggagatttggctcatctaaatgccagatatatatctatatatatatatagatattcagctgtataaatatgtgtttgtttttcttgccttttcatttttactttgttcaagactctctccatagaataatctttgtatgcttcggttgggattgtatttgttgtcacaaaacttacattgtttttcttccaagtctaaatcaaatggatttgttatctcgatt

SEQ ID NO: 4398 - DNA, 454 bp, Gossypium hirsutum
  Clone ID: uC-gsronu33B150a05b1
tgctactccagtcaatctcaagatcattgatctgtgtgtgggtttcgcagtcttcactgctctgatccaggtggtttacatggctagtgtgggatcatttcctttcaactcttttctttctggagtgctttcttgtgttgggactgctgtccttgctgtttgtcttcgcattcaggtgaacaaggaaaacaaggaattcaaggatctaccacctgagagagcttttgcagattttgttctttgcaacttggtgctccatttggtgatcatgaatttccttggataaaatcataatttccaggttttgccggactgcgtgttttctcagtttccggccgtgattcataattttagcatgaaatgaagttcttagatcatcattatgagcttgagcatacattcagaactgtagtaggaatttgatattttatctttggctaaagagtttcaagat

SEQ ID NO: 4399 - DNA, 444 bp, Gossypium hirsutum
  unsure (1)..(444): unsure at all n locations
  Clone ID: uC-gsronu33B150a06b1
ccctcttgttcgcccacgcgtacgcccacgcgtgcgcgccatcggagccaaaactttgtgccaacggctgtgggtttttcggcacggcggcgaatatgaacctctgttccaagtgttaccgggacctccgtgccggggaggagcatgctgccatggcgaaagctgccatggagaaatccctcagcgttaatacgaagcaggaagatgtcgttgacgagactgtgaagcctgctcttgagcttcctcatgtgggttgctcatcgacggtggtcgagaaacaaccggctgctattgtctccgatgataaaccggcggaacccaaggcggagaacaggtgctttatctgcagaaagaaggttggattgaccgggttcaagtgcaagtgcgggagtacattctgcggttagcatcgntacgcggaaaaacatgattgctcctttgatt

SEQ ID NO: 4400 - DNA, 484 bp, Gossypium hirsutum
  Clone ID: uC-gsronu33B150a07b1
tcttcgcgtccgcacagcttgccgataacccatgactcctatattcatctttcagcataaacgatgtcttcggttggcgaagctgcttgctcttatgctgcttcgattctccatgatgatggcatccccatcaccgctgagaagattgccacgctagttaaagctgccaatgtctctgttgagtcttattggccaagcttgtttgctaagctttttgagaagtgcgacattgagaatctcataaccaatgttggtgctgctgctggtggtgctccggtcgccgcagctgcacctgttgcagctgctagtggaggcggtgctgctgctcctgctcctgcagaggaaaagaagaaggaggaaccagaggaagagagtgatgatgatatgggattcagtttgtttgattaggaactccttttagtatgtgattcagtcgattacgggtttagtgtattaagcatgacactaacgctcttgagtttta

SEQ ID NO: 4401 - DNA, 255 bp, Gossypium hirsutum
  Clone ID: uC-gsronu33B150a08b1
gtctataacagaccaataatggcacgtcaacatgggcatgatgataggaaaatataagcttctcggactttgatagggaagcatttcttttcaccaaatgctaaattttgttgtatcgcttgtactggtgagtggttttggaactatatatccgctggttttttctgattgaagtttgcacaagtggtgttggtgaatagcagttttggtattggtttttgggtttctatgtaggaagaaatggggtgtagttgc

SEQ ID NO: 4402 - DNA, 458 bp, Gossypium hirsutum
  Clone ID: uC-gsronu33B150a11b1
tgtctttctatcgcccccctcccatagctctagggaggattcctttctcaaaaattggcttcttctctcataatacatataaaaaatcctccttcttttatactcttctctttgtcttatataatctcagggtgatagagcaacaaaaatacgaccatatatcaaaggaaaaaaaataaagagagattcaagggataatacgatgaccaagttaccttctttgtttctggttttgactttggtttctgtttttgtttgtgggtttggaaaaaggataccaattctgtcatttgatgaagggtatagtcagttgtttggagatgataatctagctctccacagagatggtaaagctgttcacttgtcttcgaatgagagaacagggtctggatttgtgtctcaagacctttacttgcatggttacttcagtgcttcaataaagttacctgctgatcata

SEQ ID NO: 4403 - DNA, 441 bp, Gossypium hirsutum
  Clone ID: uC-gsronu33B150b01b1
cccacttgtccgctttagaaaagaatggcgaaccctagccacagcgccgttcagaaatcaggccgctctaaggcctttcgagcctcgccagaacttcgatcgcgacggagcgggctgagattcaacaacaccaggtgcatggaggcgtgatgacatggaggtgcaacacgcgcggaggcctaattcccaactgcggcgcagactattcaagaaaccctaggggtttctggagatttcaaattgggccacttcaaatcgggctagggtttaattcggtctaggattgtattgggtctaggattgggtcagattttgggtttaagttattaggctttggattttgggccatacgggcctattgtaactggactgttatgtttataggactttttatttgctttatatatttttttgtttgtgagggccgggcagagtttgagt

SEQ ID NO: 4404 - DNA, 525 bp, Gossypium hirsutum
  unsure (1)..(525): unsure at all n locations
  Clone ID: uC-gsronu33B150b03b1
gatttttaagacgtattgcatgcacccatatctgacgcaacatactcctgtaatagtcaatctatttatgccaccttttgcgatggtaacattggggtatttgatgctgatagcctgagacttagatgccgtatcgctccatcagtgtacttgtcctcggtaatcttaaaaggaagtcaaactgtatacccgcttgttgtggctgcacacccgatagaagcaaaccaatttgcgatcgggttgagcgatggaactgtgaaagtactggagccctccgaatctgaagggaaatggggagtgagtccaccagcagataacggcgtccagctcaatggtaggacgacatcatcatctaccacaagcaatcacacaccagatcaattacaaagatagatttatgaaatgtagattattaggttcttactttttagtgttccatatatcccaaaaaggtaaaaccctgaatgattaagaatgccccaattcttggataatcctcctacttgatngatagtttttcactag

SEQ ID NO: 4405 - DNA, 437 bp, Gossypium hirsutum
  Clone ID: uC-gsronu33B150b04b1
ccttcgtttccggaccatttctggtgtttaagggtgggatctcatcgagaattatcgatgggaggtggccatggacgggagcacaacttacaaaggtgtgaacttgcaccacccaaagagatggcgcgtcgccaccggcaagggctcgggcgctgacatgtggttcagggtcctggacaggggtaagcaggatggtcccgtagagctgggttggcgacacccttgggagggccatgatgaccattctcatggccatggagacaagcattagctgcagcctgaagaagctaatgtgcttatgggtgcgtggcacagatgctgctctggaatgcctgccgtttattttcttcggtgtcaaaaaagagatggtgaaaagggattgtcagccaatgaaatgaaaactgaaacttcatttatgcattagggttttacatgcc

SEQ ID NO: 4406 - DNA, 441 bp, Gossypium hirsutum
  Clone ID: uC-gsronu33B150b05b1
ccttcttttccgcccacgcgtccgcccacgcgtccgcaatgacagctttcaaaaccagatgtagtttcagtagctgtatttatgctatgaagccttgaatgtgtactttgattggattttttttcttgctagttgtcttggtttatgcatacacatctaattgacatcatagggaatatcttcctgtgcccattctcaggaaatgtaggagggaacttcattttagtaggctcaagggtgaaccaacttttttcccctataggtcgtgtttgagaagcaattgacccaaacaattgtgatgagatgggtccaaacacagtgccgaccctatcccagcttctggaagaactgcccaggggaggaccaagacacgatgctgtgaatgaatgggatagaacctctcttggagagtcagtgacgttggtcagaacatcattttta

SEQ ID NO: 4407 - DNA, 553 bp, Gossypium hirsutum
  Clone ID: uC-gsronu33B150b07b1
ttttaagatatcactgcaagaaaaaaaaaaaaccagacatggcttccaacactgttgcatccgctgctcttcttcttaccttgaacttgttgttcttcactttggttagctctacctacgtgccttgcccaccaccaccaaagagccacaagcctacccacaaaagcccaccctcggcacctgaacagccaggcacttgccccagagatgcactgaaactaggcgtttgtgctgatttgttgggctcagtgcgcgttgttgttggaccgtcgaggaccaaatgctgctctctcatttcgggtttggctgatctcgatgctgctgtttgcctttgcactgctattaaagctaatgtgttgggggttaacctaaacgttcctgtttcattgtctttgctcctcaattcctgcgaaaagcaaatgcctgctggttacaaatgtgcttaagctcattttcactgtttcctcagcaatgtttgggtttttcttttacgtgttctttttttttctgggcttgtttaattggtattttgtatgtcagggttgataaatgg

SEQ ID NO: 4408 - DNA, 135 bp, Gossypium hirsutum
  Clone ID: uC-gsronu33B150b08b1
gtctaatagtaatgttaagcattttatttctgtagtaacagttccttaagagaatcgttttccttttgttgtattttatttcctgccttttaagcttcagattctgacatgttagtatctgcagttttttgaacc

SEQ ID NO: 4409 - DNA, 541 bp, Gossypium hirsutum
  Clone ID: uC-gsronu33B150b10b1
tcttcgcgtccgaaaaaaagtgtctcatttttagcaaagttacagtcgtcctcatcgaacaactatggcagccatcaaagtccacggaagccctatgtccactgctacacagagggttcttgcatgccttcacgagaaaggtactgattttcagtttgttcccataaacatggctgccggtgaacataaatccgaaaactacctttccctcaatccattcggtcaagttccagcttttgaagacggggacttaaagctcttcgagtcaagagcaatcacccattacattgctcatgaatacagcgacaaagggacccaactcttaatccctggctctaacaaggatatggctgtcttagaattatggaaggaagtggaagcccaccagttcgattctccatcttcaaaaatagcctgggaggcgttttacaagccatttttcggcatggttaccgactccgcggctgtggaggaaaatgaaggtaagcttgccaaagttcttgacgtgtacgaggctcgatggacacagtcaaaatacttg

SEQ ID NO: 4410 - DNA, 517 bp, Gossypium hirsutum
  Clone ID: uC-gsronu33B150c03b1
ccttcttgtccgcccaaaccgccggttgtgaagggggggccatatacacccaatccgccggttgagaagcctccgccatatacacccaaaccgccggttgtgaagcctccgccatatacacccaaaccgccggttgtgaagcctccgccatatgcacccaaactgccgggtgtgaagcctccgccatatacacccaagccaccttactatccaataccgccggtcatctcaccaccaacactgcctccaaagccaccagtctaccccagtccaccaatagtgaaccctccaccatatacacccaaaccgccggttgtgaagcctccgccatatacacccaagccaccttactatccaataccgccggtcatatcaccaccaacactgtctccaaagccaccagtctaccccagtccaccaatagtggacccaccaacaccgccgattctgcacctcctattgtgaatcaccaacaccgccgattctaccaccaccatcaccacctatggtgaaccca

SEQ ID NO: 4411 - DNA, 472 bp, Gossypium hirsutum
  Clone ID: uC-gsronu33B150c04b1
catgtttctcaaagagtcctaacaatgggatccaagggggatctttacccgttgtgattctgcgaaaaggacctcctacgagtcgacgatcgcgaatatctgtatgcctacgccgacgaccctagcagtgcaaattaccccttaatacagaaactgagacaagtactagtagaccatgcattgatgaatggtgacagagaaaaagattccaccacttcaatctttcaaaagattggagtctttgaagaagagctgaaaacccatttgcctaaagaagtcgaaagcgcccgaaccgaattcgagaacgggaattcggctatcccgaacaagattgaagaatgcaggtcctacccattatacaagtttgtgagggaagctcttgggactaatttgcctaccggtgagaaagtgatttcaccaggagaggatgtgacaaggctttcacagcaatgtgtgcaggaaggtgattgat

SEQ ID NO: 4412 - DNA, 289 bp, Gossypium hirsutum
  Clone ID: uC-gsronu33B150c05b1
agtttattctagcctgggttagggttttctaattgtgggtgttttgtttgttttaatggaaattagggttttgtttttttcaacattagcactattttgatgattatctttgttataaaatatttgaagctctgagcttatcaatattgagaacatgtttcgagtttatctactgttttctttttaatgttaaaagtaccaattcattgaattggcattggaaaaaaaaatctctaaactatcaaatataaaaataaaaaaatacaaatatatataattcaatctatag

SEQ ID NO: 4413 - DNA, 484 bp, Gossypium hirsutum
  Clone ID: uC-gsronu33B150c06b1
gcttctttagcagaagcagaagcaaagggtttagagacgaaatggcagcgaaatggaagactcccgtcaagaccagaaacccggatctgatccgtggtgtgggaaagtatgtccaggtctaagatgtaccacaggcgtggcctttgggcaatcaaggccaaaaatggcggtgctttcccccgccatgatcccaaacctaaggcccccgctgccgctgagaaacctcccaagttttacccggctgaggatgtcaagaagccgttccttaacaagcgcaaacctaaacccaccaaactcagagcaagcattacaccagggactgtgttgattttgttggctggaaggtttatggggaagagagttgttttcttgaagcaacttacttctgggctccttttggtcaccggaccattcaagatcaacggtgttcctttaaggcgcgttaaccaatcctatgtcattgctacttccaccaaggttgaca

SEQ ID NO: 4414 - DNA, 510 bp, Gossypium hirsutum
  Clone ID: uC-gsronu33B150c10b1
tcttatttcttcttcttcactttgaggtttgagcagatcgtatggcaccaattataagacaaggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatgggtcccttgctaggaaggctataagggaattgatggcaagaggatcgattcgtttggtgtctgcccattcgagccagcagatttacactagggcaaccaacacctagatcctttgttatatttttgcttaaattagttctatgtagtatttgcctttcttgactttctataaatgatttttccttttgctaaagacctccatctaaattgtgtgagctacagtttcttgttgtactggtttaatggat

SEQ ID NO: 4415 - DNA, 343 bp, Gossypium hirsutum
  Clone ID: uC-gsronu33B150c11b1
ctttcgcgttcgtaatgatacattagtgtcagggcgtcatttgattgctcggtacctgaaactccaaaatactcaacccatggaactggatgaatgcgcggaattgttctatgaaggtataagttcgtatggtccttattgggaccatgtcttggggtactggaaagtgagcttggaacgaccagacaagctaatgtgcttgaaataccaatatggggctggagatactgttttgtgtcttcagagaccaccagagtacatgggttatgctttgtcgcatgcggaacaacatcaggggcggccatgagacattgatgctatgtgcaggttcgacaatcgaagt

SEQ ID NO: 4416 - DNA, 552 bp, Gossypium hirsutum
  Clone ID: uC-gsronu33B150c12b1
taatttgtgagagaggctgttatgaaaatcctgaaacctgatcctaaacttgctgatttcattgaggccgagtgcagcaaagattcatggcaagggatcatcacacggttatggcctaatacaaaatatgtggatgtgattgtgactgggacaatgtcacagtacattcccacacttgattactacagcaatggcctccctctcgtctgcaccatgtatgcatccagtgaatgctattttggtgtcaaccttaaccctctttgcaagccaagtgaagtttcctacactctcgttcccacaatggcctactttgaattcttgcgggttcaaaggaacaatggcgtcactagttctatttctgtgcccaaaactctcaatgagaaagaacaacaagaattggttgaccttgctgatgttaaacttggccaagagtatgagctcgctgtcaccacttattcaggactttatcgttatagagttggggatgtgctaagggtagcagggtttaaaaacaacgcaccgcattcattttcaatgcaggaaaaatgtagt

SEQ ID NO: 4417 - DNA, 493 bp, Gossypium hirsutum
  Clone ID: uC-gsronu33B150d01b1
aaattttagcaaggaacaataagaaccctgcggctaaggaagtgtctataataactattattttgcctttgttctctttaagtttctggtaatgtttcaataaaattgcaagttttagaaaggccacattcgaaaacaaactactataatgtttatcattgtgattcaatttacaaacaaattaggtgttgatattgtgcatatttagttgagcttcgattttggctattctattcagcaatcgagttaatatagcaactaattggttattatggatgttccatttgctcagcgataaatttgtacggattttaagttgatttacatgaaattcaaggtccagtctctatatttgtaaatcctttcctcctttccccattgtagtgtacttattcacttgtgtaaaaaaaataattagttattatcgaagtaacatgatccttgtttagataaccgattgaaaatagttaaataatataaaattaatattttc

SEQ ID NO: 4418 - DNA, 523 bp, Gossypium hirsutum
  Clone ID: uC-gsronu33B150d02b1
gttgcttcttgaagacagcttttaatgccagagattttgatttggaaatgcaactacttgcgctcgagaatcatgctagccaattgcagcagcaacaattgatggatgagatatctagtctctcctctccatcttgttggactaaggaatacagtaggcttgaagatttaaagcctaccaaactcgatgatgcttttggatctctcgatccatctctgcaatctccgttgaagggactgtcaatagaatccgtaacacaaactcaatcacaatctcgccaaaacatgaaccaattccgtgcaagctacccaccgaacctttcatcatctccggtgaggaagccctcagcctttggttttgactcatctgctgctgtagctgcagcagtaatgaattccaggtcttcgggatttgcaaaacggagtcagagtcttatagaccgtggagcaatgaccggtcgtgctgggcttactacatctgctaactcaaaaactatgatgtcttcaatatttctgattggagc

SEQ ID NO: 4419 - DNA, 541 bp, Gossypium hirsutum
  Clone ID: uC-gsronu33B150d03b1
ccctctcgtccgccaaatctctctctttgtctgtcggataattccaatggagggtcttattccttttgtttatagagcaataatccgatacaaaaacggaagacagggccatcatgttttagcaacatggttcaatgactcaccttcagcttcttacatgagactcccaactggtgattctggtcggtttcaaacatctgatacacaacaactgtttcaatcagattgtgtcaatttttcaacctcttcgcctgtctcttctgccaccaccaccacttcctcttcacctctctgtcgtcgtttcatcacctctcgccgtgtcgtttcataattattacatcgaatgcagtgacatgtctgaaggaagctgaaggtgtgccacttacaatacatatggtgttttctttttctttttaatcaattcggtcgagggacggatccttaaacagtggagatattgtgtccggtgtgtccatgcttgattttatttcttgactctgaatccaatccaattcaatcgggttcacatggagtgtctatg

SEQ ID NO: 4420 - DNA, 512 bp, Gossypium hirsutum
  Clone ID: uC-gsronu33B150d04b1
aaatgattctcccagtttgttacttttctctttaatggacgtgactctctctttctgttcctttttctttgccgatctcctgcattctgaatctcaaattagctgattactgataggaaattatcaaatccgaggcaccatggaagcagacgacaagtttttgaacatgggtattctcatagttgccactctagtagtggccaaactcatatcgttcctcataatgcccagatctaagaggcaggtgccgccagtaatcaaaagctggcctgtaattggtgggctccttcgattcatgaaagggcccatcgtgatgatccgggaggagtacccaaagctcggcagtgttttcacgttgaacatgtttaacaagaagataactttcttgatcggacctgaggtttcagcacacttctttaaggcttcagaatcggacctcagccaacaggaagtttatcagttcaatgtgccgactttcggccctggtgtgtgtttgatgtggattactcaat

SEQ ID NO: 4421 - DNA, 66 bp, Gossypium hirsutum
  Clone ID: uC-gsronu33B150d05b1
ataaaaaaaaaaaaaaaaaaaaaaaagggggggttttttaaaaaattttttgggaaaaaaacacac

SEQ ID NO: 4422 - DNA, 493 bp, Gossypium hirsutum
  unsure (1)..(493): unsure at all n locations
  Clone ID: uC-gsronu33B150d07b1
ccttcgcgtccgcccacgcgtccgaaaaacccggggatacctgaagcttccttggcactatctcaaacccaacaaaccatgtcgctccaatgccaccgccattctcctactttcccttcttgctttagaccttgcaccaccccattatgtctactcatcaccacctcctcctcaccactactaagcaacggctttgaccgcaccaaggggaacaaaagagtgtgatccaataaagcgacagagaaagagagcagtgagaggtcgcctagtctccgcgtttcaagagaagaaaaagaaaacaagaatgatgtagacaagtagtagggtcaataaaaaacaaggggttcatcgttttcacatttgtattattcagtggttctcgtatttcttgctgctttagtatacaatggtttcctagatttatggtgttttcttttccgacctttntgcaaatgcaggggtgatgggtttgatcttattaaaaaaagggttt

SEQ ID NO: 4423 - DNA, 85 bp, Gossypium hirsutum
  Clone ID: uC-gsronu33B150d08b1
tcttcgcgtccgcccacgcgtccgtttatttcttcatcatctctttggtttttaagattaggaaagataatatatgctttaattt

SEQ ID NO: 4424 - DNA, 473 bp, Gossypium hirsutum
  Clone ID: uC-gsronu33B150e01b1
ccctctcgtccgattttgtggtgttaaaatcttatgtgttcatagttttttgctgcaggcaacatgtcgctcacaattcctagccttctcagtggcccaagaaccgacatcttcgatccattttcagtatgggatctttcagatgaattcttcaactctgcattggcacacactatgacatcatcatcttcagtacgcgaagcttccgacattgccaacccaagggtagattggaaggaaacaccccaagctcgcgtgttcaaagcagaccttccagggctgaagaaagaggaggttcaagtggaggttgaagaagggagggttcttcagataagtggggagagaagcaaagagcatgatgagaagaacgataagtggcaccgcgttgagaggagcactgggaagttcttgaggaggtttaggttgcctgagaatgctaagatggaacatgctaaggctagcatggaaaatgg

SEQ ID NO: 4425 - DNA, 354 bp, Gossypium hirsutum
  Clone ID: uC-gsronu33B150e03b1
ctgttgctcgcgatgctattgctaaagccaacccagttgttcgggcagagatgctcgataaaatctgagaacaacccggatcaagatgaagatatgtggatggtttatgtaagttggttacttgtctcatcaagtgtccccttgattgatattaaatgttgggagtccatcatagggaatgttgggagtccatcatagggagggacatgatttgcattgtaagtctatattttcccctgtttgtaagtgtttttatttgtgcttgtttgatggacattgatatgatcaacttgtaatgcttcttctttgtggtatgcattttttttctactttttaagttgccttttaagtttg

SEQ ID NO: 4426 - DNA, 529 bp, Gossypium hirsutum
  Clone ID: uC-gsronu33B150e05b1
cgattatggaaagatcttggccatggatatcaacagagaaaactacgagttaggattgcctgtaatccgaaaagctggcgttgcacacaaaattgaattcaaagaaggccctgccatgcctgttcttgataaattggtggaagatgaaaagaatcatgggtcgtatgatttcatctttgtggatgctgataaagacaactacctcaactaccacaagaggctgatagagttggtgaaggttggtggtttgattggctacgacaacacactgtggaatgggtcggtggtggcaccgtccgatgctccacttaggaagtacgttaggtactacagagacttcgttttggaactcaacaaggctcttgctgttgaccccaggattgagatttgcatgctccctgttggtgatggaatcaccctttgccgtcgtgtcaaatgaaccaccaccgtcgtcgccgcccgcacagtcgcttctaccacccaagatggacaaacttataagtacttcaaaatttcataaatttttttt

SEQ ID NO: 4427 - DNA, 493 bp, Gossypium hirsutum
  Clone ID: uC-gsronu33B150e06b1
ccttcttgtccgcccacgcgtccgcccacgcgtccgggtgcctgcaattgcaagaactttgtgattgattattaagttgcaatacctttattttagcattctaagcattttcctcttattgcgttaacaaaccttgctgatatatattggacttgacagacttgagaatcgaaaagtccatatttattaaacctaaaacatttcacctgacggtgctcatgttgaagttgtggaacaaagaacgagttaatttagcaactgaggtattgaagagtatctccccaaaagtgatggatgccttggataatcgacctctgtttgtaagacttaagggtctggattgcatgaggggttctttggataaagcccgtgttgtctatgctcctggagaagaaattggcagtgaaaatcgactttcatgtgcctgtcaagttattattgatgctcttgttgaggctgggcttgttctagagcgagatatcagacatgaatt

SEQ ID NO: 4428 - DNA, 531 bp, Gossypium hirsutum
  unsure (1)..(531): unsure at all n locations
  Clone ID: uC-gsronu33B150e07b1
tttttcatcccacataacatcactcttctcccacccacccaaccactttcctttctatcccaccattttccctttttttttgttttctaaaacatggccaacacactacttcacaaacctctcattaccttcttcttctttttcttcttcagcttatttattcaaaccaagcaagataacccatgtccgtatccatgttacccaccaccaacaggaaccggcggcggcggcggcggcacagtgacacaaacacctccagctagttactcaccaccctcccaaacaggagtatatcctccacctacagggaacttaccatattactatccaccaccaccttatggtggaggtaattctttatatggtcagccccctcctgaccctatcttgccttatttcccatactactatagaaaacctccacaccaaacagatgatcagtcagcagcagcaacagtcggtcctggaaggtcaatactcattaccactgctaccacanatcttggtgtattaatattctagttatttcta

SEQ ID NO: 4429 - DNA, 478 bp, Gossypium hirsutum
  Clone ID: uC-gsronu33B150e08b1
ttttcgcgtccgcccacgcgtccgcccacgcggccgctggtatctctattctccatttttcattacttcctccattccctcacctctcagaaggaagaaaattatggatttcatgattcacaaagctcagccatatttcgcagtcactgatgagaagatgatgaatacgaataacccagaaagtgaacatggtcaacaaccaaacaacatcgtcaccagccaactccagataagatcctcacctcggtcatcccctgaagcgctggagaaagaggctgttcttagacgaatccgccatcacaagtgcaaaaacagagtcaaacgtgcttttcaggctttggttggcggcgacggacaagctcaagaaaaatggatggaactgggcgatgctttcacttgtccttaaacattctgtaaaaacccagaaattcatgggatctgtaaatggcttgaatgttactgatcatggatgatgatg

SEQ ID NO: 4430 - DNA, 439 bp, Gossypium hirsutum
  Clone ID: uC-gsronu33B150e10b1
ttaaaatcatttgaaggccaagttttgaagaaagattttaaatttacattcgagtcatggcctatataaaaaatttgcagcaaattaagaagaaggtgatgatgctgatgacgacttcgaggaattattaacctcctaggcaagtctaatgcttggctttttatcctccttttttttatttctttttcttttttggggtttttatcatgtttggttgctgagaaaatggaggaggatagatactatatgaataagatttcaaggctatgtatgtctttcagtaaccaaacagctcttcttctttttcttgatttggagttcttggatgctccgacattgtaagagaaaactttgtgaatgtgaagacattaaattacttttaacataaataaacccttcttttataatataactaattattttacttatctcataattg

SEQ ID NO: 4431 - DNA, 406 bp, Gossypium hirsutum
  Clone ID: uC-gsronu33B150e11b1
atgatacagcattgatctccagtggtttggctcccgacagccccgctgtgttaggtaacaagatatatgagatgatggcaatggcacttggaggaagatggggtagatatgaggacgatgatgaagtggaagcatcagaagttagtgctgctgaaactgatacgagtgccagtgaagcttcagagaaccaagtgatcgaaccatcggaagtaaggacagagagtgatccttggcaagattaaagtgtcgtgtaatttaaataaaaattttcctgtattatctgattgctattaacaaaataatccagaaggaaagaaaagttgtgggttcggtttgggaagatgaggaggttagtgataatggctgttcctatggtggattaaagctacttatacgtgatgaattt

SEQ ID NO: 4432 - DNA, 506 bp, Gossypium hirsutum
  Clone ID: uC-gsronu33B150e12b1
ttttcgcgtccgattgcttctctgcccgagctcaaaattaaaacaactaaagatcccaatgttacggacaacaaatcgggaggaaatggaatgactcagaaggtcagtggaagtacttcttcgaccattgatgttgctgaaccaagtaggaacacggacaaaggttcacttaatattgatggggacgacggtacagtaattgagaaaaccgttgtgatgcttgaatccattcccacggtaaattcatcagaagcaacgacactagaacagaaggagaacaatggcatctttaaaatcgggagggaaactgagatggtgtcagattatgctgccattcgtgcacctgtttcttcatcgaatcttgatgcagttgataaagaacatcagatacaaccaaaaccgcaggcttatgagattcaaaagggaaatgtaagtaacaccgacaaggaattgtcaaaatttacgagcacatgtgttactgaacaacagtatcaagcccctttagc

SEQ ID NO: 4433 - DNA, 172 bp, Gossypium hirsutum
  Clone ID: uC-gsronu33B150f01b1
ccctcgcttccgacaaaaaaaaaaaaaaaaaaaggggaaaattaaaaaaaattattaaaaaaaaaaaacaaaaaaaaaaaaaaaaaagacagtaatgatatgggggggccggtttaaggggtccaggtttccgcccccttgcttgggacgataaatcttttttttggggccc

SEQ ID NO: 4434 - DNA, 546 bp, Gossypium hirsutum
  unsure (1)..(546): unsure at all n locations
  Clone ID: uC-gsronu33B150f02b1
acctgtgttgcctcctaggaataaggagagtccaaacacagtattcagctccaacgctacaatattctcttgttttggcttaaatatcatatggctgtgggtaagcttgttttgttttctttgctccttcttgtggaggtattgctggtccatgcagtgggtgaggaatctgattttggggtgaatgtgaaaccacctgagattaaggtccataaggaggaccggcctggttgggcgattccaagagaagcagatgtgcctgttccaagtcctgcggagtcgtctcgagagaccagagaggctgaagcaccagggatcagacggctaggaaagcatgattcatcatcagatgatggctccatggctgctggtggtgtcatcattggtggacttgtcaccgtttttttcgcagcagtttttgcttacattcgagtcacaagaaaaaaagatgatgttcaagttcaacattgacccttttgttggtttcctttgctgcttttgagagtatgtttttttagattttcacatngnttttccctctctttg

SEQ ID NO: 4435 - DNA, 529 bp, Gossypium hirsutum
  Clone ID: uC-gsronu33B150f04b1
ctgttctctcgttcgacacaaagactgggaattgcacgaaatgctatgccggtttgtgcttctccaatgtggatctcattgcatcgttgactctgaacgaaaagggtgactctcttaacgcgtcatactatcatatagtgaatcccatgactaacactgctgttggcgccgaggtgacccatagcttctctaccaatgaaaacaccatcaccatcggtacacaacatgcattggatccattgacgatggttaaggcacgggtgaacaacgctgggaaggcaagcgcactaatccagcacgagtggcgccccagatccctcagtaccatatgtggggaggtggataccaagtccattgacaagagtgccaaggttggacttgctttggcactcaagccttgagctttataagagctctccatcttggaagagtacggcaaggtaagcttagaattttgaaatgaaatctgttgacactttttcatggcgttgccatagacacttatgtcaggggtccttttttctttttg

SEQ ID NO: 4436 - DNA, 404 bp, Gossypium hirsutum
  Clone ID: uC-gsronu33B150f05b1
ccctctcgtccgggtgagtgtgcgggtgagggatagtggagatttcagtggaatgtgcatagaagatctactcaatcacttccaggctgaaactgaggcttttcattaggatgatgcgactctatcaacttaacatgtggaacatcaagggggggattggctttttcccttgtattatttacatctctgctgcctcctgattggcttttagaacttgcaagcattttgtttggagaaattacacacatacattctgttttactttaaaccatcgtcttcccttcatctttttattggttaaataacattgttgttttacatttcttctgccctgataattctaaattttatatcaatccatggcactaatcacacacttgtacaacatgcctttattgattgcg

SEQ ID NO: 4437 - DNA, 304 bp, Gossypium hirsutum
  Clone ID: uC-gsronu33B150f07b1
tgtatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttgggggccccattttcagtccccggggacgcccatctaaaggttttttaagggggccccttaaatcaaagcccgggcgggggtttttccccgctggtgcggggaaaacccggggggtcccccactttaacccccttgagaaaacccccctttagcccggtggg

SEQ ID NO: 4438 - DNA, 475 bp, Gossypium hirsutum
  Clone ID: uC-gsronu33B150f09b1
ttctatcgcgtccgcccacgcgtccgcttcttcattttccaaagccaaaggccaaaaccctcctttcctctcctctcctctcctctacaaggaaatggcaatttcatcaacagcggcagccactgccgcttcttctaagcttagatacccacacgcctcccctttcccaactcactcctcaaccaccacctctgcctttttctcctcaattccctctaaactaacccctacccacctctcctcttccttcctccctcctttcctcactaccgtcgccaccacttccgtattccctcgccgtcgcggttctttcaccgtcaaagctgcccgtggcaaattcgaacgcaaaaagccccacgtcaacatcggcaccatcggccatgtcgaccacggcaaaaccaccttaactgccgctctaactatggccttagcctccatgggtaacagtgccccaaaaagtacgacgaaattgatg

SEQ ID NO: 4439 - DNA, 504 bp, Gossypium hirsutum
  unsure (1)..(504): unsure at all n locations
  Clone ID: uC-gsronu33B150f10b1
tcctcgcgtccgcccacgcgtccgaggaatgtatgattacctagcaagccatgctctcatttcagatgaaactgcaaatgggattgaaaaacactgtaatttcgcacccaaggatgactcggagtctagtagcgagtgtgatgcagccactgatgaggcaggccagaatatttactatgttgatatatataatatctatgcccctttatgccataattccagtctcacgatccgtcccaaggagccttccgtggcaaatttcgatccatgcagtgactactatgtatatgcttatctaaacagggttgatgttcaagaggccatgcatgccaatgtaacaaaacttgaccatgattgggaaccctgcagcgacatcatcagaagatggggagatagcccttcaacaatcattccccttctacaagagttaatggctaacggactaagagtgtggattttcagtggngatgcagatggaagaataccagttactttaacaaagta

SEQ ID NO: 4440 - DNA, 517 bp, Gossypium hirsutum
  Clone ID: uC-gsronu33B150f11b1
ttttgaacatggagcaccgtgaacggatcgggaacgggggttcaagcctctgccccatttcatctcctgatttgatcttgatggagttgaaagaagcaaaactgaaccttggggtgaaggtgaagccacagattgccaacaatgtgggtgctgccaatcatgggagttttgagaattgttccaacatcttaagatctccatttcacaacaactcgaagctcgagcagtttaagaaaacggttgatcctgcaaaaactgaagttccaagatcaacgccactaccagggaatgaagaaaataggccctgtcgcaggactgctcaaatgagatggattgcagccaagaagatggaggaagccgccagggcagctgaggcacttgctctaattgaaatgaatgcccttacgggaatgaagggtttgccaagcaatgccaactcatcaggattttccctgccggaaccagaacccgaaccgttgcttggaaccccgaatgttataagggcagaagaggtttc

SEQ ID NO: 4441 - DNA, 519 bp, Gossypium hirsutum
  Clone ID: uC-gsronu33B150g01b1
ccttatgttaatagagcgttcgtctcagatctcagaagatggtctgtaccaagcaaaccgcccgtaagtctactggtgggaaggctccaaggaagcaacttgctaccaaggctgcccgtaaatctgccccaaccaccggtggtgtgaagaagcctcatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgcgcgatccatgccaagcgtgtcacaattatgcccaaggacatccagttggctcgtaggatcaggggagagcgtgcttaatttccagaagtgtggatcagtcgcttagaagaactattgtttattttaggcaaatgattggttttggttt

SEQ ID NO: 4442 - DNA, 516 bp, Gossypium hirsutum
  Clone ID: uC-gsronu33B150g02b1
atttcgttgcccggaagtcctcttccagccatctttcattgggatggaagctgctggaatccatgaaactacctacaactctatcatgaagtgcgatgtggatatcaggaaggatctctatggtaacattgtgctcagtgggggttcaactatgttccctggtattgcggaccgcatgagcaaggagatcactgctcttgctccaagcagcatgaagattaaggtcgttgcgccaccagagagaaagtacagtgtctggattggaggatctatcttggcatcactcagcaccttccagcagatgtggatttccaagggtgagtatgatgagtccggtccatccattgtccacaggaagtgcttctaagttttgtaattgcttttgatggtgatctacattctgcatttagttggctctttttggtgtgccgtgtcaagtgaactcaaaagtctggtttactgtggggaaggtagcgatcattgtaggacggtgtacttgatattgacgtattatat

SEQ ID NO: 4443 - DNA, 404 bp, Gossypium hirsutum
  Clone ID: uC-gsronu33B150g03b1
atctagttatcaaaagttagtcgacttgtcatccaaaagattagcatgtttggattagcccattcaaagcttcaggttttgtactctcctcgagattatcgaagtggaggagctttggcttccgagtggaaagaagtaagcgtaagatcaagtacagaggtcatattccagcctcaaaattctaccaaagtctgcaaattcaagctttcttcgatcatgtctatgtcgctaagtgcctaagaatgcatccttggaatgaatcaaatttttgtgtggggattctttcaacaagtcctgaaagtgaatgtgaatattaaataaagagctagttgtacatttctgctataaaacatccaaaaactcaaaaaaaacccaaaaaaattactaagaaatattataagctg

SEQ ID NO: 4444 - DNA, 445 bp, Gossypium hirsutum
  Clone ID: uC-gsronu33B150g04b1
aaaaaaaaaaaaaaaaaaaaaaaaaaagagggaattattaaaaaaaaatttaaaaaaaaaacaaaaaaaaaaaaaaaaaaaaaaaggggcgggggttctagtttttccgggcccacggtcccgtcctggcgaagtcaaggttgtcttttggtgttgcggaaactcaatttaatggccggggttttacattttcatggctgggaatgccaaagccttgcccaccctaaacttcttggggccgatccccctttccctggcggccgttaacgcataggggcccgggccgaacgcgtttcccattggtaacggaggcttattggaaagggggacgggccctgtcctggaacatgatcttctgccggggggggggttgtgcacagcggtaccgtttcccttgcctgggccagagcccccgctcctgttgcttgggtttctctcctttttc

SEQ ID NO: 4445 - DNA, 394 bp, Gossypium hirsutum
  Clone ID: uC-gsronu33B150g05b1
ccctcttttccgcccacgcgtccggaacatccaggttttagggtatcctcttggaaagaattggcatcaggtgccacgtcggttatgttgcaaggtaaacaatactggtgatgaagcctttcagttgacggttgggcagtgtgaaaagggagctcttagttctttttctgattctctgtgaatgattgagtgatgctgttgagtatgtatattcaggcttcaagatgggacctcaagctatcttgtgcattatgccttttagctgcattgaagttttgggctgtgccttgagatcaaaatctggcttttttcttatttcttacctcctatatcaactattggagtggtttgttgtccacactacacagctgatagagttgaagattcaggttgc

SEQ ID NO: 4446 - DNA, 519 bp, Gossypium hirsutum
  Clone ID: uC-gsronu33B150g06b1
cgtttgtataaatttagatgaagacgttaatgcattggtgtggatggatagaaaactttgcctacggtttgggtttttgagagacatctgaaactgagaaggaacagagatttttattacagagagattaaaaaaaaaaaagaaaaaagaaaaaagagaagagagtgaaaggtcaaactttatcaatggcgtgggtcaacggttgataaccctctttctctcctttttttttttaaatctctaaattctctctctttctttagctatctttgaatttcatttgaagggttcttaaaaaaattatttgataaaaaagtagcttctttttattgggaattctggatattctttctcaagtttgctgagagagaaagaaatggcacaacgatctcatgtacccaagtttggcaattgggagggtgaagaagatgttccttacacagcttatcttgacaaggctcgtatgggctcgactcgagggaagattgtgaatccgaatgatccccaagagaatccaga

SEQ ID NO: 4447 - DNA, 535 bp, Gossypium hirsutum
  unsure (1)..(535): unsure at all n locations
  Clone ID: uC-gsronu33B150g07b1
ttttcaacctgaagatgcagtgtatgactttgaagacaagatcaactttgcagttttcccttcccttcagggtggtcctcacaatcaccagattggtgccctggctgttgccttgaaacagtccatgacacctgggttcaaggcatatgctaaacaagtgaaggccaatgcagttgcccttggaaagtacctgatgggcaagggataccagcttgttactggtggaactgagaaccaccttgttctttgggatctccgacctcttggattgactggcaacaaggttgagaagctctgtgacctctgcaacatcactgttaacaagaatgctgcttttggtgacagcagtgccttggctccgggaggtgtacgaattggtacacctgccatgacttcaaggngtttggctgagaaggactttgaacagatggtggcgccgcctgatgctccgctcaggaggtacgtcaggtattatagagactttgttttggactcaacaggctcttgctgttgaccctaggatgagatctgcatg

SEQ ID NO: 4448 - DNA, 492 bp, Gossypium hirsutum
  unsure (1)..(492): unsure at all n locations
  Clone ID: uC-gsronu33B150g08b1
tttttcgcgtgggttccggaatccctgaagaacatcttcgtaggagggttgtgatttattcgcctgcaagaactgcaactcaacaaggatctgggaaagttggaaagtggaagatcaatttcgtgtcgacacaaaagtgggagaacccattgatgggttggacatcaactggtgacccttatgctaatgttggtgattccgcactcggttttgatagtgaagaagctgcaaagtcttttgccgagagacatgggtgggattatgtggttaaaaagcgccagacaccagtgctgaagccaaagtcctatgccgataacttcaagtggaaaggacctgctgtatctgaaaagtgatactatactattgcagatcctgttgcttttgattttcaaccataaatcaagttgcgagacggnggctcaggatttctttgatgcacaatttctgctgtatcttgtgacaatttggattaaaataaatgtgatcaacagt

SEQ ID NO: 4449 - DNA, 570 bp, Gossypium hirsutum
  unsure (1)..(570): unsure at all n locations
  Clone ID: uC-gsronu33B150g09b1
gattaatgcaacagatgctatgaaggatgctcgcatccctgagtttcttgcatcgctaaatgcacttcaatacagacggatggactttgatgagttctgtgcagctgcattaactgttcatcagctggaggctcttgatcggtgggaacaacatgcacgttgtgcttacgaaatctttgagaaggaaggaaacagacctattgtcattgaagagctagcttcggaactcggactgagcccatccgtgcctgttcatgctgttcttcatgactggattaggcacactgatgggaagctaagttttctcggatttgtcaaattattgcacggtgtatctagctgaaccatcgcaaaagctcaatagaagccgtaaaacttcgtaagagctctaatgagctggtatggctaataaaaggatcaggtgaggtgtttgctaggctataacctgaatatgataaagaggtagagtgaattttgtcgtcgcaataatgcccctaccccaaccctttcgattatggcttatttcatttgtctagcacangcttatngaccccccctccccccaaaaac

SEQ ID NO: 4450 - DNA, 238 bp, Gossypium hirsutum
  Clone ID: uC-gsronu33B150g11b1
ttatttcttcctttttgccttttccgacccagcaaagcacatcgacaacggggagttgctccatgtctttgctggcctctcaccaccagtttccaattaaaatcatgcccatatcgacaagtaaaatccagtaaaatcaatgttacaaataataaactgagttctatactcgagatttgcgttcttgtattgtactactatgttatggttagtaataattttataattgtattgtacc

SEQ ID NO: 4451 - DNA, 540 bp, Gossypium hirsutum
  Clone ID: uC-gsronu33B150g12b1
attatcaccaaatgaagcaactcatccgccgtctgtcccgcgtcgccgacgtttccgcccagtacaacctcctccgctccgactcttcctcctcttcttccggtagccgccatcgttcttccgccgctagggctgaatctttccgtgtggcggttaaaaagacggtgcctcaaggttacgttccggtttacgtaggggaagagatggagcggttcgttgtgagtgcggagttgctgaatcacccggttttcgtcggcttgcttaataaatcggctcaggaatacgggtatgaacaaaaaggggtacttcatattccgtgtcacgtactggtttttgaaagggttatggaagcgttaagacttggggttgagtcacgtgacttacaggatctactccggtcattctccgatgactggttaaatgatttttagaccggtgaaacgacaaaaaacgatgtccgcttttttcatgtaaatatattatattaaagggaaaaaaagggaagaaattgtaggggttttttttttttttttttaattt

SEQ ID NO: 4452 - DNA, 474 bp, Gossypium hirsutum
  Clone ID: uC-gsronu33B150h09b1
ttttataagatcatacaagtcacttcactcctatcgggccctctctcacagcacacaccgcccaccatgtcggagccaatcgccaagccgcagaagcacgccaactcgtacctccacatcaccgacggcgaggagcgcatccgcacgctcattaccgagttcgcccagcaggtcgacgacccagaagacagggaatggacaaagtacctctttccctacctgaccgtccactccgtctcgcccgacggcccccgcccctcggtgacctttgcctttaccgtccagccgcagcactgcaaccgcctgcgcaacctgcacggcggctgcacggcctccctcttcgacttctgcacctcgaccccgctggccctcgtctcgcggtccgggttctggtcctttctgggcgtgaggccgaccctcaacacgacctacctgcgcccggtcccgtgcggcaccgagctgctggtcgagtgc

SEQ ID NO: 4453 - DNA, 540 bp, Gossypium hirsutum
  Clone ID: uC-gsronu33B150h10b1
gccttggcgtatgcatattctcaccagctatggaaggatgcaatgaaatcaccttacacaggtgtacccaacattcggtccggtgtattcccatggtggtggaactggttagaacgtcgattaccaccaaccgatttacccgaaaaccaagccacaaagaccttccaatttacaccaacaatgccaaactccgaattaaagcctagtccgaggccacaatccagtcagttcacattcgacaacatcattgacatccctacaccgaaatcgacaaggtccaccattctccccaccacaaggccaatgcaaacaccaacaccaccgagtaaacttgtgccgcatgcaaccaactcagggttattaaactcaaagcattcacgaccccgacctaccataatcgattcaccatcgaacttaccactcaaagatgacgacagcctcacatgttgcccaccgttttcggtcccgaactacatgacaccaacagtttcagctaaagccaaagcgagagccaatggcaacatgaaagagaggttcatg

SEQ ID NO: 4454 - DNA, 580 bp, Gossypium hirsutum
  unsure (1)..(580): unsure at all n locations
  Clone ID: uC-gsronu33B150h11b1
ttatttggtggcaaaatgttactttgctaagcgcaggcttttatgggaagtgcttgatggtggtctcaagaacaaaattgaaattcaatggtcagatattgtagctatcaaggcaaattatcctgatgatgttccagggaccttagatgtagtggtaataatcaaacttatgccataagctcttctctctacatacttggtaatataggaataagctgcttcaaattatacttcctggcaaatcgtgttcatataacttctgatgcgttaatgatttatcatgccatgatgtgctgcattgtcagctctacttaaatcttctcttctgatcactgtgaatattttgatgtaatatttattttagatgcaatttttgtttgctacagttggcaagacagccacttttctttaaggagacatatccacaacctaggaagcatactctgtggcaagcaacctcagattttaccggtggacaagcaagcgtacacaggtactactgttgacctttaacttaacaatcagttaaagaaggattnaaataagcattaaaattgaaatattaaaaatttattattgg

SEQ ID NO: 4455 - DNA, 574 bp, Gossypium hirsutum
  Clone ID: uC-gsronu33B150h12b1
ttctcgcgtccgcccacgcgtccgcccacgcgtgcgctttgatgcctacatgaccaaagcccagcttatgccaaaaatggccaatcaagtcgttagagatgtaaaacttgttgagggtagtggttgggattccgagggttcggttagacaatggtattttgttgccggaggtaagcttgagacttgtaaggaaatgatggaaaaggtgaatgataaagacaggactattgtttacaaattggtggaaggtgaaatcatgaaagctttcaaaagctggaactccatcctcaacgtgatgccgataggggagggaagtttggtgaaatggactatggaatttgaaaagcaaaatgatgatgtccctgatcctgtcaagtacggcgagtttttaactacctgggctaagaatgtcgatacttaccttcttaatgtctaattaaataattaaggaaactacatatatgaataatttgatcatatgtcctcgtcttaaataaattatacaaataatcataataaacatgcatttaatattttataatagctgattaagcatttagcttagtggcaaccg

SEQ ID NO: 4456 - DNA, 233 bp, Gossypium hirsutum
  Clone ID: uC-gsronu33B153a01b2
cattgttattggccttatatgcataagatgaacatgtaaagatcatttggccttccatgattgcaatatcttgaatgttggcatgtgtttcgctttattgagtattcctctatagaactttgaattatcctagaaggtagctgagaaacacaaaaaggcagtggtgtatttcatttgctataaaattcttttctctttctattgaaaattgctatatatatatatattggttc

SEQ ID NO: 4457 - DNA, 370 bp, Gossypium hirsutum
  Clone ID: uC-gsronu33B153a02b2
cccacgcgtccggaatcatcttggggtgaggaatgctgcccaaaggaagcttttggatgagctcggtattcctcctgaagatgttcctgttgatcagttcgtcccactgagccgcatgctgtacaaggcaccttctgacggcaagtggggcgagcatgaacttgattacctcctattcattgtccgagatgttaacgttcatccaaaccctgatgaggtagcagaggctaaatacgtgaaccgtgaccaactgaaggagttactgcgtaaagctgatgctggtgaagatggtttgaaactgtcaccatggtttaaactcgtcgtggataattttttgttcaagtggggggatcatgttgagaaagggacc

SEQ ID NO: 4458 - DNA, 406 bp, Gossypium hirsutum
  Clone ID: uC-gsronu33B153a04b2
ccctcgcgtccgtgaagaaaccaaagaaagcacagagtctacagaagcagcagtagctgcagcagcagaagaagaagtaaaagcagaagccgaagccgaagccgccccagtggaagcacccaaagaggaagctgcaaaggaagaagaggaaccagctgaagctcaagctgagaagactactaccgagtaaaataagcttgtaagatggggagtcaatggaagcttgtgtagtgcgcttactgttagctaagtttgcatgttgaaatcaattagtttctattctagttgaataaggacgtgatagtattaaggtggatgaggcttgtgactggggcatggaaatgacccaccaattgtagcttgcctaatggctaaactaacatgcaaatgggattatggaaggaga

SEQ ID NO: 4459 - DNA, 539 bp, Gossypium hirsutum
  unsure (1)..(539): unsure at all n locations
  Clone ID: uC-gsronu33B153a05b2
cccacgcgtccgaatgacatggaaaaaactggcagatgtggcagcggagagaggagacaatatgttaacagtgtaactgattaatgaagtaattcgttttgggatagtggctctgctgcagttcccttctccattttggtggtattctttttcttttgccccctaacttcatttctattttatttttgttgtcaatctgatcaatgaagacatttaaaattcatggagtttgttagttcatgctgaagattaagaaccatctgtgaggaacgacttgtattttttttccttgtcactctttgttcttcctacaaaagaagtatcagacttttagtttgtattcatagtattacatgaaatttcattctttgagataaaattaggatcaaattattgaaactcatgtggctggatatctcaacatgccttggtttggtntgtttattcattactgttgctaaaattggacagacagacattcccgttgcaagtgtgcaagtttgtaacttatgctactcggatttagatgtgtatggatg

SEQ ID NO: 4460 - DNA, 379 bp, Gossypium hirsutum
  Clone ID: uC-gsronu33B153a06b2
cggttatgcggactttttctttcgcatgctacctttgattgttacagaacgttatgtgtaagtaatacatgcttggatttgtttacttggttatctttatggctgtcatattggtggtttgatgacatgactggctctttgctcattgctggtttattcatgtccttccattttatatattaatatggaattatggatattgggtttctatatttattttattatttttttctgtttttttttttttgtatattagattattttttatttacttttttatttatttattaatatattttttattattttttttagtgtgtgttttatttttttttatttaattttttttattcttttgttatttattacttattatttt

SEQ ID NO: 4461 - DNA, 360 bp, Gossypium hirsutum
  Clone ID: uC-gsronu33B153a07b2
ctttattccattctcttcgctctgcttatgctgccgcgtccagttaatctcaagatcattgatctgtatgtgggtttcgcagtcttcactgctctgatccaggtggtttacatggctagtgtgggatcatttcctttcaactcttttctttctggagtgctttcttgtgttgggactgctgtccttgctgtttgtcttcgcattcaggtgaacatggaaaacaaggaattcaaggatctaccacctgagagagctttggcagattttgtacttggcaacgtggtgctccatttggtgatcatgaatctccttggataaaacctataatttccaggtttttgccggatagcgttgtttttt

SEQ ID NO: 4462 - DNA, 81 bp, Gossypium hirsutum
  Clone ID: uC-gsronu33B153a09b2
taatagtataattatggtaactaaggaatatcgaattggcgaaggttgaaaatatcaataattattattattttattattt

SEQ ID NO: 4463 - DNA, 447 bp, Gossypium hirsutum
  Clone ID: uC-gsronu33B153b02b2
atttggtatccctgtgtttatagggaataaatcgaagatagcagatctgacattcctgtgcttacagcgaagcagatcaaagatttcagcatggcatccctgtttttatagggaacaagttgaagatagcagatttggcatccctgtgtttatagggaataaatcgaagatagcagatctgacattcctgtgcttatagcgaaacagatcaaagattttaacatggcatccctatgtttatagggaacaagttgaagatagtagatttggcatccctgtgtttatagggaataaatcgaagatagcagatctggcattcctgtgcttacagcgaagcaggtcgaagatttcagcatggcatccctgtgtttataaggaacaagttgaagatagcagatttggcatccctatgttatagggaacaaatcgaaaatagcagatctaaca

SEQ ID NO: 4464 - DNA, 421 bp, Gossypium hirsutum
  Clone ID: uC-gsronu33B153b03b2
gatttcatattgacatgcctgctggcccttcagaagttttggttattgctgacaaacttgccagtcctgtacatatagctgcagatttgctatcccaggctgagcatggacctgatagccaggttgttcttgtaatagctggtgagggtgtggatcttaaagctattgaggaggaaattagtaaacagtgcaatagccttccaaggggagattttgcttcaaaagcactaagccatagtttcactgtttttgctcgtgatatggttgaggcaatctccttctcaaatttatacgcgccagagcacctgatcataaatgtgaaggatgcgtagaagtgtgagggtttttgttgagaatgctggttccgtgttcctagggcagtggacaccagagagcgtgggagactatgcaagtgggtcca

SEQ ID NO: 4465 - DNA, 387 bp, Gossypium hirsutum
  Clone ID: uC-gsronu33B153b05b2
attgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaagggctataattatgtctctggctgtgtctt

SEQ ID NO: 4466 - DNA, 447 bp, Gossypium hirsutum
  Clone ID: uC-gsronu33B153b06b2
cccttgcgtccgcccacgcgtccgcccacgcgtccgcccacgcgtccgcagtagcaggctcgattcagatgctgaggtaacatatcccacatctcaaacatcatccatcaccagtgaaaatgttggtttaggtgaaactgcctcttctagttctagtcgtttcccaaattcaatgaatgctcagtcaagctttccaccaacatcaactgctgatctacaagaacagatgagaaatcaaatgaaagatccagccatgcggcagatgtttgcatcaatgatgaaaaacatgagtccggaaatgatggcaaacatgagcgagcaatttggaatgaagctttctcgggaagatgctgcaaaagctcaacaggctatgtcatccttatcacctgatgacttggatagaatgatgcgttgggttgataagatccaaagagggagccgaggtgc

SEQ ID NO: 4467 - DNA, 517 bp, Gossypium hirsutum
  Clone ID: uC-gsronu33B153b07b2
ccttaaccgtagaagataacggggactgatcccccaccaccccaaaaaaaaaaaaagaaacacaaagggaaaatcgagggagccggcttttacttccaataattcatcattctcctaatgctctctgtattcaagctggcaacaccctgtccttcctcttcttcttctcatctcagattttccataaaccctaaatctaaattcccgtttctatgaccaacaattctccaatccccatgctttaacacaaaattccttgtgagaacccctccccaaaatgatgattcctttaattgtttccacatgtattcaccttgttttcatcttcgcggctgtcagctgcgagaaagattctatttacgatatcctaaaggcccatgggctgcccatggggttgcttccgaagggtatatcccgatttgacatcgacgatacgggccgcttcgaggttcatttggatcaggcctgtaatgccaagtttgaaagcccagtgcattttgataccaatgtgtcgggt

SEQ ID NO: 4468 - DNA, 474 bp, Gossypium hirsutum
  Clone ID: uC-gsronu33B153b09b2
gttgcatctgtttccggtagtatattttcaaggctagtgatgggtgctgtttgtgaccttttgggacctcgttatggttgcgcatttttggtcatgttatcagctccaaccgtcttttgcatgtcgtttgtttcggacgctggagggtatatcgctgttcggttcatgatcggcttctccctagctacatttgtgtcttgccagtactggatgagcacgatgtttaatagcaagatcattgggctggtcaatggaactgcagccggatggggtaacatgggaggaggtgcaactcagttgttgatgcccttagtttatgacattattcgtcatgctggagcaactccattcactgcttggagaatcgctttcttcattcctggatgtcttcatatcatcatggggatcctggtcttaacacttggccaggacttgcccgatgggaacctaagcagtctacaaaagaaggttgat

SEQ ID NO: 4469 - DNA, 333 bp, Gossypium hirsutum
  Clone ID: uC-gsronu33B153b11b2
tccacgcgtccggcgatgacgatcctctcatccgtcaagttgtttccgatggtggtgtcgaggaggactccgatgaccatctccttaatgcggagcaccacttcacgctgttcaaatccaagtatgggaaaacctacgcatcccaggaggagcacgattaccgactgggagtcttcaaggctaacctgcgtcgggccaagcgtcatcaggtcctggaccccagtgccgtccatggcgtcacaaagttttcccgattaactctatccgagttccgccgccagtatctaggcttggaaaccgtcaagcttccagcagatgcttaaaaggctccta

SEQ ID NO: 4470 - DNA, 386 bp, Gossypium hirsutum
  Clone ID: uC-gsronu33B153b12b2
tcgataatgattttattctatatgtcatgaattatgaagagatttttacggcttctgggcggacctacacccatttggcgccttagccacccacgagatatgcactatgacccagaagctcgccacgaacccggaaaatgatattggcgccctgagtattcccaatggcacggttagaattcaagaaggcatcaaaccgacacatgcttggatggttcagagtgcgggcagaatgattgaaaatttcttctgagcatttttctgacatggatttggctttaatctagatgatgaacctagagttatactgcccttgggaaaagataggttgaacttttgaacccatccgaaagcgcaacatctgccagctgttgacgatatttcag

SEQ ID NO: 4471 - DNA, 494 bp, Gossypium hirsutum
  Clone ID: uC-gsronu33B153c01b2
cctacgcgtccgcccacgcgtccgggaaaatcggaactagcaaaggcactagctgcttactactttggctctgaagaagccatgatccgacttgatatgagtgagttcatggaaaggcacacggtgtccaagctgattggttcaccccctgggtatgttgggtacaccgagggtggtcagctaactgaggctgttaggaggcgaccatacaccgtagtactttttgatgagattgagaaagcccatcccgatgttttcaacatgatgcttcagatcctcgaggacggaaggctcacagatagtaaaggaagaactgtcgatttcaagaatacactcctgataatgacatcaaacgttggaagcagtgttatcgaaaagggtggacggcgaattgggtttgatctcgattatgatgagaaagacagtagttacaatagaataaagagcctggtgacagaagaactgaagcaatatttaaggccggaatttttgac

SEQ ID NO: 4472 - DNA, 491 bp, Gossypium hirsutum
  unsure (1)..(491): unsure at all n locations
  Clone ID: uC-gsronu33B153c02b2
cccacgcgtccgcccacgcgtccgaccaaattgggggcttgcaagtgctttatgaagatcaatggctcgatgttcctccggtgcctggtgccttggtggttaatgttggagatcttttacagcttataacaaatgacaagttcaaaagcgtggagcacagagttttggcaaaccgtgaaggaccaagagtatcagtggcaagttttttcaccacaggcttattaccaacttcaagggtttatggacccattaaagagctgctctctcaacacaatcctccactttacaggcaaaccacagttaaagactatgtttcctacatttatcaacatggtcttgacggaacttctccccttcatctctttaggctctgaaaaaattttcgcccctaaacttgtgagttgcagaagacataatggtgttcttagttacttatcattgcagctattatcngtttttgacgtggctcattttcatccactcttctggtg

SEQ ID NO: 4473 - DNA, 167 bp, Gossypium hirsutum
  Clone ID: uC-gsronu33B153c06b2
gcccagcgcgggcagtagttcggccagcggcagctcgtccgtgccgtgcgcgcaggcggcgatctcgggcgcgaagtcgcgccggcccacccggcgcagcgcggccaggatgtcgtcctcgccgatggggccgccgtcgctggcgcgccacagtttgtgcattacct

SEQ ID NO: 4474 - DNA, 420 bp, Gossypium hirsutum
  Clone ID: uC-gsronu33B153c07b2
gccataactcgccgagcaagccgagcgctacgaggagatggtcaagttcatggagaacgtcgtctccgccgtccccgctcccgacgaactctccgtcgaggaacgtaacctcctctctgtcgcctacaagaacgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaagcttgttccggctgctggaaatggggattccaaggtgttttatctgaaaatgaagggagattaccataggtacttggctgagttcaagactggcgatgacaggaaatctgctgccgagaa

SEQ ID NO: 4475 - DNA, 299 bp, Gossypium hirsutum
  Clone ID: uC-gsronu33B153c09b2
tttctttttacagagccctcatagctgagttcatagccactctcctcttcctctatgtcactgttgctaccgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgattttggcccgtaaagtatctctcatcagggctgtggcttacatggtgtcacagtgcttgggtgctatatgtggagtt

SEQ ID NO: 4476 - DNA, 437 bp, Gossypium hirsutum
  Clone ID: uC-gsronu33B153c11b2
cggtcgcgtgggcggacgcgtgggcaacatctttcccattttctctctctctccttaaaaccctaccgccaccatggcaatagcatgcctgccaaaactccgacttgccaccgccacagccgtctccgtttccaccttccttaagccactcagacatgggctccgatcattcggatcagcagctgcgttggagcttcctgacgaggatgtatactacgagtacgaacaagctcaccgggatcggcgctcagctcagccgaagattgacgtggatgggtcagcgacagacaggggagtccaatgggtacttataggagagcctggggtcaaacgacatgcttatgctgaaaggctttcgaagcttctagaagttccacatatttcaatgggtacccttcgtagacaagagcttaatccccactcttctctttacaaac

SEQ ID NO: 4477 - DNA, 360 bp, Gossypium hirsutum
  Clone ID: uC-gsronu33B153d05b2
gtttcttacattgttgatctcaagaaaggagaggttaccaaaggttagccgcttatttaagacctatccttattttccaattcggttcaatcctgcttttcttcttcttttatcttggttgggtttgtttatcttggttctattaatataattacaactttttaaattctaatgatggaatagagtctgaagtttgtgtcttttgtaatcacacatcgaatgtagaaatttcttgtggaatttgtatgtgcctgagctcttcaattatagtagttagttcctgaggtgtggttctccacagttttacatgaattggggttagaaccatctcccatatctctagttgcaatggtgtcacca

SEQ ID NO: 4478 - DNA, 373 bp, Gossypium hirsutum
  Clone ID: uC-gsronu33B153d06b2
cccacgcgtccgcccacgcgtccgctcagcggctgtggtgtcttctggctttcgattcaaatcccttttggaatcaattgaaaacaagcagccaacatggggaagacacgaggtatgggagctggacgtaagctgaggacccaccgaaggaggcaaaggtgggccgataagtcatacaaaaaatccaaccttggtaatgaatggaagaagccatttgctggttcttctcatgccaaaggcattgtccttgaaaagataggtattgaagctaagcaacctaactctgctatcagaaagtgtgctcgagttcaattgatcaagaatggaaaaaagattgccgcattcgttccaaacgaccgttggttaaattaca

SEQ ID NO: 4479 - DNA, 364 bp, Gossypium hirsutum
  Clone ID: uC-gsronu33B153d08b2
cccacgcgtccgctttaaatggctcataaattgtatgctgtagctagaattatcactgttcatgaattaggtggatttacttcgattctaaatctctcttttcttttttggctacacccacagttcgggtgaaaataaacaggtctgtgaaaagcttgctgtttgataatgcctgaatcttcgattgagaacttcataaattgcccatgccgctaaaatgagttctgaccagagattttgtaggatatcctgtaaaaaattttaatgtgcatgagattttcttgtggagcttataaaaaataaatttatactattttcaatttttatattttattatataataaattaattatttattaataag

SEQ ID NO: 4480 - DNA, 209 bp, Gossypium hirsutum
  Clone ID: uC-gsronu33B153d09b2
tctacgcgtccgatttgagtaccctgcttgaataagaccaggaggacctcatttgaagaatgtgaccgaagtttttctacaattgtctgaatataccacccactctcaatagtgttaaaaaagaaagattgaaacttaataatagcccttaaatgtgtgcttataggtatcttgacactaaggcaataataattattatatttttgatg

SEQ ID NO: 4481 - DNA, 356 bp, Gossypium hirsutum
  Clone ID: uC-gsronu33B153d10b2
tttgccatagagccttgaataaatatgtttttgcggggatattgaagaagtattgtggggtgtgccctaagaattaatagagataataatttaaggtgggattatttttgacattattgttttttgttgggggtgggatggcgggttttatgttctggcatgtccttgctgctccgtcggttgtttcccgggggggggccgttcggggggtcctgtgtcgcccccgcggggtcggcggtgttttttcttttttggggggccgcttgttgtcctgcccgggcccgcgttgttcccgcgcggcgggggggggccccgggggttcccgccttttttggctggggggggccccccttttt

SEQ ID NO: 4482 - DNA, 405 bp, Gossypium hirsutum
  Clone ID: uC-gsronu33B153d11b2
ctccgttgtgatgtcactggcaagattcttatgaagtgcttcctctctggaatgcctgatctgaaattgggcttgaatgataaaattgggcttgagaaagaatcacaaatgaaatcccgtcctgctaaaagtggcaagactattgagctggatgatgttacttttcatcaatgtgtaaatcttacaagattcaactctgaaaagactgttagttttgtgccaccagatggtgaatttgaattaatgaagtaccgtatcactgagggagttaatcttccttttcgggtattaccaacaatcaaggaacttggtcgaacacggatggaagtaaatgttaaggttaaaagtgtctttggagcaaaaatgtttgctttggagttgttgtcaaaattcctggcccttaac

SEQ ID NO: 4483 - DNA, 410 bp, Gossypium hirsutum
  Clone ID: uC-gsronu33B153d12b2
tctttatggggtcacctttaatgccgtttattgctctcgcttggatcgggctagatccatggctctctccgtttgtcaggagatgaattttgcagtgtcagagatacaatcctctgatgcacttatggatctgaacatgggccattgggaggggtgccctcgatcagaaatatatacgcctgaagttttgagtctgatggaaagatatcagcctgatttttctgcaccttctggagaatctcttaggcaactggaatttcgaatggttcaattcttgaatgggactgtccttgggcttcctgaaaaatttagatctgaattttctttacaccaaaatgagagtcaaggatttacacaccataacaaccctgctttagccaactcaattcatgacagagatgtagcttctt

SEQ ID NO: 4484 - DNA, 303 bp, Gossypium hirsutum
  Clone ID: uC-gsronu33B153e02b2
gttagtgctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcattcccccagaccagcaac

SEQ ID NO: 4485 - DNA, 327 bp, Gossypium hirsutum
  Clone ID: uC-gsronu33B153e03b2
cccacttttccgcggacgcgtgggcggagatgcttttatcatatataatcatgattcttagattcgatcatgttttcagatgagataatcgctattgttgtcttaggttacggttcaaggttaagatctaatcatgctttcagatataaacttttaatgctcattttggggctgagcttttattttttattatttttttcttttttaacgttgatttggggaatacctctgttttcctatgtatgttgaaagaaacttctcatgtgattcttttatcgaaaatgcccttctgtattacttttcaaaaaataatctccattataatac

SEQ ID NO: 4486 - DNA, 415 bp, Gossypium hirsutum
  Clone ID: uC-gsronu33B153e04b2
cggacgcttgggtgaaattagtgggatatatgtgaaagtgagcatggacggggctccttatcttagaaagatagatttgaaggtgtttaaagggtacccagaattgcttaaggccttggaagagatgtttaagttcaaagctggtgaatattcagagagggaaggatataatggatcagaatttgtacccacttatgaagataaagatggtgattggatgttggtcggagatgtaccatgggagatgttcaccaattcttgcaaaaagctgaagatcatgaaaggatcagaagcaagaggcttgggttgtgtttgaaaaaaaatagtcctttagcttagggtatacaaagaagaaattacgatcccatttttctttttttcctttgttggataagcaacaaagaaggattaattt

SEQ ID NO: 4487 - DNA, 454 bp, Gossypium hirsutum
  Clone ID: uC-gsronu33B153e05b2
attggtatacttcaaagctcatctgtcaacccagagccccttctctccgccgaatctcctttttctcccgtaaaaatgtctctggtggccaacgaagattttcagcacattttgcgtgtcctgaacaccaacgttgatggaaagcagaagattatgtttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgcatgaagttgagagatgacttggagcgcttgaagaagatcaggaaccaccgtggtctgaggcactactg

SEQ ID NO: 4488 - DNA, 558 bp, Gossypium hirsutum
  unsure (1)..(558): unsure at all n locations
  Clone ID: uC-gsronu33B153e06b2
agatattctaaagaaaacaaggaaggcagtcgacgatctgagccgtggtatcgtcaataaacttctccacggtccaatgcagcacctgagatgtgatggtaatgatggtcgaacccttaacgaggcccttgagaacatgaatgcgcttaacagaatgtttgggctggagtcagatttgtcacttgttgaacagaaaattagagccaaggtagaacaaagccaaaagtaggaattgaatacagaatctctcaccctacaatcaactacacttccttgcaatcgaataagtggtcagttgtaacgtagtagctaatcaatttgaggtccttgtgggggcatctttcaattcattaattggtgtaaaacaccattgcttgactctgatttggcttcaccatttctacaatggtttnttagaggtctttcggctatgtagattgcagcatgaggtaagcttgaaccctgtatgggttcatcagtagaattttattgatattaaggggaacaatattaatcattggtaataaattactacttatttatagtgctgggattttt

SEQ ID NO: 4489 - DNA, 265 bp, Gossypium hirsutum
  Clone ID: uC-gsronu33B153e07b2
tcccacgcgtccgggaatttcaggtacattgagaccatcaaagaagctgtagaaagggaatgtcctggagttgtttcttgtgctgatatccttgttctgtctgctagagaaggcatcgtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgaca

SEQ ID NO: 4490 - DNA, 410 bp, Gossypium hirsutum
  Clone ID: uC-gsronu33B153e10b2
tggatgtcctccccaagagtgactaacgaggctgttcaaaaggctgctgctgctttgaagggctctgatcaccgtcgtgcaactaatgttagtgctagactcgatgcccagcagaaaaagcttaaccttccaatcctccccaccacaaccattggatccttccctcaaaccttggagctcaggagagttcgtcgtgaattcaaggctaacaagatctctgaggatgattacattaaagccattaaggaggaaattaagaaggttgttgaccttcaggaagagcttgacattgatgtcttggttcatggagagcctgagagaaacgatatggttgagtactttggtgagcagttgtctggttttgcattcactggtaatggatgggtgcaatcttacggatctcgatgtgt

SEQ ID NO: 4491 - DNA, 428 bp, Gossypium hirsutum
  Clone ID: uC-gsronu33B153e11b2
gattttctgggttttttccccccgttatttttagtatcagcattgtctttttttcttctttagttttgccttgttgaaagctcaagttcgaagaaatggctgagcgtgctctcactcgcgtccacagtctccgtgagcgtttggattccacacttaccgcccacaggaacgagattttggctttgctctcaaggattgaaggtaaaggaaaaggaatccttcttcaccatcaaatcattcttgagtttgaagctatccctgaagagaaccgaaagaaattagctgatggtgcattttttgaaatactgaaagccagtcaggaagccatcgtgttgccgccgtgggtggcgctggccgtccgaccaagacctggtgtttgggagtacattagagttaatgttcatgctcttgttgttgaaagactcact

SEQ ID NO: 4492 - DNA, 482 bp, Gossypium hirsutum
  unsure (1)..(482): unsure at all n locations
  Clone ID: uC-gsronu33B153f01b2
gcctgttgtgaagcctccgccatatgcacccaaactgccggttgtgaagcctccgccatatacacccaagccaccttactatccaataccgccggtcatctcaccaccaacactgcctccaaagccaccagtctaccccagtccaccaatagtgaaccctccaccatatacacccaaaccgccggttgtgaagcctccgccatatacacccaagccaccttactatccaataccgccggtcatatcaccaccaacactgcctncaaagccaccagtctaccccagtccaccaatagtgaacccaccaacaccgccgattctgccacctcctattgtgaatccaccaacaccgccgattctaccaccaccatcaccacctattgtgaacccaccaacgcctcctatcgtgaagccaccttcaccgggaacaccgtgttctncaccaccaccttcggcacaacaaacatgccccatagacactc

SEQ ID NO: 4493 - DNA, 475 bp, Gossypium hirsutum
  Clone ID: uC-gsronu33B153f02b2
gtttggtcttcctattgatttgagaggtaaaagagcatttatagctggtgttgctgatgacaatggatatggttgggcaatagcaaaatctcttgctgctgctggagctgaaattcttgttggaacatgggtgcctgcactcaacatattcgagagcagtctaagacgtgggaaatttgatgaatcacgcgtattgccagatgggtcattaatggagatcaccaaagtttatcccatggatgctgtttatgactctcccgaggatgtacctgtagatgtgaaaacaaacaaacgttacgccgggtcttcaaactggacagttcaggagcttgttgaatgtgtgaaaaaggattttggcagcattgacattcttgttcactcccttgcaaatggaccagaggtaagcaaaccttctttagagacatcaagaaatggatatcttgctgcctatctgcataaagttactcctatattt

SEQ ID NO: 4494 - DNA, 487 bp, Gossypium hirsutum
  Clone ID: uC-gsronu33B153f03b2
ggcgatttgatcgtcaaatttcaattgataaacctgacattaaaggccgtgagcagatatttctggtctacttgagaaagataaagcttgatcatgagccatcatattactctcaaagacttgcagctcttacccctggctttgccggagctgacattgctaatgtttgtaatgaagctgctctaattgctgcaaggagtgaaagggcacagatcacaatggaccattttgaggccgctatagacaggattattggtggtcttgagaagaagaacagggtaataagtaaacttgaaaggaaaacggttgcttatcatgaatcaggtcatgctgtttctggctggttcttggaacatgctgaacccctcttgaaagtaacaattgttcctcgtggtacagcagcacttggatttgctcagtatgttccgaatgaaaaccttctcatgacaaaagaacaacttttttgatatgacatgcatgacccttg

SEQ ID NO: 4495 - DNA, 373 bp, Gossypium hirsutum
  Clone ID: uC-gsronu33B153f04b2
ccttcgcttccggggttgcatgtaaatagtgtgttctctgttcttttcttttttttcaatgtgctattttgtctctgtctttgtctcttgatgctatttgatgtctcgagtaaccgtagaaggtgttttaagagctgacagctaaagctttagtttgcccttgtttttttgtaagtaatgttggccaagggtgcgctagcccacggtggctattgatgctttgtcattcaagctgccaccgtgagcggcggatatattacataaataaataaagagattaatggggtatgtgtaatgatgtgcataagtatgttattttaatttaatcaaagcattaataatatttaattaattttggggttcatctccattt

SEQ ID NO: 4496 - DNA, 407 bp, Gossypium hirsutum
  Clone ID: uC-gsronu33B153f05b2
ccttcgtttccggtttcttttagcttacagcttccattgtttttcagtagtgaagagctaaaaaagaagggaaaccaatggaggggaaagaagaagatgttagattgggagcgaacaagttctcagagaggcaacctattgggacagcagcccagtcccaagatgataaggattacactgagccacccccagcacccttgtttgagcccagtgagttgacttcatggtcgttttaccgagctggaatcgctgagttcgctgctactttcctattcttgtacatctcggtgttgactgtgatgggagtccttaaggacaaaaccaagtgtacaactgttgggattcaagggattgcttgagcttttggtggaatgatctttgctcttgtttactgcactgctgggatc

SEQ ID NO: 4497 - DNA, 67 bp, Gossypium hirsutum
  Clone ID: uC-gsronu33B153f06b2
ccctcgtgtccgaaaaaaaaaaaaaaaaaaaaaaaaaaggggaaaattaaaaaaaaatgggggttat

SEQ ID NO: 4498 - DNA, 329 bp, Gossypium hirsutum
  Clone ID: uC-gsronu33B153f10b2
tcccacgcgtccgcccacgcgtccgattgtactgaccttcgggttttctttttcctttatttctttttatgtgttgtgtttcgattggtatcttatagtcgtgtgatttctcaccaataatcatatattagtattgtttccaccaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaataattctataaaattaactataaaattataaataaaatctaaatggggttccctttttaaagatccctatttttcttccctc

SEQ ID NO: 4499 - DNA, 486 bp, Gossypium hirsutum
  unsure (1)..(486): unsure at all n locations
  Clone ID: uC-gsronu33B153f11b2
cggacgcgtgggcggacgcgtgggcaaagctcatgctgttgcacatgtgaccgataagatgatgcttaatgcttcaaacatcttccctcacaacactccgaccacgaaagaagcatactattataggatgatcttcgaaaggttcttccctcagaactcagcacgattgaccgtcccgggaggagcaagtgtagcatgcagcacggccaaagctgtcgaatgggatgccacttggaagaacaaccttgacccgtcgggcagagcagcacttggagtgcatctctcagcttacgacgcggagacacctttcgataacaagccgtccaagattgttgagtcaataccgttgatgatggagattcctggagttgccatacatggttaagtgccatgaaaattgaagcaaatgtgtgaaatntaatgattgattagtataatttgtgccatattatccatggaacttcagtatgctataatgtataatat

SEQ ID NO: 4500 - DNA, 190 bp, Gossypium hirsutum
  Clone ID: uC-gsronu33B153f12b2
cccacgcgtccgctagtcttagtaacttagaataagggttttttgttccttgtctgcgtcatgatgttagccaagactggtatggcccgactacggagtacatggctttgaaatggaatagatatactgatattagcactttcgttccagagtgcgcattttgtaattaagaatctgagcttgaagggtc

SEQ ID NO: 4501 - DNA, 455 bp, Gossypium hirsutum
  Clone ID: uC-gsronu33B153g01b2
caatcattgagttgttacacttagcactttttgtgggtctatgatacttggacttgtgtatatgtattggatatgggtatgttcatgtatttctggtgatatagttcttgcaacagcttatggacatgagctttctcgctatggacttgaagttggccttacaaattatgcagcagcttattgtgttggactccttttggctcgccgaacactgaagcaagctggagatggatgctgaatacgagggcaatgttggggtatgcatttgccctggtttctgaggtgtggagatggactcctattttttcatgctttttgattatataaacacccctgtttcaatgtctaatttgaagttatagaagcaataaacccatgtagtaaaagggaatgtagtaacccattttaagctaatttcaaggggttttttaattaaaaaaaaaaaaaaagggccg

SEQ ID NO: 4502 - DNA, 287 bp, Gossypium hirsutum
  Clone ID: uC-gsronu33B153g04b2
cccacgcgtccggaactttgcatcggggactgggttagggttaggccatcaatttcagtcccgactcaccactggggagaggtaactcactcgagcatcggggtagtgcatcgaacggaaaatggggacttatgggtggcattctgctttatggaaaggctatggctttgtaaggcttgcgagatggaaagggtcaggccatttaaagttggcgacaaggtgcggattcgagaggggcttgtaacgccaaggtggggatggggaatggagactcatgcccgcaaagg

SEQ ID NO: 4503 - DNA, 470 bp, Gossypium hirsutum
  Clone ID: uC-gsronu33B153g05b2
tttatttttttcagagcctccttcaccaacctccgctctgttcagcccgtgatcttttgatctttctccatggctaccatttccaagctcgctaaccccaacccagtcgcttctctttcattatctttcaaacccagatcttcttcatcgcttaaatgcttcgttgggttccctaccaggcctgctttcagctctaagctggtttcatcttctagcttgtcctcgataaacacccaccctttcaggggctccttggttgtcaggtgttctcttgctgatggaaacggtagttcagtgaagacgactactttgcatgatctgtatgaaaaagaagggcagagtccatggtatgacaacctttgcaggccagtgaccgatttgctgccactgattgcaagtggggttaggaggtgtaactagcaacccagcgattttccagaaagctatatcttcattaatgcttacaatga

SEQ ID NO: 4504 - DNA, 465 bp, Gossypium hirsutum
  Clone ID: uC-gsronu33B153g07b2
tttttgaaaagtggaaaggagcattttctgttgatgctgaaggaaccacagagaacgaattgcaagatggaagtcaggatttgctttctaattttgtggaatacattaagaatcataaatgtattcctttggaagatcttgctggagaattcaaattgagaacccaggtatatgatcttaatagctaagtaaaaccctttcatatgtgtactttcggcctcttgatatattgtaaaacccatcaacggaatgtgtgttgctgtttttttttaaatcccatccccgtttgcttatatttttaaagtacattgattgtttgatgcaggaatgtatcaataggatcaccttccttgaaagtatgggtatgtaaactatatctattatcaatttgggtactgactttaggaaatggataatcaaaatgcttggcatatacaatgtaatgatttatgtgatccttttttg

SEQ ID NO: 4505 - DNA, 473 bp, Gossypium hirsutum
  Clone ID: uC-gsronu33B153g08b2
atagtgacatttctgtggcgtcaagccatccatcaatggctgaggaggaggaagtggtggttttttcttggtatgtattagaggtctttctgttgtttctttttattggttttgtttttttttttttttttgttttatcttatttctcttttatctttttctgttccttatccttcttactctcaattttttctttttctctctttttttattttttttctcctatattttttctcttctcttttttaattctatttttattaatttatttttttcctcctttctttttctttttttatctcttttattttcattttatttatttcctcttcttatttttacttctacttcaattctatatttcttctctttattctttttatttttttttcttcattactcttcttctatattttttttatttatctcttatttttctatactctatatctttttctattttcttccctctt

SEQ ID NO: 4506 - DNA, 507 bp, Gossypium hirsutum
  Clone ID: uC-gsronu33B153g10b2
ctcatatttatttgcctttggatatgatgatgattgtcaagtgtttttactggctttgctggtaacagttggttttcttgaattcgtatttatatgattatttaaatttctgactgaattagtttcacaagtgaatcgggagaaattgtggaagtatttttccttaattaaaataaattagcactgtctttcgctctgggcttctctcgctcgctctctgcattctttcaaagctcacatatcctttatcttgaagctcaaatcattcctcgacaaaagatggaagaaaacaaggaaggatcctcaaaattggaagcccaggatgagactaggaagcgaccgtccattttcatcattggatgtcccaatgttggcaagcgcacccttgatctccggcttgcactgtggagttcgaagagaagaagagattgctccaagtggttgtccgtcgttgactatgaataccaaactacactgctgatgtctttctggatggctcatcttaag

SEQ ID NO: 4507 - DNA, 510 bp, Gossypium hirsutum
  Clone ID: uC-gsronu33B153g12b2
gtgtatttaacgctcacgccagtaacatcgttgctggaatctacatagctaccggccaagatccggctcaaaacgtcgagagctcgcattgcatcacgatgatggaagctgttaatgatggcaaggacctccacgtctctgtcacaatgccttccatcgaggttgggactgttggtggtggaactcagcttgcatctcaatcagcctgtttgaacttacttggagtgaagggtgcaagcaaagagacaccaggagcaaactctaggacgctggcaaccattgtagcgtctgctgttcttgccggggagctgtcgcttatgtctgcaatttcagcaggacaactagttaggagccatatgaagtacaataggtcaagtaaggatgtctccaaggcaacgtaatgataacctgatatttgggataaaagtggggaacttcccatgtaggaacatactaggagacaaatccctttggaataggtaaagccctaggcaatttctttatttattt

SEQ ID NO: 4508 - DNA, 497 bp, Gossypium hirsutum
  Clone ID: uC-gsronu33B153h01b2
ccctcgcgtccgcccacgcgtccgaaaaaaaaaaatgggggggtttaataaaaataaggggggaaaaaaaaaaaaataaaaataaatatttttaattggttttagtgttgtgatgtttatgagtttttaagtttttttttaaaaggggggggccgttttgggggtcccaggtttccgtccgcgggctggcgaggtaatagtttttttatgggggcccctaagtaaatttcaggggccggggttttcacaccgcgggctggggaaaccccgggggttccccaatttaatggcttggagggaaatccctttttccccggggggggtaatagggaaagggccgcgcccgttggccttttccaaaatttgccccccctgatgggggaaggggaccccccctttaggggccctttaaggccgggggggggggggggttccccgcaggggcccttttctttgccggggccttgggcccggttctttgggtttttcccttcttt

SEQ ID NO: 4509 - DNA, 124 bp, Gossypium hirsutum
  Clone ID: uC-gsronu33B153h02b2
cctatgctatcgcccacgcgtccgcccacgcgtacgcccacgcgttcgtggacgcgtgggtttgaagtcgggttttagtttttggggagaaaaaaaatgttgggagtatttagtagtgcgatag

SEQ ID NO: 4510 - DNA, 520 bp, Gossypium hirsutum
  Clone ID: uC-gsronu33B153h05b2
cggtcgtgtgggctttcaaaaaacttcccacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtttggtgtagattgtgtggtgacttatatctgtcagtttactcatttcttacttactttgtgatattgctatgcttatggtcttattatggtaatgttgttttctacttaatattataaatttaggtctttttttttttagatttatgtttttgatatttttattcattcattttcatattttttctatccctatattttttactttt

SEQ ID NO: 4511 - DNA, 497 bp, Gossypium hirsutum
  Clone ID: uC-gsronu33B153h06b2
ttttaattcactgagaaagtcatggaaggtttcaaggttgttcacctcattgcaatactatcaaccctttcgatggtttcggttaatggacagatttctacagcctgcactgcctcaatgatctccagtttcaccccatgcttaaattttattactgggagcagtgggaatggctcatcatcaccaacacaaggctgttgtggttcattgaagtcgcttatgagcactagcatggattgtgcttgtcttattattactgctagtgtaccttttcaattgcccataaatagaaccctggcactaagtctgcctcgagcttgtaacatggggtggtgtaccagttgcagtgtaaagcttttggcactcctctaccagctccaggccctgttccctttctacttccaccaactttggcaccagcagccgcatcttccttaagtccaggagcttccgaagcttaaacaccagaatctgatactcctctggacctagcacct

SEQ ID NO: 4512 - DNA, 451 bp, Gossypium hirsutum
  Clone ID: uC-gsronu33B153h07b2
gtatatgctacaacgaaatgccctcagcgtaatcgaagctcccaccggtaacgaagaagatgatgaccttgagttcgggaacatgcagtggaacggatcagacttggcatcggatgacactcaaaagtcccataggtcgagacataagtcgcataaatcgacggggtcttctcacaaaactacgagcaggtctctttcctgtgactcacagtctaagagttctgtttcgacaccccaggggtccacgaaagttgacctcagcaaactagagatggctgctttatggagatattggcgacacttcaatcttgtggatgccattcccaatccgtcgaaagaacaactagttgatattgttcaaaggctttcatgtcacagcaaatggatgagcttgaggtgattgtgggatttggtcaggctgcaaagagattgaagaccgtttgcaaatgaa

SEQ ID NO: 4513 - DNA, 523 bp, Gossypium hirsutum
  Clone ID: uC-gsronu33B153h12b2
cttgcatcaaagttggtccaaggttttgaaggttctgcagatgataaaaccttctcaatatctgattagttgcagtcaccaactaacccccgacagaattcaaaatgccacgagctagtgaatgacttccaggtatacacatggtctgctcgagcacttgcttccttaacttcacgctcgcgtagggaagaccgatttggagttgctcaactatctggtagcaatgctgctgccatctcaacactcatagcttgtttacttgctgttgaaacattgatggggaaaaaaataagcttacaaccatctcatcagttaatgggagcattcagcacgaaatcggctaccttcagtactggaagaagagatgttaggacaggaaaaaggagagatgacccactatattctaaagcatacgcaatggctgatgttttaaggacttcaatttacggcattgtgtctgctttccaccatgagatgctgactaagtgcaaagcaaggttttttcgagaggattggattacta

SEQ ID NO: 4514 - DNA, 513 bp, Gossypium hirsutum
  Clone ID: uC-gsronu33B154a03b2
gagctttttgcttgcactttatatgacagctgaagctgggaatccatatttcagattgggttataacagcttgggtgcatttgctacaatcaaccaccttcacttccaggcttactacttggctgtgccctttcccatagagaaagctccaacgaagaagataaccactttgtatgatgaagtgataatctcagagcttttaagctatccggtcaggggtcttgtctttgagggtggcaacactcttcaggccttgtctgacactgtctctgatgcctgcatttgccttcaagagaacaacataccatataatgtcctcatctccgattgtggaaagcggatctttctcgttccacagtgttatgctgagaaacaagctctcggggaagtgagtccagagcttctggatacccaggtgaacccagctgtgtgggaaattagtgggcatatggtgttaaaatggaggaaggactattatgaggcgtctgatgaaaatgcttggaggctcctggc

SEQ ID NO: 4515 - DNA, 51 bp, Gossypium hirsutum
  Clone ID: uC-gsronu33B154a04b2
cccacgcttccgaaaaaaaaaaaaaaaaaaaaaaaaaaggggaagggcttg

SEQ ID NO: 4516 - DNA, 308 bp, Gossypium hirsutum
  Clone ID: uC-gsronu33B154a06b2
ttcttgttatcctctctcatctgtcaaactaaaaccaaccggggaaccctaatacggctaccagggcctttcgccttagacgcgagctaagagaaatcctcagcatcattgcaccagtttatgaaaatggctgaacaggaaatcccaaggattcaagcacatgaaaggctagcactatcactaggcaaggagattactgaatacttccatgggaattcagcaaaggaagaaactcatccctttagaatcttcatgggggtgagggatttccttacggttctcgatcgagtctgtaaggaagtcgggac

SEQ ID NO: 4517 - DNA, 378 bp, Gossypium hirsutum
  Clone ID: uC-gsronu33B154a07b2
cccactcgtccgggcatctcaaatttcagagtcccatctccttcacaaactcgacattttcaagatccaaggcaaagataaacgcggccacaagattcttcgcattaccggaaagtccttccccgctcggtttttgagcgttgatgttttgaaagagtatttagatgagtatatatttccaaggctttcaaagaagccgttttcggtgttgtacatgcataccggagttcaaaggaccgacatctttccgggaatctcagccctccgatcaatctatgatgctattccggtcaccgtcaaagataatctccaatccgtttattttctgctccctgtcctacagtttcggcttttccttgccactttcgatccgacttt

SEQ ID NO: 4518 - DNA, 410 bp, Gossypium hirsutum
  Clone ID: uC-gsronu33B154a09b2
cccactcgtccgtccagtcgtcctctctctccaatgtgatcataaaccaaccctatctgagcacatgcacgtagcataattatgatacatgtctgacccgatcggcctacagtctttatgtgtagagctaactctggatcgagatgttgatggacactctgcaggagatgctatgaacacgtcgagaccaggagtgaccgatccagatcacataccagagagctgacagccgaaccttgtccatcctcagcattgaattgacatcacctgtaaccaaagtactcggagtgctcggggggatgcaggtaattctaacccgcttgcacgtaagacacctgcgctcgagaagctggggcatgagccgaacgtggagctttacgcaaatatgctccagggggccagcctaactg

SEQ ID NO: 4519 - DNA, 555 bp, Gossypium hirsutum
  Clone ID: uC-gsronu33B154a12b2
gtgatgtctccaagctttctagaggcctcgaaaacatgggtgacgtcctacggttaaacgaaacaatggggttggacgagagcaaagagaaattttcggaatcaatgaaccagtttatgaaaatggctgaacaggaaatcccaaggattcaagcacatgaaaggctagcactatcactagtcaaggagattactgaatacttccatgggaattcagcaaaggaagaaactcatccctttagaatcttcatggtggtgagggatttccttacggttctcgatcgagtctgtaaggaagtcgggacgataaacgaacgaaccattgttagttctgcgcataaatttccagtcccagtgaacccaatgatgcaacaaacattcccagttccagtaaatccaatgatgcaacaagcttttcctggatttcaagggaacccacactatgattctgatgatgacactgcaccatcctagtcttttgcagcttataatcaggtcaaatacgaactatgacacgtgatttttctatgtcagtcacgaatatttctagaaaaag

SEQ ID NO: 4520 - DNA, 536 bp, Gossypium hirsutum
  Clone ID: uC-gsronu33B154b02b2
cccactcttccgcccacgcgtccgggaaaggctaaaaaggcaaaggaagtagtggaagcagtagaccctgataagaatttggtcactttcagagtgatcgaaggagatctaatggaagagtataagagctttgtaatcacgattcaagtttcgcccaagagcgagggtagtggcagcgtagtgcactggactttggaatacgagaagctgcacggtgggattgcgcatcctgagactctgctgcaattcgttcaagatatctctaaagacattgacgcccacctcacccaagcaagctaaacagtatcacatgttgctattgttgccgctacttgaagcactgttcatctatttaatgaataaagtgacttcctttctcatgtattttgatctgaatatgtatgtttagatcaatatgcagtcaaggggagggagctttgtatttcctgcatgtttgtctttttaattctgtatgaattcaatgaatcctatgcctttatttgtgttctaatgaatataagtaagtatgatttcgt

SEQ ID NO: 4521 - DNA, 473 bp, Gossypium hirsutum
  Clone ID: uC-gsronu33B154b05b2
ccctcttctttcgcccacgcgtgcgtgcgtcatttgtcggaaaacttggagacgacgagtttggtcacatgctggccgatattctcaagcaaaacggtgtctccggtgacgggatcttgtttgaccaaggcgctagaactgctcttgccttcgttacgttacgcgccgacggagagcgtgagttcatgttctataggaatcctagcgccgatatgctgttgaagccggaggagttgaaccttgatcttatcagatcttccaaggtatttcactatggatcaataagtttgatcgtggagccatgcagatcagctcatttaaaggcaatggaagtagccaaaggagctggtgcattgctctcatatgatccaaaccttcgcttgccactttggccttcagctgatgaggctaggaaacagattttgtccatctgggataaggcagatattgtcaaggttagtgatgtcgagctc

SEQ ID NO: 4522 - DNA, 367 bp, Gossypium hirsutum
  Clone ID: uC-gsronu33B154b10b2
gtgaaatatagttgaagtgtctccttctctttcttatagatgtgatgtatgtctattaacaaaggatctttcggttgaaactcaaacatgggttgcaaatttttcacaaaattattgaaaatttttggttcagccatatccaatggatattgaaacttaataatcatttttgcaaaatccaagcgattccttttctgatcaaacattgagcttctttcatttgtggtagttgaatatatcaacttcctttcttgatttcgtatttttctttctagacatctttctcactgttttttcaagcgttccactcttgcttaaccctgttaacttcttatgactctggagataaacactagaggtgggattt

SEQ ID NO: 4523 - DNA, 488 bp, Gossypium hirsutum
  Clone ID: uC-gsronu33B154c01b2
ctttgttgaataaagtagattttttttttaatttgacggggaaaaaaaacaaacaaactatgaccatgggtgctgcagacaagagggaggaagtgattcaagcatggtacatggatgatagtgatgaagatcagaggcttccccatcaccgtgaacctaaggaatatgtatccttggataaactttctgagcttggagtactcagctggcgattggatgctgataactatgaaaatgatgaagagttgaagaaaattcgtgaagaacgaggttactcctacatggacttctgtgaggtttgccctgagaagcttccaaattatgaggagaagataaaaaatttctttgaagaacatcttcatactgatgaggagatccgttactgtgtggcaggaagtggttattttgatgtacgggatcacaatgataaatggattcgcgtgtgggtgaagaaaggaggcatgatagttttacctgctggaatttat

SEQ ID NO: 4524 - DNA, 527 bp, Gossypium hirsutum
  Clone ID: uC-gsronu33B154c02b2
ctaattcctccttcctaatggtcgattcatctccaccagatggtgttcttcaagcctggaggaatttcagcctcgagatatcctcttggcttcgatttcaacaaagcaaaaggaagtctacgacgtatttgcaaggtaagaccctcttttctttttttccttttttattagtataatcaatcaaaaaagaaagtaagtaagaaataaaagagaaaaataatgaataaaccaccttgccctattttctttctatttgattgctttctattgtgtaaaaaaaacacattccttctgtcttgggctttatagccgatgaaagaaaataaaaaaataaaaaaataccagtttttctattttctatttctatttgctgttgttcccttgtctgtttgcaggtacacggtgtgcgtggcgctcgtacagatgctgtgcgctggcgtacagagacgcagtggaggccgtacgtaagggagcagcgcgagagaaacccaagcttctgtttggccgaacctaggtctaggttttgg

SEQ ID NO: 4525 - DNA, 560 bp, Gossypium hirsutum
  Clone ID: uC-gsronu33B154c03b2
gccacttttgggatcatcccattcatttcacgacgatctttgggaatcatttcaggtctaacaggtgcaggtggaaacttcgggtccggactgacgcagctaatattcttctcaacctcaagattttccacagcggcaggtcttacttggatgggagtcatgatcgtggcttgcactcttcccgtgagcctggttcatttcccccagtggggtagcatgtttcttccgccttcaaaagatgaaaacaaatccaccgaagaacattactactcctcagagtggaacgaggacgaaaagaaacagggcaagcactccgcaagtctcaagtttgccgagaacagccggtctgagcgtggaaagcgcgtggactcagcaccaaccccgcccaatgcaacaccgtcccaggtttaacctatccaggcgtgaaacactagattttacaaattaatctttcttgttgaataatgggaagggttattgtaccgtgttgtattctgaatctgaacctttgccttttcatctcttttgcttcttgggaagcccttcttggttcatttttt

SEQ ID NO: 4526 - DNA, 455 bp, Gossypium hirsutum
  Clone ID: uC-gsronu33B154c06b2
ccgaaatgtaaagcttaggttctctgtctgctgcttcttgcttctcttatacttcattatgggtcctttttcttcttttttgtgaaaaaacattgaaactcttttcaagacgcaatagaagatgtgtggaggtgcaatcatttccgatttcattgccgtgaaacgcggtcggaagttaactgccgaggatctttggtctgaacttgacacattctccgacctgttgggtctggattacggaaatggaaaagagtctctctttcactcagttcgacaacaccaaggccggttccaaagcctagaaccttgataaagtggcacacgagacgactcataagacatgccgagggagagagaatgaagggaagactcagcgaactcgcacgaacattaacagaggaatcaggcttaggccatgggggtaacgggcgtctgagatatgagatcctcacaaa

SEQ ID NO: 4527 - DNA, 438 bp, Gossypium hirsutum
  Clone ID: uC-gsronu33B154c07b2
ctctaatgttaccccaccgtgccaatgcaaatgtgaaaatcggtggctacgacatccccaagggatcaaacgtgcatgttaacgtatgggcagtagcccgagatccagctgtgtggaaggaccctgaagagttccggccagaacggttcttagaggaggacgtggatatgaagggtcatgatttccgattgcttccatttggtgcagggaggagggtgtgccctggtgcacagctcgggatcaacctggtgacatccatgttgggtcacttgttgcaccactcttgttggacaactgcggagggtgtgaaggctgaggtaattgacttgcttgaaaaccctggtctggttgcttatatgcggtctccattgcaagctattgccaccttctggctgccttttaatctgtcatacgtgtggctgtggatatctaagtttt

SEQ ID NO: 4528 - DNA, 572 bp, Gossypium hirsutum
  Clone ID: uC-gsronu33B154c08b2
aaaaaaaaaaaaaaaaaaaaaaaaaaaaaaaaaaaaataaaaaaaaaaaaaaaaaaataaaggggggccgcctttaatggttcctacttttccttccgggggcgtccgttcgtagatggtccctttgtttatgtggccccctcgctttgcgcctgatttggccttttttttttctcccccttttttgctttacctgcccgggttttccccccttttggccggggaaacccccgcctttccccaccttttttcttttggaggagttccccctttcgccggctgtcttattacagatggggcccctccctgtcggtttcccccccttttgcgcttcctttttggcctctggggcttgccttttttccgggtcttttagcctggtggtttgggtggtttccccccgtctgcccgttttctttgcctgggttttttgcccctctcttttgttttttttccttttttttttatctcgtttgccgttttttcccttattttttttttttggtctcctctgggttccctttttttttttctggtcccgccccacttcttttttgtgtgtgttttctctt

SEQ ID NO: 4529 - DNA, 491 bp, Gossypium hirsutum
  Clone ID: uC-gsronu33B154c09b2
tgcttctattgtttcattgaccctactctttgccttgttgtattcactaaatttcttgtttttgatccacaaaatctcccataccttatcttcagtttcctggattctcctcctttttgatccacaaaatctcccataccttatcttcagtttcctggattctcctccaatcacttgcttctctcgtgtatcttgttttgattctaagctttgtttgcttacttgtgtgtctgttcatcacatcatctacatttccctccactgtttctctcttctatattttcccaagattattttctctttcctttttttccttcctattttttttctcgggaaaaaaagactttttttccggtatacccagatcttgtttagttccaagctttaggttgccatcgttttctcgaggctttaaactatgggtatctctttgatttgtgaagcatagggagaattattggttaaaactaagagcagtgtattgaatcaag

SEQ ID NO: 4530 - DNA, 485 bp, Gossypium hirsutum
  Clone ID: uC-gsronu33B154c10b2
agcatctctagctgcttgttcattgaaggatgtgctgggtatgctgagatcattgtatgccttgaattgtctggaagatggtgcgtatctccgatatgggtacctgtcagttgagaatgctgctacagtgaggagagaaataacaaaaatatgcagtgaacttcgaccgcatgcacttgctttggtcagttcctttggcattcctgatgctttccttagccctattgtttttaactggattgatgccaactcttggtcttcggctcaatattgatagggtgttgttaatctaccaactgcacctaacccaaagctttacacttttctaagcagtttataccccaacatactcaataaaaataaattctgttcatataatacatttatatttgttatttaggaagtgccccatgtatgtatacttttggtgcttgcttcttctattcatcataccgtatcatcaaaaggtttgaatgtataccata

SEQ ID NO: 4531 - DNA, 444 bp, Gossypium hirsutum
  unsure (1)..(444): unsure at all n locations
  Clone ID: uC-gsronu33B154c11b2
gctgtttccacttacgagctccagcggaaactcgtccaggctgccaccgcctgcgactgctctggtggtgtcacctcctctttctctgtcgttacccctaattctgccgttttccaggtggttattggaggtgctgtaggcggagccttcatcgggggtggaggtgctgctgctgctccggctggaggcgctgccgctgccgctgaagctcctgcagctgaggagaaaaaggaagagaaagaggagagtgatgacgatatgggattctctctctttgattaagctcctttactgccttactgcctgtttagatcttagcaagttgttacattttcatttttcatttatgcgtgaattagactattttgggtgacattgggcactnttcctagttaggagatgccatttttcaggatacatttgacaatattatgagtatgtttt

SEQ ID NO: 4532 - DNA, 532 bp, Gossypium hirsutum
  Clone ID: uC-gsronu33B154c12b2
ccctctcgtccgggaaacacagcccgtgccacgagtgggtgtagtgctgttcgtgttgggggggaaatcggtcctcctgggtcgccgccgcgcctcaatcggtgaatccacctttgctctccccggcggccacctcgagtttggtgagagcttcgaagagtgcggagccagagagttgatggaggagacgggcttggaaatggggaaagcagacttcttaacagtgaccaataaagtcttcctggacaaatccaaacactgccattacgtcatcgtctttctccgtgcagtgctggcggaccctaatcaagttccacaaaacccggagccagacaagtgcgacggctgggattggtatgactgggataatctgccccaacctctgttttcgacgcttgacgaaatggtacgaagtggcttcaacccctttccctccacttgacagctgctgaatgaatacgttttcttttcttatatattgcttgcgtataattgatccatgggttactttaatttcatcatgatgtattca

SEQ ID NO: 4533 - DNA, 526 bp, Gossypium hirsutum
  Clone ID: uC-gsronu33B154d01b2
cccatcttttccgcccacgcgtccggggttattgcctttgtttgacagtgcttaccagggatttgcaagtggtagcttagatgcagatgcacaacctgttcgcatgtttgttgcagatggcggggaatgctttatagctcaaagttatgcaaaaaacatgggactttatggggagcgtgttggtgctctcagcattgtctgtaaggcggctgatgttgcaagcagggttgagagccagttgaagcttctgattaggcctatgtattccaatccaccaattcatggtgcctcaattgcaatgactatcctcaaaaatagtgatatgtataacgagtggaagattgaactgaaagctatggcagaccgaattattagcatgcggaaacaactatttgatgctttaagtgctaaaggtactccaagtgactggagtcacattataaagcagattggaatgtttactttcacaggattggacagtgatcaagttgttttatgatcatgagtccacatctacatgacatct

SEQ ID NO: 4534 - DNA, 416 bp, Gossypium hirsutum
  Clone ID: uC-gsronu33B154d02b2
ttttgtttctggccaaaacaagaaaaaaaaattcccattttgccagaaacaaagagcttgtcaagaaagctccaagatatcaacaatggcagttgaaacaagctctgcaactccatctccagtcaaaacagtggttgttttggttcaagagaaccgttcctttgaccacatgttaggctggttcaaaactataaacccagaaatcgacggtgtcacaggctccgaatccaaccccattttcaccttcgaccccaacttcacccaaattaccttcaaggacaccgccggcttcgttgatcccgaccccgaccactttttccatgccatatacgaacaggtatccggcaaatcgtgggataccagcaacccggattcgaacccggggatataaatgaacggttttgtacatattgctt

SEQ ID NO: 4535 - DNA, 172 bp, Gossypium hirsutum
  Clone ID: uC-gsronu33B154d04b2
ccctcttcttccggagacgaggaagggcgtagtaagcgacgaaatgcttcggggagttgaaaataagcgtagatccggagattcccgaataggtcaacctttcgaactgctgctgaatccatgggcagacaagagacaacctggcgaactgaaacatcttagtagccggagg

SEQ ID NO: 4536 - DNA, 545 bp, Gossypium hirsutum
  Clone ID: uC-gsronu33B154d05b2
cgccttcttttcgctccctacttagctctctgtattgtgtttttgaatttgaacttttttgcactctcagattcagaaaaaatgaaggaaccctttaactcaattgcaacttcgagcaaaacccacttcgaggaaagtgaagaagaagaagagatcgaatcttcatccgaagaagagaaatccgatgacaccattgattctgatgaagaggaagagatagagcgtgaattagcagaagttacattcgaagagctacaaaaagcacgagccgatggtactgattcaatttctcgcaaaccccaaacagagaccaagcgtcgtcgcgctaacaagaataggccaatggagcttagtagcaaggagccagtaaggtcatttagacaggttattcaagctcctaaaaaggtggtacgagacccccgttttgaatctttatgtggtaatctcgacgtcgagggattcagaaaaagatataattttctgtttgagaacaacctaccagctgaaagagaggaggtgcagaaacaacttaaaaagccagagac

SEQ ID NO: 4537 - DNA, 494 bp, Gossypium hirsutum
  Clone ID: uC-gsronu33B154d07b2
ccctctcgtccgtgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaaggcgcaaaaataacaggcctctgtaatgatatattgtcaaggatggatgcctgcaaggtctataattatgtctctgtctgtgtcttgggtaatagaagctttgcttgtggtgaaaataatgtataagccatttggttgggagcatattgtccttttctccaaggatttttgctgctcattcat

SEQ ID NO: 4538 - DNA, 508 bp, Gossypium hirsutum
  Clone ID: uC-gsronu33B154d09b2
ccctctcgtccgatttcaaactacctgcttttagctctccttttgaatcaatctccatttttggtttttcgtaaagtgaaaggatgttaggcattttcaagaaagaattaatgaatcctccaaaggagctgcatagcccagcttcactcacttcatcaaacaagcccaagcttcccaatcaaatcatcaaccatttcctttcttcaaatcccaacaatgctttctcaatggggttcggatcctcagcttgctttgcttatgctcccacagagaatcgtttccccagtcatcaaaggttgttttgtggagtggatgaaatatactgcatattcttgggggatttgaataatttgagcagcctgctaaagcagtatgggctgtcaaagggcaccaatgaagccatgtttatcatcgaagcatatcggaccctccgagaccgtggtccgtacccggctgaccaggtccttaaggatcttgaaggcagctatggacttgtggtgtatgatag

SEQ ID NO: 4539 - DNA, 596 bp, Gossypium hirsutum
  Clone ID: uC-gsronu33B154d10b2
ctttcttggccttttcctttccattatcgtgactgctgttctcgagctccgatggagtggtgtcagcattgaggacttatggcgtaacgagcagttttgggtcatcggtggcgtttcagcccatctctttgccgtcttccaaggtttccttaagatgcttgcgggcattgacaccaactttactgtcactgccaaagcagctgatgatgcagattttggtgagctctacattgtgaaatggactacacttctaatccctccaacaacactcctcctcgtcaacatggttggtgtcgttgccggattctccgatgccctcaacaaagggtacgaagcttggggaccactctttggcaaagtgttcttttccttctgggtcatcctccatctttatccattcctcaaaggtcttatgggacgccaaaacaggacaccaaccattgttgtcctttggtcagtgttgctggcttctgtcttctctcttggttgggttcggatcaacccgtttgtcagcaccgtcgattgcaccaccgtgtcacagagctgcatttccattgattgtgatgaaattatgtgttcctcagattgaaatcatg

SEQ ID NO: 4540 - DNA, 419 bp, Gossypium hirsutum
  Clone ID: uC-gsronu33B154d11b2
ctctttgcctgttgatatttctcattgagcaattatggtctcaagtcttaatccaagtgaccagtagaaggatagcttttctcattgaacttgtgttttcaaggatacccgtacaaatactctgagttccaaaagaagaaaagggttgctagctacaagatgtatcgtgttgaaggtaaggtcaaagggtcattgaggttgagctttaggtggctgaaagatacgttcacacaagctgtttatgggtggtggtgattgtagcagtttctgggctcttttgtttctagttgctcttataatttgtcttgcttgtatccaaggtatgtgtgaaaaagaaatttcaattttaaaaggaaggtttttgataaataatattaaaataatttacaaaattacttttcctaaacatacaataaccc

SEQ ID NO: 4541 - DNA, 435 bp, Gossypium hirsutum
  Clone ID: uC-gsronu33B154d12b2
gagatttcaactttccctctccttataatttcctcagagaaatatggaggaaaaagaaaaggttccagagaaaaaagcaatacacaaccttccacacgatcaaccagcactgatggatgggattatgatgatgaaggtgaagcaagtactgctgaagaatgaattccaattcggtgcagctgccacctccattgccacttgttcatcttaatttggtgctatcctacctgagcttctttttttattttaatttcttagtatttttttctttcttttttaaatataaaatattaatcttcttgaccttgtaagaccttttcttgaccttgtaagacccagtccagtatttccaactcttcttctccttccttgtctatccctcctgagctgtttgtaactttgaaatggtcaaatcatatgccaattccttttcta

SEQ ID NO: 4542 - DNA, 596 bp, Gossypium hirsutum
  Clone ID: uC-gsronu33B154e01b2
cggtctcttggggtgatttcttcatctctttaatttggatctataaaatttatatttctttattttctcatagcaataaaaccttgttcaaaaaaaaaaaaaaaaggcaataaaacccttcaatttttgttcccattaatcctaagatggctgtcaagtctcacataatctcaggatttaccataccattgaaacccactgcttcttcttcaagctcggggaatagtagcaccctctgtttagttaagaaaccactcacttcttccttcttcaatggcggagtagcttccctaaaacttacaaggttaaggagtgttcctggaagatctcattgttacagacaaagaggaggtgcccttggtacgcgcatgaacctttttgatcggtttgctagagttgttaagtcgtatgcaaatgcactcttaagttcctttgaagacccagagaaaattttagatcaagctgtgcttgaaatgaatgatgacttggtaaagatgagacaggccacagcgcaagtattagcattctaaatacggttggaaaataagtacaaagctgcacaacaggcttctgaagattggtcccgaaagcacagc

SEQ ID NO: 4543 - DNA, 570 bp, Gossypium hirsutum
  Clone ID: uC-gsronu33B154e04b2
ccctctcttccgctttgaactcaaagtcccagctaatatgagaatcatgggtgttgtcacttatgactatgagaatacctccccagtcgcccctgccaggcttttcaaggcctttactgttgaagctccgaaagtttggcccacggctgcaccaaatgcagtcaagagcattgaggttgaagctaatcctagctctggaagtatagtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaagtttgaggcagctgcaggtggaggaagtatttgcaagagctcaatgaaattctacactgttggcgataatgttatcactgaagacgaaatcaaggctctcattaaagggagtgaaggagtctacaagcctgttgaagctacctcttgctaatcccgagcctgcactaggatataagtgtttaattctatgctgctttaaagagggttgatttatgt

SEQ ID NO: 4544 - DNA, 348 bp, Gossypium hirsutum
  Clone ID: uC-gsronu33B154e05b2
ggcgattctaatttttggagggagatttagcacccaaatgtgcttgtaaaatcttgtatgattggtacttatagtgtcgttgatgttcgattcgacaagacagcggtaaccactgcataccgtatacataccagagttatctgtacaccacactgtagaggcccaatttagcctgggcccgaaacaaaactaaaaaataaaaaaatatatcagtctatgtaaaaaaaaaaaaaaaaaaaaaaaaaaaaaaaaaaaaaaaaaaaaaaaaaaaaaaaaaaaaaaaaattaaaaaaaaaagaaaaaaaaaaaaaaaaatatattataattggggcggccttttttttggtg

SEQ ID NO: 4545 - DNA, 600 bp, Gossypium hirsutum
  Clone ID: uC-gsronu33B154e06b2
cccacttcttccgaatcaattgaaagagagatcaactctgtgaatgataaccctttgatcgatgtttcaaggaacaaggcgctacatggtggcaacttccagggtaccccgattggagtgtcgatggacaatgctcgtttggctattgcagctattgggaaattaatgtttgcccaattctctgaacttgttaatgatttctacaacaatggtctcccatcaaacctctcgggtggtaggaacccaagtctggattatggtctcaaaggcgctgaaatagcaatggcttcctattgttctgatctccaataccttgctaatccggtcactagccacgttcaaagtgctgagcagcacaaccaagatgttaactccttgggactaatctcttcaaggaaaactgctgaggctgttgatattttaaagcttatgtcctctacatacttggtggcactttctcaagctattgatctgaggcatttggaagagaatttgaggagcacggtgaagaacaccgtgagccagatagctaagaaagtcctcactactggtgccaatggtgagcttcacccttcaaggttctgtgagaagatctactaa

SEQ ID NO: 4546 - DNA, 382 bp, Gossypium hirsutum
  Clone ID: uC-gsronu33B154e07b2
ccctctcgtccggtcacaattcggcatcaagaatcccaggacggttatcgtggtcactccgacgtatgtacgcactttccaagcgctgcatttgaccggtgtgatgcactctctaatgctggttccctacgatctggtttggatcgtggtggaagctggtggcgtcagcaacgaaacggcgtcgcttattgcgaaatcgggtttgaaaactatccacgtcggattcaatcaacggatgccgaattcctgggaagaacgacataaattagagtccaagatgcgtcttcgtgctctaagaattattagagagaagaaatcggatggaattgctatgtttgccgatgatagcattatgcatagtatggaactttttgatgagatc

SEQ ID NO: 4547 - DNA, 533 bp, Gossypium hirsutum
  Clone ID: uC-gsronu33B154e09b2
ccctctcgtccgtggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggagaagcatggcctacggaatgaccgaaaccgaaagttgcgagtaccgcagcgaagtatacttttccaacgagtcacactacaacgacggccgtggataccaccacgctggcaaaagtgaccaccctgtcaagggtctgctaaggaaaataaagggtggcatttcacgtaataaaagctgtagtgatagcgacagtggcagcgacagtgatgatgatggttacgggaagaagacggtcttcgtgagcaaggcaatatgatgaagacatatatgataataataatgataat

SEQ ID NO: 4548 - DNA, 557 bp, Gossypium hirsutum
  Clone ID: uC-gsronu33B154e11b2
ccctctcgtccgcccaaattgagcctgctaaaaagctggatatgaacaactatttgattggacaagagattctgtcattagctgaaacagatgttcccccagaagatcttgtcttccacaagttttatatgaacaaaatgaattcctcgaagaaaccaaagaagaagaggatcaataccgtcatggggccagcatcaaattcaggttgcaaatgcatcatcactaaaccaaaggggcagcaggggtaggagatggtggtctctcttttgagaggcttcagtaatctggtggtccagactcaaattatgtatttatattctaatttcacccgtggattgttgtgagtgcaatccttgccatcgcattggtatattagtttcattatttattttggtttattatgtcagtttctggcctcgggagccgaattggacatggttatagtttgctatcccaactgtgctgtgcttgcccaagatttctttcaattgactggacattgattgattatcagtaactgaaaacctagttgcctttaaatgaatggatatgactgc

SEQ ID NO: 4549 - DNA, 203 bp, Gossypium hirsutum
  unsure (1)..(203): unsure at all n locations
  Clone ID: uC-gsronu33B154f01b2
gctctctttcacctttaattgtgtcctgtcaatgtcgtgttgcaaaaatgtatgagaattttgcttatattgatgccactggaagtaaacaatcttcctcttatgattgcttaatggaattcttggctaccttaatcaaanatnaaaaattaaaaacttaataaaaataaaaaaaaaaaaaaaattaaaaaaaaatccattat

SEQ ID NO: 4550 - DNA, 477 bp, Gossypium hirsutum
  Clone ID: uC-gsronu33B154f03b2
acattattaaggagcaagttaagctactgtacaagcgactgagattcactgccttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctctggcgttcttgacaggtttgccgccatgggtattgacacccctggagtcgttgccctcctaggagctcacagtgtcggcagaactcact

SEQ ID NO: 4551 - DNA, 505 bp, Gossypium hirsutum
  unsure (1)..(505): unsure at all n locations
  Clone ID: uC-gsronu33B154f04b2
gcacattcagcaaatggtttaatcatcacaaagaaataggaaccaacacagtgaagaagaaagacaaaatacgtgcagaaaacgctcggcttcactccgccgtttccatcgccggattagctgcaggtttggcctcagtagccgccgcagggaactccgacggcggcggcgcaggctcgaaaatgagcatggcattggcatccgctactgaacttctagcatcccattgcatcgagttagctgagctagctggggctgatcacgaccgagttgcctcagttgtgaaatcagcagtggatattcaaagtgcaggtgatttgattacactcactgcagctgctgcaacagcattgagaggagaagcagctttgaaggcaagaataccaaaagaagcaaagaaaaattcagcaataagtccatatgcagaaactcaatggtctgatgctttgcatactcaaatgaaagaccaaaatcctncttgtcaaggtgaactattgcaacatac

SEQ ID NO: 4552 - DNA, 572 bp, Gossypium hirsutum
  Clone ID: uC-gsronu33B154f08b2
gtgttgttgatgaagtcaaggagttaattattattgccaaggagtatgtacttggtctgcagatggagctgaagcgaagagagatgaaagacaatccagtacgccagcaggagcttgctgcctacttcacccactgcaaccttcaactgcctcacctcagacttgctctgctgaatgcaatgaccatctgctataaggctaagaaccttgctacagcaggtaactttgcccggcgactactagaaacaaaccccacaaatgagaatcaagcaaagacagcaagacaagtgctccaagctgcagagaggaagatgacagatgcctctcagctgaactatgacttcagaaacccattcgtgacttgtggggcaacttatgtgccaatttaccgaggacagatggatgtatcctgcccatattgcactgctcgcttcgtccctagccgggatgggcaattgtgtgctgtatgtgatatcgctgctgtcggtgcagatgcatcaggactgctctgttctccttcacatattcgcaatcaaattcgatgattgcgctacttttgtctgagtcttgtt

SEQ ID NO: 4553 - DNA, 320 bp, Gossypium hirsutum
  Clone ID: uC-gsronu33B154f09b2
ctctttcatcaatccagcaaggagctttggagctgctgtgatttacaaccaagaaaaagcttgggatgatcaatggatattctgggttggacccttcattggtgctttcgttgcagccttttaccaccaatacatcctaagagcagcagccattaaagcccttggatctttcaggagcaatgcttaaaaacatttcaccttcattacaataagaaaacaatgatgtaataacaaatgaggaatgagagcaagtttatgtcttgtgggaggggttcccttttgcagtttattttctataccattgagaaggggggccattg

SEQ ID NO: 4554 - DNA, 470 bp, Gossypium hirsutum
  unsure (1)..(470): unsure at all n locations
  Clone ID: uC-gsronu33B154f12b2
gaactcaccaaatggtcgctttatagggcggcgatcggtgagttcattgccacccttgttgtcttgtatgtcacggtgttgactgtgatcgggtataaagtccaaaccgacccggtaaagaatactattgacccggattgtggtggtgttggtatacttggtattgcttgggcttttggtggcatgatctttatccttgtttactgcactgctggtatctctggaggacacatcaacccggcggtgacgtttggactgttcgtggggcggaaggtgtcactgatccgagccctgttgtacatggtggctcagtgcttgggtgcaatctgtgggtgtgggttggtgaaggctttccaaaagacttaccacttcccattggatttgccgtgttcatggttcaccttgccacaantcctatcactggcactggcatcaacccagcaaggagctttggagctgttgtgatttac

SEQ ID NO: 4555 - DNA, 533 bp, Gossypium hirsutum
  unsure (1)..(533): unsure at all n locations
  Clone ID: uC-gsronu33B154g01b2
cccactctttcggctcatttagttcaagagaacatttcggtggagcataaaaaaaagttgagaacatgggtgtccaagctgaaattgagttcccagtcattgagttccgttcagcagatttggagcggggaaccgatgggtggcaccgcttgtgcaagagggttcgagaggcttgtgagactttcggctgtttcgaggtggcgtataaaaaaatatcgacggaagttcgagaggagacatttgggttgatgaaagaattaattgaggtcccagtggaaaggaaacaaaagaacgctagtcccatgccttatcatggctgggttggaccatgcaatcaggtttctttgttgtatgaaggctttggacttggagatgcctncaactatgactctgttaaaagctttgctcaacttatgtggccagatggtcacccacgcttttgcaccaccatacatacaattggcactcaaataagagagttggataagttaatctggctaatgttaatcgatagttatggatcgggggagaaa

SEQ ID NO: 4556 - DNA, 359 bp, Gossypium hirsutum
  Clone ID: uC-gsronu33B154g03b2
attgccattggcgaagatggcattgaacatgatgctaagagtctgcctaaggagcccgatcctaaagctgaatccactgaagaagaaagcaccatcaccaaaacctcccaccgcgctatggtgggtgggacacaagaatgcgttgttctgcagtaggaactggcattccacaaacagaaccatgtttcatccatgttatagtttctactaagcccgattggcatgtatgattgtgtatggcagtggtagcctaaataaagcaaacatagctagcggtggtgtaagtttatcattaaccttggacttgttgatttgatgatgtattatgattggatgatgtaaaataccaaataatgttt

SEQ ID NO: 4557 - DNA, 533 bp, Gossypium hirsutum
  Clone ID: uC-gsronu33B154g04b2
acaggtttgccgccatgggtattgacacccctggagtcggtgccctcctaggagctcacagtgtcggcagaactcactgtgtgaagctggtgcatcgtttgtacccagaggttgaccctgccctcaaccccgaccatgttccacacatactccataaatgccctgatcagatcccagaccccaaggccgtccagtatgtgagaaacgaccgtgggacacccatggttttggataacaactactacaggaacatactggacaacaagggtttgctgattgtggatcaccaactggcgtacgacaaaaggaccagaccttatgtgaagaaaatggccaagagccaagactatttcttcaaggagttctcaagggccattactctcctctctgagaacaatcctctcactggtagcaagggtgagatcaggaagcaatgcaatcttgcaaacaagcttcactaaaatgcctcgccaaagagaaagccgagtgtggccgaataaaatgttggtttactcagtttcttttccaagaga

SEQ ID NO: 4558 - DNA, 502 bp, Gossypium hirsutum
  Clone ID: uC-gsronu33B154g06b2
ccctcttttccgcccacgcgtccgcccacgcgtccgcggtgatgtaaagtctaaaattcaagacaaggaaggcatcccaccagaccagcagcgtctcatcttcgccggcaaacagctcgaagatggccgtaccctggccgattataatatccagaaggaatccaccctccacctcgtcctccgtcttcgcgggggaatgcagatcttcgtgaaaaccttgaccggcaagaccatcaccttggaggtggagagttcggacaccatcgacaatgtaaaggcgaagattcaggacaaggaagggatcccgccagaccaacaacgtttgatctttgcagggaagcagctcgaggatgggaggaccttggctgattataacatccagatggaatcgacccttcaccttgctttgaggcttcgtggaggcatgcagattttcgttaagacattgactgggaaaacattcacaatggaggtggtaaagtcggatccaattgacattgtg

SEQ ID NO: 4559 - DNA, 192 bp, Gossypium hirsutum
  Clone ID: uC-gsronu33B154g07b2
aaaattaaaaataacaaggaaaagggacataaacaaatatctccactggaatgatggtactattactcttttctagtaatacggaaaagacaatatatacatgttaaactacatttacaattcggatttgatcttgttactttaaacaagaatattttggttatatttaatttttgatatgtttttattttt

SEQ ID NO: 4560 - DNA, 361 bp, Gossypium hirsutum
  Clone ID: uC-gsronu33B154g08b2
gctgatctctgttcagttcgctggaccattggcctcaagttctattagcaccagtgctaaattcgaggttcgaagccccaaacgtgtgcagatcaagtttcaagaaggcataattggaactccccagctgacagactccatagtgttaccagaaaatgtggaatttctaggacaaaaaattgatctcactcctattaagggcttgctgacctctgtgcaagacacagcttcatctgttgcaaagaccatttccagccaaccgccattgaagatcccattatcaaacagcaatgctgaatcatggttgcttacaacataccttgacgatgaactgcggatttcaaggggagatgctgggagt

SEQ ID NO: 4561 - DNA, 308 bp, Gossypium hirsutum
  Clone ID: uC-gsronu33B154g09b2
ggcatttccaacacttacccttggaaaaattaaccagcttttctgctcattttcccagagaaaacatgctgatgagcattctttaaaactcagaaccttgcactgtctttgcccgatgatttgagattcaagatccaaatcttataatggtgtactttgtgaccgcagattgatgtgctaagaaacagaatatgcatatcctacttgtcttcaatacaagaaccaataccatggttgtcagcttatgggttttaactttgaatgtcctcatttttcttctctttcttttgcaagtcccgtttctctca

SEQ ID NO: 4562 - DNA, 534 bp, Gossypium hirsutum
  Clone ID: uC-gsronu33B154g11b2
ccctcgcgtccggtttcttgcaaacttacatatcccacacagagaagacgatgaaggtggccaaacattcggattctgttttttggtgaatcagtatttaagggttttcgatcctttcatttgtcttcatcgtcgtcaaggttcggcccatgtctttggatgcaacaaaaagatcgaaatagttctgttctgttgtggggttactgagttttgtgttcgtttggagaaatcagattgtgagcaaaaaagaaagaaaagaggttttgggagattggtagaatggggacaagagaagtatatgaggaaaagctaaggaatggaaatttgcaccacgatccaaccatcaaccctggcttaggttccgctcgttgtcctcgttgcctctctctcttaaaccctgattgcgacaaagccgaatggacaattaattcagttttggaggatgccactgcagtgggatccctgtccttcagaatcacatcaagggacctaagtggctcccttttgaactgtgattcctctgctgttaatgtt

SEQ ID NO: 4563 - DNA, 402 bp, Gossypium hirsutum
  Clone ID: uC-gsronu33B154g12b2
aatcctccccccccttttctcatctatggcctgcgcggctaacgctatctctctttctgggtcttccaaccccaactccaaattgtcctctgacttcatccccaagcttaataggcccgtcaatgtttctcttcgcgcttccacttccgctgagttggatcccggacgactttttctctccagacccattggactcagtcgcaggatttgcgccaatgcaactccggtgatggatcagtcggttggtgaaaggagctcttcagtgcccactattgttgaggtggatttgggtaatcggagttacccgatctacatcggctccgggttgcttgatcagcatgagcttcttcaaagcaatgtcatgggaagaaagttcttgtggtaactaacactaccaatgct

SEQ ID NO: 4564 - DNA, 470 bp, Gossypium hirsutum
  Clone ID: uC-gsronu33B154h01b2
ggtttttgtagatgacaaagcaaagagacaacaagttgaagaaatctcctgaatctgatccttcttctgagaattctgattctgggtattttagaaatggaccaaagaaggtggaatcagatgattctgtcgatgggtttctcaagaacaatgagtttaagaagcctaatatagaatctggatctgggttcagagacagggatgcaacttatagcaagtgtttgagtaaattcaaaagtgtgaaaactggatctccaaagtatgatttaagaagaaatgggaagaatgattattacagtcctcaaaagggaagcaaatatgaatgtttaacctgtaacaagacctttgactcccatagggctcttggagggcatagagcaagccatacaaaggtgaatggctaccatgagtcaatacaggagagttatgaaaataacctgggcaatgattcttttacggctcccatgact

SEQ ID NO: 4565 - DNA, 555 bp, Gossypium hirsutum
  Clone ID: uC-gsronu33B154h02b2
tgctggtacacctgccggggccgctccggaattcctgggggaatatggtactttgcctgttattgcaacatcctttgacggctttcctttccccgggctcaattcttttcccttttcgtgttttattctttatctcatctttttttcctttgatttttctttttcgattttgtacgacttttaagatcaaatctatcatctcaataccttagtttgagatggcgacgtactttcatggaggctcagacttccaggctgcttcagctgatgggttgcaaacgctttatctcatgaacccgagctgctttccctacgctgacacacaccaacaaccatgggctgccactaacatgttcttgttaaaccccacaagcttaccccaagcaccaccgtctaaccatcatcagcgtttccttggtgtgcctctgccaacaccatccacctgcatcaaaccggtcaatttcgacgatccccaccgttcattcccccttcaaggtgtagtccccggttttcactctaacttatggggttcatgtgttgatcatcagaattccc

SEQ ID NO: 4566 - DNA, 468 bp, Gossypium hirsutum
  Clone ID: uC-gsronu33B154h03b2
cccacttctctcgccaacttccacacccatacgaaaatggcggcccgcttcaagaagaaccggggaagcgcggtcacgtcagcgctggtcacggacgtattggtaagcacaggaagcatcctggaggtcgtggaaacgccggaggcatgcaccaccacaggatcctctttgacaaatatcaccctgggtatttcggtaaagacagcatgaggtacttccacaagctccgcaacaagttttactgccccattgtcaacatcgacaagctctggtctctcgtcccacaagacgtgaaggcaaaagccaacaaggacgccgcgccgatgatcgacgtgacccagttcgggtactttaaggtccttggaaagggtgttttgcccgaggaccaaccgatcgtggttaaggctaagttggtgtccaagacagctgaaaagaagattaaagaggctggtggtgctgttgtgctca

SEQ ID NO: 4567 - DNA, 442 bp, Gossypium hirsutum
  Clone ID: uC-gsronu33B154h04b2
caaattttccaaagatgcagtacaaaaacctgggcagatgaggcttaaaggtgagtcaactatcgtatggagcatgggttagtttcggtaaccagctcgatgttaaagaagcaaagtcacttctccagtgttgtaaagacaacggagtcaactttttcgacaacgccgaggtttatgccaatggtcgagccgaggagatcatgggtcaggctattagggaacttgggtggaaacgatcggatatcgtggtttctaccaagatcttttggggtggtcctgggccaaatgataagggtttgtctagaaaacatattgtggaaggaaccaaggcgtccttgaagaggcttgatatggattatgttgatgtgctctattgtcataggccagacacacagactccaattgaggagactgtgagtgcaatgaattatgcgattgatat

SEQ ID NO: 4568 - DNA, 462 bp, Gossypium hirsutum
  Clone ID: uC-gsronu33B154h06b2
cttgttttaaaaaaaaagtgataatcaacttgtcagaagggagaagatatgggaagcgaggcatacgaggaagccattgcagctttgtcgaagcttcttagtgacaaagctgatctcgggagtgtcgccgccgcaaaaatcaagcagataacagacgagttagaggcagctgccgagtccactcagttcgacccggtcaagcggctcgagaccggtttccttcacttcaagaaagaaaaatttgacaaaaatcctgatctgtacggtgcacttgccaaagggcaaagtcctaagttcttggtatttgcatgctccgactcccgggtgtgcccctcccacatcctgaatttccaaccaggggaggcttttatcgtccgtaacattgccagcatggtcccgccctatgacaagaaaaaatactctggagctggggcggccatcgaatacgctgtcctgcatctg

SEQ ID NO: 4569 - DNA, 325 bp, Gossypium hirsutum
  Clone ID: uC-gsronu33B154h07b2
ttctaggaaagagtgccccaatgctgagtgtggggctggcactttcatggctaaccatggggataggcactattgcggtaagtgtggactcacttatgtttaccaaaaggctggtggcgattgagtttccatctttagcttgtcgatcttttgttagtatgagagacgggattttaatttccaattatcgttcgactgtttaattttttattatgttttatcatgttacgatacttgggatatgattatcaattttagcttttctgaatctaagtaagggcattttaaaaaaaaaacctctaaagggatagcaaaataaaatttg

SEQ ID NO: 4570 - DNA, 514 bp, Gossypium hirsutum
  unsure (1)..(514): unsure at all n locations
  Clone ID: uC-gsronu33B154h08b2
ccctctcgtccgattaattctcccattttcctttttgccttctagaaatttccaagttcttcttcaaaaccctcacatcccattcgatcaaaagaactcaaatctttatcatccaccatgggaggaggaaatgcccaaaaatccaagatggctcgtgagaagaacttggaaaagcaaaaagctgccgccaaaggaagccagcttgattctaacaagaaggccatgaccatccagtgcaaggtgtgcatgcaaacattcatctgtactacaacagaagtgaaatgccgggagcatgctgaggcgaagcatcctaaatccgacctatacacatgttttcctcatcttaaaaagtagcacactggngaagtggagatggcttgtagcatgcatctatcttgtcccattggtactgtatgagtaacttcttaaaatctctctcacaaaagccctataagctctcacttggtgaattcgatgaagcaattgtcatgtcgtgttcctgctcgatacttgc

SEQ ID NO: 4571 - DNA, 521 bp, Gossypium hirsutum
  Clone ID: uC-gsronu33B155a01b2
tgacatctcaacttctaagaagcctccaagtccttctcctttgagattttccaagttttttcagtccaacatgagaattcttgttactggtggagctggattcattggctcccatttagtggataaattgatggagaatgaaaagaatgaggttattgtcgtcgacaactactttaccggcacaaaggacaatctcaagaaatggattggacatccgagattcgagcttattcgtcacgatgtcaccgagccgttgctcattgaggttgatcagatctaccatcttgcttgcccggcttcgccaatcttttacaaatacaatcctgttaagacaataaagacgaatgtgatcggtacattgaacatgttgggtctggcaaagcgtgtcggagcaaggattttacttacctcaacttcagaaggttatggagatcccttggaacatccccagaccgagagctattggggaaatgttaaccctatcggagttcgaagctgctacgatgagggatacgagtggc

SEQ ID NO: 4572 - DNA, 512 bp, Gossypium hirsutum
  Clone ID: uC-gsronu33B155a02b2
acctgtagaagctgagccggagacaacatcagatgctccggctgcggaggaaaccgaagtttccatagccgaagctccagctgaagtcgataccaaagaagtggtagaagaagaagcgaaggctgctgaggaatcggagaaagcaaaggaggaggtaaaggatgagaccccggaggtgcagacagaaacagttacagaggaggccaaagtagagaccgaggaacccgcggtggaagcagcggtggaggagaaaccagcggaggaggaaaagggagatgaaaaagctgaagagattcctgttgagaaagttgaagaatagagcgaccaataccatacgtaaggtggcaaaagcttaaaggagcttcttttttctataggctgtatgtcatagttggcggagtcatactactattatttatgattactatgtcggatgtgggatgatgagggctttctttttctttatggctgtttttcttgctcgggtttgcttttagcatgtattttttttt

SEQ ID NO: 4573 - DNA, 555 bp, Gossypium hirsutum
  Clone ID: uC-gsronu33B155a03b2
ggattgactctacgtggcaccatgcgtgcccacaccgacatggtgacagccattgctactcccatcgataactccgacatgatcgtcacttcctcccgcgacaaatccatcatcctttggcacttaaccaaggacgaaaagacctacggtgtccctcgtcgtcgtctcaccggtcactctcacttcgtccaagacgttgtcctctcttccgattctcagttcgctctctctggttcctgggatggtgagcttcgtctctgggacttatctgccggtatctcagctcgccgttttgtcggccacaccaaagatgttctctccgttgccttttcaattgacaaccgtcaaattgtttctgcttctcgagatcgaactatcaagctatggaatacccttggagaatgtaaatacacaatccaagaaggtgacgctcataccgactgggttagctgcgttcgtttcagcccaaatactcttcaacccaccattgtttcagcttcatgggacaagggactgtaagtttggaacctgaccaactgtaagattcgtaacacc

SEQ ID NO: 4574 - DNA, 537 bp, Gossypium hirsutum
  Clone ID: uC-gsronu33B155a04b2
cccactcgtccgcccacgcgtccgggaacatctgccatgcgcctcctacacctctggatccgactccgtaaccctcaaaaggcctggccacttttatttcctttgcggtgttccaggccactgccaagccggtcagaaagtcgacgtattggtcaaatcatcgaccacagcctcaattgcgagtcctagcccatccactttaggttcatcgcctgcatacccaccgacagaaatgttgggtgctcctggcccagctcagagcagtgactatgaccttgttactcttcacgaattccctggcatggagtcttgtcgcggttggcggcgtcttctggcatgtcttatacttctaggctggcgctccttacaattgtgggtgtgggcggggctacacattggtgatgagaagcacctgatgcaaacaggtataaatgtattaggtaaggctgtgaagttttaaaagataggcagcatttcaatcactgctattgttgcaaaatcagaattactgagagattctcggaccccctgaatttt

SEQ ID NO: 4575 - DNA, 382 bp, Gossypium hirsutum
  Clone ID: uC-gsronu33B155a05b2
ccctctcgtccgtgctgcttgcctttgtactgctatcagagctaacatcttaggcatcaaccttaacatcccagtttctcttagcttgctcctcaacgtttgttcaaggaatgttccaactggcttccaatgctaattaagtcatcacttttccctccattctttctcaacttccttgtggtgttttgtgtttggttttttataaagttatgatgtcataacttcattgttttaatttgtatcattcttgctttaatttcattgggagaattgatacagaataatatttttcttaaagtgtttttctttgagtgtgtattgtatctctaaaggacatgaaaaagcttgtattattcaaataaaaaaaaaaaaaaaagaggcc

SEQ ID NO: 4576 - DNA, 496 bp, Gossypium hirsutum
  Clone ID: uC-gsronu33B155a08b2
gaagacatgaaggctttcttctgtctaggagcagcaacgagggcatctatcatttgaagtgactttcctgtacctgagattagcaagattagggatataatcccaggaaatccgccaaatagtaattgcaatttttgagggtagctgtaggctccataatttcttgtaaaattcttttatctcggtctgtaataagtaattaatagcattcggattagcatcttgtaatagtttacaggcactgcatactgaaaacttgccagacaattctcttttccaaatttgagtatcctcgtgctcagtcactgcaagacggatctatagaattttttgagcagtttcctcttgaaagatagaaatattgtctcctctgcccactctccaacacatccttttttgaaagaagtctatttgctgcccagataccttttcaggcaagtgaagccgccaaaagaaattctttttaaaactgttttgggatttccttcgttcatac

SEQ ID NO: 4577 - DNA, 430 bp, Gossypium hirsutum
  Clone ID: uC-gsronu33B155a09b2
gtttaaaccacctcgctgccatcattgttctgtttgtgggcggtgtgtgctaaagatggaccatcattgcgtgtgggttgtcaattgtgttggtgcattaaattacaagtatttccttcttttcttgttttacacattcctcgaaactagtcttgtgactttggccttattgcctcatttcatagcattctttagtgatgtagaaattccaggaacccctggaaccttggctaccactttcctttcctttggtatggacttcttggtctgttcttctgatctattttactttagtgactatgcagtatgtacaaatgtatgactatgttctgctgtggcagttttgaatctggcatttgcattaagtgtcttgtgctttttgatcatgcacatatctttggtggccgttaatactacttctattgaggcc

SEQ ID NO: 4578 - DNA, 410 bp, Gossypium hirsutum
  Clone ID: uC-gsronu33B155a11b2
aatcccggatagtcctaatttgtgttgggatgtgaggtttcgggtggcggttggcactgcaaagggcatagcatatttgcacgaggaatgcagggattgcatcattcattgcgatatcaaacccgaaaacattctcttggatagtgattacattgcgaaagtatcggatttcggattagcaaagcttgttggaagggattttagtagggtattagctacaatgaggggtacttggggctatgttgctccggaatggatatccggtatggctattacaccaaaagctgacgtttatagctatgggatgacattggtggaaataatcggcggccgtagaaacgtgcaagcaccacaatccgtacaaaatggcaatgcatttaatgaaggaagggatggagagaaatgggttt

SEQ ID NO: 4579 - DNA, 523 bp, Gossypium hirsutum
  Clone ID: uC-gsronu33B155b01b2
cccactcgtccgcaaaagcaagttgttgtggaaaaggttggtgaacctactgatagctatgaggctttcactgctagccttccagccgatgagtgtcgatacgctgtgtatgactttgattttgtgaccgatgagaactgccagaagagcagaatttttttcattgcctggtctcctgatacatcaaaagtaagaagcaagatgatctatgcgagctcaaaggacaggttcaaaagggaattggatggcatccaggtagagttgcaagctaccgatccttccgagatggatctcgatgtcataaggagccgtgccaattgaaatgtatgtaccatttcttcattgaaatggaactttatactatgtggttcacataaatgtaatgtctatatcaactttggatcttggaacttgctttgatattgggttatatctgtggattcttatggggtatgtggtgtgttccccctttggggtaccaaatttcataacgatttgactattacatgcctttccttttatg

SEQ ID NO: 4580 - DNA, 525 bp, Gossypium hirsutum
  Clone ID: uC-gsronu33B155b02b2
gtttattacctttcgaaaaagagggaaaagaaaaaagcggtcgagattttcacagccatggcgagcaccaaagtacagaggattatgacccaacccatcaacctgatcttcaggtttctccaaagtaaagctcgcattcagatttggcttttcgagcagaaagatttgaggattgaaggccgaatcattggttttgacgagtacatgaatttagttcttgatgatgctgaagaagttaacgtcaagaagaaaagccgaaagtcattaggaaggattcttcttaaaagagacaacattactcttatgatgaatagtggaaaatgattgtagatccagcagttatttggactcgtgaatgcaaaatcttcttgtcatcgtataggtcaatctactatgacaatatcgtgctatctttaaaaacatgtcttcgtgttagaacattcaccttctaggaggtgcttctagtatttcggacaagttaactgtgcctttgttagataactaatgatttgacatgttgatctg

SEQ ID NO: 4581 - DNA, 529 bp, Gossypium hirsutum
  unsure (1)..(529): unsure at all n locations
  Clone ID: uC-gsronu33B155b03b2
cccactcgtccgcttttgcataaaatgggcttgtggacgttattagaaggatttttgcttcttgcaaatgctttggcaatattaaatgaggatcgttttcttgctcccagaggatggagtttctcggatttctctgcagggcgtacaaagtcatttaaagggcaacttattggtctcatttacgccactcaatacatgagagttcctctcatactacttaatgcaatctgcatttttgttaagctagtttctggttgatgctgcgctagaacgcatgaagtcgaatatggagcataggaatttgccgaaggttgtgtaagacggaagcagtcagttcaaaaattaggtgatgtatctgttttacacttaagtttgtatcccacctccttttaaaattgaatttgaggtttcatgatgggattttatcgaacctggaaatgtgataacttgatagctctagcatttgtataatttggagactttacgctgtcattttgaaatatacagnttattgtgcctggaatttcta

SEQ ID NO: 4582 - DNA, 527 bp, Gossypium hirsutum
  Clone ID: uC-gsronu33B155b04b2
ccctctcgtccgatcgaacccgtgatgagattactggtgttagacaggagcgtgatccggttgaaagaattaggaagctgatattgtctcatgacctagctactgagaaagagttgaaggacattgagaaggaaataagaaaagaggtagatgacgcaattgctcaagctaaggaaaatccactgcctgaatcttctgagctcttcacaaatgtgtacgcaaaaggtttgggtgttgagtcatttggagcagataggaaagaagtaagagctatacttccataaattgggactttgttggaacgtcttcattcttttctttagttttaccaccctcaaccttggaagaaagaagaataaagaaccaaaagagggtaaccagctcttccaagttacaaatatgacttagcatttgtatttgtacggaatacttattattttccctaaaaattacgggcagaattgtccatttaaattgtgggtaacccgcccatggtttacactcctatgataaattggttggtgttt

SEQ ID NO: 4583 - DNA, 291 bp, Gossypium hirsutum
  Clone ID: uC-gsronu33B155b06b2
gttattaaatacgagaccagaaagaattacaaacacggggttttttagaaaaaaacaggtcaagagagaagaccatggacgatcaacttacgggcgatcagatctctgagttcaaggaggctttcagcctctttgactgggatggccttggttgcatccctaccaacgtctgatggttgagcgatgctgtcacttggtcagaaccttactgaacgtctgattacacgatatgatcaatgtagttgatgctcgtggaaatcgaaccattgattttcctgaattccttaacct

SEQ ID NO: 4584 - DNA, 585 bp, Gossypium hirsutum
  Clone ID: uC-gsronu33B155b07b2
gatattggatggatttatggttctgttacagaagatattttgactggttttaagatgcatgcccgcgggtggatatcaatttattgcatgcctcctcgtccagcattcaagggatctgctcctatcaatctttctgatcgtttgaaccaagtgcttcgatgggccttgggttctattgagattttgctgagtagacattgccccatatggtatggttacaaaggaagattgaggcttctggagagactggcatacattaacaccattgtttaccccctcacctctattcctttgcttgcttattgtatgcttcctgccttttgccttctgacaggaaaatttatcattcctgagataagcaactttgctagcatgtggttcattctccttttcgtctccatttttgctactggaattcttgagcttaggtggagtggtgtcagtatcgaagactggtggagaaacgaacagttctgggtcattggtgggacatcagctcatctctttgctgttttccagggtcttctgaaagtgcttgctggaatagataccaactcactgtcacttcaaagcgtttgatgatga

SEQ ID NO: 4585 - DNA, 476 bp, Gossypium hirsutum
  unsure (1)..(476): unsure at all n locations
  Clone ID: uC-gsronu33B155b09b2
cctacgcgtccggccttggtaaatttgagcgttgagaaacaagcagatgggaaacttagtgggtacatcaggataaggagcaagacccagggtattgctcttagtctcggggataagattactctaaaacaaaagggaggcagttgatctgtgggatgttgacatcatttgtttaaccaatactggtagtcattctggttttcgcttttgtcagctgctgcctgtctcaatctcctttgaaatgcaaaaaattattactgatctaaaaatgcaggtactttgcctgcattttaaagatagccgccttcatttttgttgtgttctctgtatctaggggtagtatcgatttcaagagatgacattgttgtatttgcagttacatatttctacagtaaaaaagggtcattgaacatttgttaaaaaaagatacttctttttggcgatgttaaaacaggattatctntttgcggattctc

SEQ ID NO: 4586 - DNA, 455 bp, Gossypium hirsutum
  Clone ID: uC-gsronu33B155c01b2
ggaaatgaatcatgggtcgtatgatttcatctttgtggatgctgataaagacaactacctcaactaccacaagaggttgatagagttggtgaaggttggtggtttgattggctacgacaacacactgtggaacgggtcggtggtggcaccgcccgatgctccgcttaggaagtatgttaggtactacagagacttcgttttggaactcaacaaggctcttgctgttgaccccaggattgagatttgcatgctccctgttggcgatggaatcaccctttgccgccgtgtcaaatgaaccaccaccaatgctaccgccgccacagccgctactaccacccaagatcgacaaactttcatattttttttgtgcaatttcaaatatggtgtaaatttaatttggcatttataaacgcaatgcctatctaccattatcaaatcatattacattctaaacc

SEQ ID NO: 4587 - DNA, 509 bp, Gossypium hirsutum
  Clone ID: uC-gsronu33B155c03b2
gccaggtgttggtcgacgcgtccgacccgaacattatagagacacatgacatattttagtttttattgattgtaacatgatctttggttttatatgtctgagtatatgttggaagttgtacatatcgttaagggggaatctttgagtgcttataatttaatcgaagttagattcgagtgagacgtgacctgaacaatgaagaacacattatttattggtattttgatttgtgtgacatatattaagattttatatttctgaatatttatatgaaagtgatatatgattctaattagaaatgtgaggatagattgtaattaatcttggatttgtagattattatgaaattgacatagtatgtgaacattgagggctatatggattaagattcttaggcctaaattgatagattgtgtaaaatgttaggggttcacattggtattatgtcgatgaagagatcacatcagtattgtcgtctggttactaaagcgttttaacagactgttcac

SEQ ID NO: 4588 - DNA, 70 bp, Gossypium hirsutum
  Clone ID: uC-gsronu33B155c04b2
agatatgccttcacattagatccaaccttgaaaattacaaaggctccccattaaaaaaaaaatctaccct

SEQ ID NO: 4589 - DNA, 437 bp, Gossypium hirsutum
  Clone ID: uC-gsronu33B155c06b2
ggtctttaagattgtcacgggaccatctgaccatcaacaaattgatacagtaaaggtacacaagggcagtcagcactctacgaaatctcatgtcaaggagttgggtgtagataaagagaaatctaagagatatacagagccaaaccaagaagaaaagaagaggaagattttagaaagacttgattctgatgctcaaaagttggctaatcttcagataactgtgcaggacctgaagaggaaggtagagataactgagaagggcaaaaaggggaaaggaattgaatatggtacggtaaaagagcagctagaagaagctgaggaagctatcacgaaactatctgattttaatcgcaaattgatagtgcatgctggagacccttcacggtccctttttgatgggaaaccttgcatagattcggatgggagcggaagtggta

SEQ ID NO: 4590 - DNA, 399 bp, Gossypium hirsutum
  Clone ID: uC-gsronu33B155c08b2
atcaagacacccaaagagtttatagatgaccaacatcctcggcttttcaaggacttagatttcatggagttcttcctttatgccttttccgatcctgcaaggcacatcgacaacggggagttgctccatgtctttgctggcctctcaccaccagtttccaattaaaatcatgctcatatagacaagtaaaagtttggttttggttttaaattaatgttacaaataataaattgagtcctatactcgagatctacgttctcgaactgtattaccatgttatattttgttataattgtgtactactaaatctactatgttgagtaatgttggttttatgaaatcaataagaatgcagttcatggactggaaaaaaaaaaaaaaaaaaaaaaaaaataaaaa

SEQ ID NO: 4591 - DNA, 432 bp, Gossypium hirsutum
  Clone ID: uC-gsronu33B155c10b2
cccacgcgtccgcccacgcgtccgcccacgcgtccgctctcaacgactttgatcggttcaagcttatgttagctaagatcaagagggctggggttgtcaggcaagaactcgcgaagttgaaaaaggagaattcatcttgaaatgatacctgaatcacgaggatttgctagttttgtcattcaacattctgcaatgtgttctttcggaatggtttttttttttttttcaattaagatcagttgagtgcagtttcattggtctaagacagattttgtagtgaatttattgctagatttttgtttgtgaaaacttgtggtaatttatattggctgcatgagaggcataataatagtctccataaaaacagcgttgtatttgtccttcctctgatggccacaaatgctttgaaaatttcttcaaaaaattcctttt

SEQ ID NO: 4592 - DNA, 285 bp, Gossypium hirsutum
  Clone ID: uC-gsronu33B155d02b2
cccacgcgtccgcccacgcgtccgaactccaagctcttgccttcccttggtattgacccaaaccttgccatgaaattgcctagcttgtgcaagcttcctcatcctgcaaattgttagttcctggttctccatatttgatctcaaatgtgagggaaaatcatgcttattataagcctctacttcacataattgtactgaccttcgggttttctttttcctttatttctttttatgtgttgtgtttcgattggtatcttatagtcgtgtgatttctcaccaataatc

SEQ ID NO: 4593 - DNA, 539 bp, Gossypium hirsutum
  Clone ID: uC-gsronu33B155d04b2
cctactcgtccgcaacaccaacgccatgggaagatttgaagagggaggattcgattcagtggtttgccctaagcctatacgaacctttagatggtctaccaacagctgttatcagactgagatggctgattcaaaagctggtgcagagcttcttgatataatcctctccgagggagggtatggggccgagaaccccaccgaccaaatggcttcatcaccaccgtatttctgtggatcaccgccgagcagggcgtcgaatccggtaatccaagatgcccgattcaacgacgagcagccggtgctacctccactaacatccccgggaccctcctcaaggggaggatgcgtgagggtgaaattcgggcagatgccagctgctgtacgaatcgagggatttgattgcctcaccagagatggccgccatcgcagaatctccgccgtggcttaagaaataccgaggggaagaaaaatttgatatgagaaaaaaaaattgagaggagagagggagatgataaaaataagttacaacttggaatagt

SEQ ID NO: 4594 - DNA, 583 bp, Gossypium hirsutum
  Clone ID: uC-gsronu33B155d05b2
ggtaattttgtgaaaatatgttgaaaaccaatgctagttgtttgaatgaatgaagtcaaacagttatgctttgggttgtgttggctatcactagagcttctggattgttaaagcaattgctggttttgattaattacatctatggtctgtccaataggaggattgaattgctttgcacgtcatcaaggtcttttcttttagagtttctagtttgcttgagcttaaaatgtggatgtgttttagtagcattttgtctttatatgtttcttacaaaagttcctcttatgtgccttttacttttgtgaatcatgaggatattgatggaacttgagcttcagtttaggtttctggattggagtgtttctccttgtattagggctgttaataccaccctgtgtttatctcaaagctaaagatacgaggtgtcaaactacatttctttctgctttcatttaaatggggcctgcttgctactgctgccattactgtattgaaaacccttgttctataggaagtcttcaatgataccgtaatggttgtactgactattattgcagtgagtgttggagcatttcggaattag

SEQ ID NO: 4595 - DNA, 538 bp, Gossypium hirsutum
  unsure (1)..(538): unsure at all n locations
  Clone ID: uC-gsronu33B155d06b2
cccactcgtccgctctttaactctaaaccccaactctgcagattacatattgcaaacaatggggtcattggattcaaaagaatcaccagccaataacccaggccttcattctccccctgatgaagccaccaaaggctacatcatgcagcaaaccatgtttcgaatcaaggacccaaaacctacccttgaattttatagtcgcgttttgggcatgtcgttgctaaacaaagtggatgttccatatatgaaaatgacattgtatatgatgggctatgaggatgtttcatcagctccgagtgacccagttgagaaaactatttggacatttggaagaccagctactatggaattaacacatttctggggtactgaaaacgaccctgagttcaaaggataccacgatgggaattcagaacctactggcttcgggcacattggcatcaccgtggatgacatgtataaggcatgtgagagatttgagagtcttggagtagagtttgtcaaaaaaccaggcgatggntatgcattcatcaaggat

SEQ ID NO: 4596 - DNA, 232 bp, Gossypium hirsutum
  Clone ID: uC-gsronu33B155d07b2
cccacgcgtccgcccacgcgtccgctttgttgattgagttgcatgatggaatgacagaaatatatggtgtgatgttctcaaacccaggttgctgcttatggcggacttggactttgtaagaatatttacagtacttgtcaatgatgctccttaccaagtcatgcaaaatataaagctgtcatgtatccttcctatttcttcaacttatacaagggccatttccattgacacc

SEQ ID NO: 4597 - DNA, 570 bp, Gossypium hirsutum
  Clone ID: uC-gsronu33B155d09b2
cccacgcgtccgcccacgcgtccgcaaggacatcaagaatggcgtgtttgtaaatggtaaattttgcaaagacccaaagcttgcagttgcagaagatttcttcttttcaggcctaaacaggccggggaacacatcaaatccagttggatcaaatgtcactatgatcaatgtagatataataccaggacttaacactctaggtatatctctggttcgaatcgactatgcaccttatggtgtcaaccctcctcacactcaccctcggggatccgagatcctgcttgttgtcgaaggcacactttatgtcggcttcgttacggcgaacccagacaaccgtctcttcactaaaatcctaaaccctggagatgtttttgttttcccctttggtatggttcatttccagttcaacataggaaaaactgcggcggttgcctttgctggtctcagcagccaaaatgctggggttatcaccatagctaacgcagtgtttggctcaaacccaccgatcaacccagatgttttggccaaggcgttccagttgaacaagaatgggttaagtatcttcagtct

SEQ ID NO: 4598 - DNA, 554 bp, Gossypium hirsutum
  unsure (1)..(554): unsure at all n locations
  Clone ID: uC-gsronu33B155d10b2
tttaaaaaaaaaaaccttcaaattctccttgcttctctgactatgggacttctccagaggtctgccctaccgccgccgtagccagtggccggcattgcaggaaaacgagcctttacccttgcctccgagcgaatttgaaggccaagcaatcggagcccgaatagccgagaagtgatggttctcaatcccatccctttcacgggttgatcctcgacgacagagaaggactctccgacatcggccatgggaaacgagttttcaaggaaggaagaggcagaagctgctctgaaggcacccgatgctgtaatgggtaaccgctttattaagctctggtgtgcaaatcgggatagaatacctgatggtgacataaacagtggcagtggtgtgtcagtaacttcacgtggtctaacagcttctgttattccagctcagaggaaagattattttcaacctattcctctgaattcccccaagcctcatagtatgaatggtctcatggttcctcctgcaccgcggnaaaaattagagactttggagcagatgaaagaggaact

SEQ ID NO: 4599 - DNA, 421 bp, Gossypium hirsutum
  Clone ID: uC-gsronu33B155d11b2
cctacgcgtccgcccacgcgtccgaaccggtgcatgtgtcccctgtattttacgctattttcgtggctttcactggcaaaaacttgagaacattggccctactgtagttactgttggaagtgctctaacacacatgcttttgaattccacttaaagtattcagattgagatggtttttatgtcaaaagttacgtttcaccgcaatatcaaatgctaaatgtgtaattttttttggtttttgattcaatagtcggtttccgagccataatgtagcaatattacatttttcttctttgagttttaccattggctttacctttgttttttttgtttgtttcctttggacgatacaaagcgtatgaatgttgatatcatgtgatgctgttgtttatatagaatcatatgtactcattggtattat

SEQ ID NO: 4600 - DNA, 446 bp, Gossypium hirsutum
  unsure (1)..(446): unsure at all n locations
  Clone ID: uC-gsronu33B155d12b2
cctacgcgtccgcccacgcgtccgattttccttgggtctttaaaccaaaagacttggatagaaataggacacacctccaaaattctgtatagagaagtaagactcctaaaagggtacagaattgtgcgaggaactctcatctagctgactttgtgtatacagcttcaggtggaaccaaagaattctttctcagctgcgaaaaacctcagctgctgttttttttttttaaaacttgaaaaccatcaaataatggcccaaggttttaaactatactatttgttttattttcctgtgatgagatgtacttttcctcagattgccattacttaaaagtaatgcgggggatacaatttatgtagcgatgaacatatccgtacatgattcaatttattatcttaaaagttctctcaagtctataaccaggcatgagtaagaacaactcanaa

SEQ ID NO: 4601 - DNA, 568 bp, Gossypium hirsutum
  unsure (1)..(568): unsure at all n locations
  Clone ID: uC-gsronu33B155e01b2
aaatttgataatcaaaatgtcactgttgagtgttgaaatttagttaaaacaacaccccccttaattgttccatctatcaaatgctttcttctttcaaatcctgggttttcagcagctactagtctgccactgctccctcatgggattgagatgtgtgctaatttacttgcagcattttgttttacttacaacagggttaactaaaggagctttgtgcggtaaagcacatggtctaattaacaagtaactatcatttgaaggaagggagcttttacctatgttggtgcttcatctgtacattttagggaattagtgatcaaaacgaggtgtaaagttttactattgcttacatttcccatcatactttttccattttttgctctggcttctttattcatggtccgtggaagctgagcaacagaacacagcaaagaaacagttgattagaagtttggcagagatgagatgagtttatctaggcctatatcagggccttaggntacacgtatccagtagcttgtcacccagcattcatcgtccactacattcagtattaatcacatgactg

SEQ ID NO: 4602 - DNA, 563 bp, Gossypium hirsutum
  Clone ID: uC-gsronu33B155e04b2
agctatcataacctcattgatagaaaagcttagtaaaagccccgggataaacaaaaaatggagctcactttccctgtaatcgacttctccaaactcaatggtgaggagagagcagccgccatggaaatgatcaaagatgcctgtgagaattggggtttctttgagttggtgaaccatggaatatctcatgagctgatggacactgtggagaggctgacaaaggagcactacagaaagtgcatggagcaaaggttcaaagaaatggtggccagtaagggtcttgaggctgttcaatctgagatcaatgacatggattgggaaagcaccttctttttgcgccacttgcctgaatctaacatgtctgaaattcctgatctcgaagaagattacagaaaggtgatgaaggaactccacagcaagggcagatgatgttgttagccactctcttgtaacttagattgatcaatgtagagatgtaattccagtagatcctccatattgtaattgtaattttttatgggagctgtatgtccccatagtttctaaagaaatctttagattcg

SEQ ID NO: 4603 - DNA, 557 bp, Gossypium hirsutum
  Clone ID: uC-gsronu33B155e06b2
ctcgccgccgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggaccttcaatttttcatcggagagagcatgcacgatgatggatgtttggtatttgcttactacaaggattgtgctgttgacccgacattttgtactttgcgatgc

SEQ ID NO: 4604 - DNA, 395 bp, Gossypium hirsutum
  Clone ID: uC-gsronu33B155e07b2
tgtacgcgtgggttttgttttcttaattatggcagcttcctttcgtaagtcagaaccagtgcagggtagatcacaaacccatgctaccttagaggttgaaaaccttaatccaacgccagcgagtaaaaatggatgccgaagtaacaggtttatggaggatggtgttctcttgacttgggacaatttgtcggtcacggctgctggtggaagaccgatccttcagggcatgactggttatgctcgccctggtgagccgttggccataatgggaccttcggtttgtggcaaatccacacttcttgataccttagttgggagacagggtctccaacacatgccaagctggacatattcttatcaatgggtttaattaatgccttgttttatggtatcat

SEQ ID NO: 4605 - DNA, 447 bp, Gossypium hirsutum
  unsure (1)..(447): unsure at all n locations
  Clone ID: uC-gsronu33B155e08b2
atgtcactcaggccaattcgtatgttgctcgaatatgatacagtcaaatctctctttttctttaatatgttctgtatttgttgactcccagatgacacttttttccttttttttttcccttttcattaactgctttaaacatttttatcatgtagccattacctgatttctatgttagtggtctttgttttgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggnaggggggttccggttttaggggttcaaatttcacccccggggcctggaaaacttttatttttttttagggaaacccaaatacaagtcccggggcctcggtttacaaacgggggaaaagggaaaacc

SEQ ID NO: 4606 - DNA, 470 bp, Gossypium hirsutum
  Clone ID: uC-gsronu33B155e09b2
gtttatgcagatccatgcggttgattgtgcaagaaagactcacgatagccttgaaaagttcacttctaaagcccttgccctcactctcaagaaggagtttgatggtgtctatggaccggcatggcattgtattgtggggacgagttttgggtcttttgtaacacattcagttggtgggtttctctatttctcaatggatcaaaagttatatgtcctcttgtttaagacaagtgtccaaagagctgattgaagtgtggtgacaaacatagaacaatttggaagttaaaaggcatttgtagtatagcaaaacttttggaagcttaaagccagtgtttatccatttgtagcttgtacattgtttttcagaagaacaaaagagtaggaattgaagtctttggcaagtggtctagcctgtatgacattcttcttctaatgtatcgttttagaaatacagaatccattagcagctc

SEQ ID NO: 4607 - DNA, 167 bp, Gossypium hirsutum
  Clone ID: uC-gsronu33B155e12b2
ctcggcaacggatatctcggctctcgcatcgatgagagaacgtagcgaaatgcgatacttggtgtgaattgcagaatcccgtgaaccatcgagtctttgaacgcaagttgcgccccaagccattaggccgagggcacgtctgcctgggtgtcacgcatcgtcgcaat

SEQ ID NO: 4608 - DNA, 308 bp, Gossypium hirsutum
  Clone ID: uC-gsronu33B155f01b2
aattcatgggattagcatacatgattgcaagagaggagggaatgcttatgtgagggactctcctagccattatggttggagaactatatcggacggtgatgcggtgtcgatatttggaggcagccatgtttgggtggaccactgctcgttgtcaaattgcaccgatgggctggtcgatgccatccaaggatccacagccatcaccatttctaacaattatatgacccatcataataaggtcatgctcctgggccatagcgattcttacaagcaggacaagaacatgcaagtcaccattgccttcaacc

SEQ ID NO: 4609 - DNA, 435 bp, Gossypium hirsutum
  Clone ID: uC-gsronu33B155f02b2
cacacttgtcagcctgtgcctattgcaatcggaggtccaggattggcagcaggcgttagattcaggaatgatgttccggatggcggacttgcgaatgtggctgcaactgtcatgaacctccatggttatgtagctccaaatgactatgagccaacactcattgaagtagtgagcaattagaggcatatgttgcggtcgctgaatgggctaaacgagtttagaataaggatatatttggttcaaaaaaaaggtagtattttggtagacatatgtggtattgagtatatttccccaatgtgttgggaaaatttttgggcttcattgccccaattttaagaacatgggatcgaatgttgaactgatttgcactatgaggtctttttatgattggttgaaatttttaatgcccaaagattggattattttcatccctaa

SEQ ID NO: 4610 - DNA, 112 bp, Gossypium hirsutum
  Clone ID: uC-gsronu33B155f03b2
ccctctcgtccggtcggatgtaagtactggacaggaatgcgtttcaaacaaaaataaaaaaaaaaaaaaaaagagaagaaaaaaaaaaaaaaaaaaaaaaattattgcgacc

SEQ ID NO: 4611 - DNA, 400 bp, Gossypium hirsutum
  Clone ID: uC-gsronu33B155f06b2
atatattcaattgttttgtagtactttgcaaaaagaaggccccagctatgatactgtgacagacattatagacttggtgttttaagttattggatatcctttacaaaatttgtcatagaactgtaatcaaactaccataaatttgttttagttttctttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacggggggggccgttttaggggacccaagtttcctcccgggggcttgcaagttaaaattttttttttggggcccccaaaattaaattaccgggccgcggtttcaaaccgcgggaccgggaaaacc

SEQ ID NO: 4612 - DNA, 525 bp, Gossypium hirsutum
  unsure (1)..(525): unsure at all n locations
  Clone ID: uC-gsronu33B155f08b2
cccacgcgtccggacggcgccaatcagctgtccgccttgactgaccgtccggcatcgtcttggccctcgattttgcccttttgtaaacctttttttttcaccaattcccgaaatggcagtgaaaccctccaaggccgataagaaaatcgcgtacgacgcgaaactgtgccagctcttagatgagtacacgcagatcttgatcgccgcagccgacaatgttggctcgaagcagctccagaacattcggaaaggtctccgaggtgactcagttgttttaatgggtaagaacactatgatgaaaaggtctgttaggatgcatgctgagaagactgggaacgaagctttccttaaccttatccctttgcttcagggaaatgtgggtnttgatctttacaaagggtgatttgaaggaagtcagtggggaagttgctaaatacaaggttggagctcctgctcgtgttggtctggttgcgcctattgatgtggtcgttccacctggaaacactggtcttgacccatcacaga

SEQ ID NO: 4613 - DNA, 540 bp, Gossypium hirsutum
  Clone ID: uC-gsronu33B155f10b2
tgatgttgtagcaagatgatgctcaggattaagagggttccgactgttgtttcgaattaccagaaggatgagactgaagagactgctcgccgcagcagtgggtgtggaaagaattgccttagaagctgctgcatcccaggagcgaagcttcctttatatgctttcaggaaactgaacaatattgagagtgaaaaagtggtgcttggaattgagaacaaagaaccccctgttgcttttcttgactcgctcattcttggggagtgggaagatcggatgcaaagagggctctttcgctatgatgttactgcctgtgaaaccaaggtgattcctggtgaatatggcttcgttgcccagctgaatgagggtcgccaccttaagaagaggccaactgagttccgtgttgataaggttctccagcccttcgatgggaacaagttcaacttcaccaaggttgggcaagaggaggttctcttcccagttgagcaagtgaagatgggaagttcaagtctacccaagtgcttccattgatgctgagaattc

SEQ ID NO: 4614 - DNA, 361 bp, Gossypium hirsutum
  Clone ID: uC-gsronu33B155f11b2
tttagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgct

SEQ ID NO: 4615 - DNA, 347 bp, Gossypium hirsutum
  Clone ID: uC-gsronu33B155g02b2
gtttttctttctttttttgagttaatctgcctggttttgtctgtctgaattattgttgcagattctccatggccgtcaagtaagagtagactatgcaaatgacagacctagtcggaactttggaggtgctgacggctatggtggtggcggtgagatactgatgattcacacacctgccatgctgttccaacacaactggcttttggtttcctttggattgagctcataactatactgctcgctttggtttcttatgaattgtgattgatataaatcatttatattctccatcatgaactttcattcgcgtcataaaatttttatttaatcgcattacatttctatta

SEQ ID NO: 4616 - DNA, 482 bp, Gossypium hirsutum
  Clone ID: uC-gsronu33B155g05b2
ccctctcgtccgcttggcttacaagttccattgtttatcagagcatgaaaaaaaagggaaaatggaagggaaagaagaagatgttagactgggagctaacaagttctcagaaaggcaacctattgggacagcagctcagtcccaagatgataaggattacactgagccacccccagcacccttctttgagcctagtgagttgacttcatggtcgttttaccgagctggaatcgctgagttcgttgctactttcctattcttgtacatctcggtgttgaccgtgatgggagttgttaaggacaaaaccaagtgtacaactgttgggattcaagggattgcttgggcttttggtggtatgatctttgcccttgtttactgcactgctggtatctcaagtggtcatatcaatccggcggtgacattcgggctgatcttggcaaggaaattgtcgttgacaagggcaatattctacatggtgatgc

SEQ ID NO: 4617 - DNA, 367 bp, Gossypium hirsutum
  Clone ID: uC-gsronu33B155g07b2
tttactggatcaaagatgggaaggtggttggagctttcttagaaggcggcactgccgaagaaaaccaagctattgcaaaggtcgctaagcttcagccttcagttcagagtttggaagctgtgaaacatgaaggtctttcttttgcctgtaagatctgatgattcacacacctgccatgctgttccaacacaactggcttttggtttcctttggattgagctcataactatactgtttgctttgttttcttttgaattgtgattgatatggatcatttatattctccatcatgaactttcaatcaggtcataaaattttaattttatcgcattacatttctattattaataaattagaaattagattt

SEQ ID NO: 4618 - DNA, 494 bp, Gossypium hirsutum
  unsure (1)..(494): unsure at all n locations
  Clone ID: uC-gsronu33B155g08b2
cccacgcgtccgcaaccctaatttcaaacctaaaatcgatttgctgaaacccattccagtgactgccaatccaccattttatttggtggccgacaatgctcgagcagcaacccgatcccaccggcgaacgcgccaagcgaggaaacctggtatgccactttattttcccttttaaaaaaaaacctagatctaatgttgtttaatcaagaaagatgaaaccgaatataagaagaacacttagtatcatccgaccctcgtccctatctcaatatttttgagatattcgggacttcattggtatcgtctccaatatttctttctaaaatcgcaagtaaatgagaagaagaaaaaaaattagatagacttgaaaataaccttttctgatttgtgatttcttggttttttcttctttttttttggtatagatgtgtgtcatcccccaaatacaatcgattntttggctttataggtcgaaagaagaggaaaacaaatca

SEQ ID NO: 4619 - DNA, 470 bp, Gossypium hirsutum
  Clone ID: uC-gsronu33B155g09b2
tgttaaccccaaggtcttggatcaccatctaaaagcagctggccgtggtggtcttgaagttgatgttagcaaattaatctggacaccatataaagaacaaagttaatgatgctactcatataaagaacaggttcgaattacactaacgagtttgtctacttagtagctgtttagttaggaatttgtagcttcttgtattttatgtataaagctgaggtcttaggttatgagattagaaagtcaaacttagatcaactcaagagctatttacattctagatgtacttattgccatcacaccatcacctgtgtcatctgagacatatcgggacaaactaacctgtatatattttattacaccgtgagttacaatataacgacttctctctctctctctctcttatgtttgacatttgatttgatttccacctgtgtttgatggaagttgttgctcgcaaccttattgcttct

SEQ ID NO: 4620 - DNA, 538 bp, Gossypium hirsutum
  Clone ID: uC-gsronu33B155g10b2
tgtgtcctaagatgagctcaacgagaacagaaatctcgtgtggaacaaaagggtaaaaacttgttgattcacgagatattacggagctgcaactgaagcaatcggattgtgagcttgtcataagaaagaaggaagctttgcagcagctggaatcagcatctccaattgtcatgcagcagtacatgcctcaaccgacgtttcaaaccccagctccagcagccccagtagcagctcctgctcctgctaacccagcccctccagcagcagcaccttcgtcacctccccctgctaaagcggttggttcttctcatccgccccttaaatgccccatggctggaacgttctacaggagccctgcaccgggtgaaccaccatttgttaaggtgggagataaagtacagaaaggccaagttgtgtgcatcatcgaggcaatgaaactaatgaacgaaattgaagctgatcaatccggaaccgttacagagatattggtagaggatggaaaaccagttagtgtagacatgcctctatttgtaataag

SEQ ID NO: 4621 - DNA, 531 bp, Gossypium hirsutum
  Clone ID: uC-gsronu33B155g11b2
cattttctctctctctaggtcatagagatttcagcttgcttcccatcatcccagtccctcccattactccatataacttgttcatttgttctactctctagctagcctttttccccacaaatcaaatataatcttcgtttcctttacttttgggttcccatggcgtcggctttgactgttctcaggcggctctacctttccatctacaattggctcgtcttcatcggctggtttcaggttctgtttttagcgttaaaggctttgaaagaatcaggtcatgaacatgtctataatgctgtcgaaaagcctctccttctagctcaatccgctgccgttatggagattcttcatggcttaataggtctggttagatcaccggtgtcatcaactctgccgcagataggatcaagattgtatttaacttggggaattttatggagttttcctgagattcgaactcacattcttgttacttcgttggtcatcagttgggccattacagagattatacgctattcattctttggcatg

SEQ ID NO: 4622 - DNA, 111 bp, Gossypium hirsutum
  Clone ID: uC-gsronu33B155g12b2
aatttgggtaaattactgttttagtccataaatttgtaattttgttaatttgactttgttattactaaatttagtcgtaatttaataatttagaaaaagaatctctgtagc

SEQ ID NO: 4623 - DNA, 533 bp, Gossypium hirsutum
  Clone ID: uC-gsronu33B155h01b2
ggttaaaaccctcacacaaattctctctctaaatcttaaccgaaaaggtctccaaaaaagactaccctttttgcccatttactctccttattcaacaaattcagcatcacatccccaaaatagtcgcttttttatctcttgctttcttcatctgcttcaagtcatggctggtttagcacctgaaggatcccaattcgatgctcgtcaatatgatcagaaaatgagtgatttgctccaaacagacggagatgattttttcacttcttatgatgaagtttatgacagtttcgatgcaatgggacttcaagagaaccttctgaggggcatctatgcatatggttttgagaagccctcagcgattcacaaagaggaattgttccattctcaagggctttgatgtgatacaacaggcacagtctgggaccggaaagactgcgactttttgctctggaattttgcagcaacttgattacggtatagtccaatgccaggctctggttttgcacccactagggagtggctcacagatcgag

SEQ ID NO: 4624 - DNA, 531 bp, Gossypium hirsutum
  unsure (1)..(531): unsure at all n locations
  Clone ID: uC-gsronu33B155h04b2
cattttctctctctctaggtcatagagatttcagcttgcttcccatcatcccagtccctcccattactccatataacttgttcatttgttctactctctagctagcctttttccccacaaatcaaatataatcttcgtttcctttacttttgggttcccatggcgtcggctttgactgttctcaggcggctctacctttccatctacaattggctcgtcttcatcggctggtttcaggttctgtttttagcgttaaaggctttgaaagaatcaggtcatgaacatgtctataatgctgtcgaaaagcctctccttctagctcaatccgctgccgttatggagattcttcatggcttaataggtctggttagatcaccggtgtcatcaactctgccgcagataggatcaagattgtatttaacttggggaattttatggagttttcctgagattcgaactcacattcttgttacttcgttggtcatcagttgggccattacagangatatacgctattcattctttggcatg

SEQ ID NO: 4625 - DNA, 372 bp, Gossypium hirsutum
  Clone ID: uC-gsronu33B155h05b2
ccctctcgtccgcccacgcgtccgcccacgcgtccggaaaaagaagccacaactaaaaagaagacagttgggaagaaaaagcagctccatgttgataaaccagatgatgatttggtggttgctgcttatgatgacattgatgattacgactttatgtgattcatttttgggcaaatgccacccaccttcaagcgtttgcactacggatccttgggttaccacaacaaccatatatatgcagatccggcggctcttctcttttttaatttttccctttctttcttcttccaattcttggagaaatttagttgtctgatgaatagtctatccataatatggatgatattgttacatgaagaaaaccattagatt

SEQ ID NO: 4626 - DNA, 347 bp, Gossypium hirsutum
  Clone ID: uC-gsronu33B155h07b2
actaactaaaaaggaaaagcggttcttttttaaacgcttatgattcctttaacaacaatggctgcctcaatggctactctaatggttgttctcgtcgctgtatgcgctctcatgggttccggcattgccgccgacgctccggctccgagccccacctctggtgccggctctatctctccttcatttgtctctgtttccgtcgccgccgccgctgtggctctgcttttcggatctagacttcggatctgaatgatgctatctctggtgttcagatgatgctctgcttttcttttatatatgtattcttttctttttgatttgattttgaatctggtttggaattttag

SEQ ID NO: 4627 - DNA, 416 bp, Gossypium hirsutum
  Clone ID: uC-gsronu33B155h10b2
tccacgcgtccgcccacgcgtccgaacgaacaactatttccgagctgatggccagaattgtggcaactttcttacggagcgcaggacaactaaggttcacgcagcgcctggcggtgggtcttccttggattacctgtttggtggcagcgagaagtgatatgtgagatattaaatgttggaaccactgcttatggttgtcctaaaaggtttgggacagaaaatatttaagtataaacaatatgttggtttcccttccatcctggactttctggaaacttcaaattaagctttttcctatctaagcaactgcttaccattagttaaccatgcttatccaatcctttcatcaagtgttataagtatcttttatcatatattaaagtaatatattcaagaaaaaatggaaacttgcttaa

SEQ ID NO: 4628 - DNA, 267 bp, Gossypium hirsutum
  Clone ID: uC-gsronu33B155h11b2
cctacgcgtccgcccacgcgtccgctgtctttatgattccaggggcttggccgatggcacctctgaaaacattaatatggttcaatattggatgaataatggtgttcgtcatggggaacctgttatcaggaaatctgatgattccagtttaaggagaagaatgaaatttaaaccacgagagctaggttggaagttctgcaggccccagatggttaattttgtcatttttgttgttgatgcggcttctgttttgaaatccatagaggg

SEQ ID NO: 4629 - DNA, 52 bp, Gossypium hirsutum
  Clone ID: uC-gsronu33B156a03b1
ccctctcgtacgcaatacgcagataaactttaaactagaatttttgagagaa

SEQ ID NO: 4630 - DNA, 51 bp, Gossypium hirsutum
  Clone ID: uC-gsronu33B156a06b1
actatggggtatgctgctactgctggtgccgccgcggcataattgccgggt

SEQ ID NO: 4631 - DNA, 1015 bp, Gossypium hirsutum
  unsure (1)..(1015): unsure at all n locations
  Clone ID: uC-gsronu33B156a08b1
gtcctaagtacgaaacccggaaaggtagagagaaacgaaaagaaagatggagaaaggcaaaggaataatggggtccggccgaagatgggccgttgatttctccgataattccactgctccttcttctcgtgacattcccgatcctcccggcttcgctcgtgcctctgtggatcaggacgattcgactgtaagtcgtcaaaagaaggatgctgaatccaattggaaagctcagaaagcttgggaggtggcacaagcacctttcaagaatttgctaatgatgggcttcatgatgtggatggctggaaatactgtgcatctctttagcattggtataactttttctgcactttgtcagcctatcagtgctcttaaggggttgtgaaggtttttgagccttattatacattaatgttatctttttggtcttattttctttttattgtctctattttgtgtgttttattacttgttttttgtatttttatactttgggtttttttctctctttatcttatttgttcattcatttctttttattttctttttttatattttttttatttattaccgttattttatctatttattttattttattttacttattttctttatatttttattttatactttttattatatttttatttttttttttattttattcttctttcttcttttttatattttcttttttttttctatttatttattttttctctttttattttatttttttttatattatcttcttatttttttcttctttttttttctctttttgctttattttttcttttattcttccattttttttttatcttttttataatanttttnantattnaattatttttttttttttttttttttattttccccccatannaanttcatacacttcttctctttcattttctttaaaattaatttatatttatctatagtttttttgttttttgtantatttttntncttctccccccccccccctaattcattttttattttattc

SEQ ID NO: 4632 - DNA, 267 bp, Gossypium hirsutum
  unsure (1)..(267): unsure at all n locations
  Clone ID: uC-gsronu33B156a12b1
gtgtttctgctgggagggttggagcacattggactaggtgacccggatttgaatcaatgttgtccggntctttcaggacttgccgagctcgaagctgccggctgcttgtgcaccaccctcaaacttaaggttcttaaccttaaaatttatgtgccactggctcttcaactccttgtcacatgtgggaaaacaccccctcctggttacacttgctctctctaaaaccaagttgctaggttgatggaatggacatgagaggatgtcgag

SEQ ID NO: 4633 - DNA, 391 bp, Gossypium hirsutum
  Clone ID: uC-gsronu33B156b02b1
gctgtttgtgaccctagaaaagatggaaagcaagctactgttggaccagtgaataccagccgtcctggaatgttcaacatgagggaaaagtacaagtgggatgcatggaaggctgttgaagggaaatcaaaggaggaagcaatgggggattatatcaccaaagtaaaacaactgtttgaggctgctggaagttcttgatgtgtgtgtgtatgaccaatgaaactggtgtaatttcaagcccttgtcggttacttggggttttcattactatgaataaattatgtactctttttctattgctattatgttatttacagtagaaactctttgatttacttttaaaataaaataatttttttttatatatatttattttaattttatatattat

SEQ ID NO: 4634 - DNA, 463 bp, Gossypium hirsutum
  Clone ID: uC-gsronu33B156b03b1
ctcagaaaaaacgaagagctcattgttgatggataacttattgggccttcttcgggttcggatcaaacggggcgttaacctcgccgttcgtgatgttcgaagcagcgatccttacgttgttgttaaattggataaacagaaattgaagactcgtgtaataaagagggatgttaatcctgagtggaatgaggatttaactctttccataacagatcctagtactccaataagactgacagtttatgaccatgacacttttagcaaggatgacaaaatgggaaatgcagaggttgacatcaggccgtacatagaagccttgaaagtggatgtggatggtatcccgaatggaaccacgatagccagagtgcaaccttgcaggaccaacttgctgtccgaggagagtgccatcactttggtcgacgaaaatgttgagcaagacattttgttttcgattgagaaacgt

SEQ ID NO: 4635 - DNA, 446 bp, Gossypium hirsutum
  Clone ID: uC-gsronu33B156b04b1
gcgtttttaaaagaaatcactccttatggccatcaagggccagatctatgatgtttctcaaagcagaatgttttatggacctggtggaccttacgcgttgtttgctggaaaagatgcgagcagagctcttgcaaagatgtctttcgaagaaaaagatctgacaggtgacatttcaggtcttggtccattcgaattggacgcattgcaggattgggagtacaagttcatgagcaagtacgtgaaggctggaaccatcaagaagacaacagttccagtaaccgaaggggatgccagtggtgaagcctcaggagctgcagaaactgattctaagccaactgaagatggtccatcacaaacttcagttactgtgtcagaggaaaaattttttccttgcagatctaaggaggagttacacgttcgagctttagctgattttggttcgaaca

SEQ ID NO: 4636 - DNA, 197 bp, Gossypium hirsutum
  Clone ID: uC-gsronu33B156b05b1
ctcttattccttgttttccttctaagccaaacgaaatctaatcatttttgaaaaatggcaccaaaagctgaaaaaaagccagccgagaagaagcctgcggaggagaagaaagccgtagctgagaaagccccggcagagaagaagcctaaggctgggaataagcttcccaaggaaggcggagcggctgccggtgacaa

SEQ ID NO: 4637 - DNA, 380 bp, Gossypium hirsutum
  Clone ID: uC-gsronu33B156b06b1
ctgaactcttacataaatctctatgaataaaaaacactctttgagtgatactgttttttaaaaaaaaaaaaaaaaaaaaaaaaaaaaaaaaaaaaaaaataaaaaattcccagtctaccttcacccatttgttacccaaaaacacaaatcgaaaaaaaacaaaaaacaaaaaaataataaataaaaaaataaaaactaaaaaagggcgccccccttataaaaaaccaaaattcactcccccttcataccaaaataaatattttttaaaagtgcacaaaaaaaaaaaaaaccggcccggaaattaaaaaattctaaatggaaaaaaccctgggtaacccaaaataaaaccctttgaacaaaaacccttttttccaacatgg

SEQ ID NO: 4638 - DNA, 267 bp, Gossypium hirsutum
  Clone ID: uC-gsronu33B156b09b1
ctatggagcccacaaatgcacagtgtctctagtatcatcgccaatggctaaatgcagcaaaccatctaatctccatggtggattgaagggagctaccttgaggcccgagaagccatttactgcgaataagctttcgtttattttatacaccgttgggccatttgctttcgaacccaaatgctactagaaacttagattccactcttttcctttgattgttgctcttaaatgcggtacccagttcttacctagtttccttgcttaatt

SEQ ID NO: 4639 - DNA, 479 bp, Gossypium hirsutum
  Clone ID: uC-gsronu33B156c01b1
gagattttgattccttcttaaccactcctgggtccacaactgtatccttggttccaagggaaaatactcacaacatcaattgaaacaactctgcttttgttgtttccaatcttaggtggttctcaaacttcctattcaaaggtacaatttttttcttcaaaagatacatttaagttttagtcgtgcagattagaatggatcaccaggggcatggacagcccccggcaatggggatcataggtggtggagcccaaatgccgtacggtactaacccgtatccaaaccaagtgactggggccccgaattcaggatcggttggaggcattcaaccgagcagccagccaacaggagctcaacttgcacaacaccaacttgcttatcagcaaattcaccagcagcagcaacagcaactttagcaacaacttcagacattttgggcaaatcagtatcaagaagttgagaaagtttcggatttcaag

SEQ ID NO: 4640 - DNA, 367 bp, Gossypium hirsutum
  Clone ID: uC-gsronu33B156c03b1
attgatgacctggttcatggagagcctgagagaaatgatatggttgagtactttgttgagcatttatctgtttttttttttattttttacttaatgttttattatattcttttctcttttttcttttttttctctttattttttctttttcattcattttttttttatttttttctttttgtatttctacttcacaatttttttttctttccttttaattctttctttctttttttttttctttttctttttttattctttacctttttttatattttttctttatatttttcctatttttcttcttatttctttatatttttttaatctttcttatttttctttaattttcatttatttttttttt

SEQ ID NO: 4641 - DNA, 325 bp, Gossypium hirsutum
  Clone ID: uC-gsronu33B156c04b1
acgcgcgccttattgttcgctagatcgctagtacacttgctagaggattacttatatcactcttccttatctcaccagtaccattcttggttcagatagtgatttctgctatcaatcatattacaaacagtgggggttggtttgctggcatcaattattacatgtattatctcaatctcttctactttgtacttgcttcgctgagtttggtcaattactgtgtctattttgtttgtttcttcgcgttataagcacaggtctaagaacttagatggtcccaagactgaagccaactagaccttcattttatttcatttccgcttta

SEQ ID NO: 4642 - DNA, 269 bp, Gossypium hirsutum
  Clone ID: uC-gsronu33B156c05b1
cccactcgtacggagacggagaactatacataggaagaggaagtaatgatcactatcacagtgcccacgacagttccttcggtgtctgaagattgtgaacagctaagaaaagccttttcaggatggggaactaatgagggcttaatcatagatatattgggccacagaaatgccgagcaacgaaacttgattcgaaaaacctacgctgaaacctatggagaggatttccttaaggtactagacaaggagctcttgaatgactttgagag

SEQ ID NO: 4643 - DNA, 472 bp, Gossypium hirsutum
  unsure (1)..(472): unsure at all n locations
  Clone ID: uC-gsronu33B156c06b1
gaaaatcagaagcctcaatcccatcaaaacctcccttcttctcctaataaatcaatcccagaaatcgaaagcaacgccgcctctgatttctcgggccatcaaagggtccgtttccccaacccacccgacctcactaaccctgacccttctaccctacgagatcaatggaggtacgccatccggcagtacagtcgttggtactctcacgcctggggcaccgctattcttgctggggtttcctttttcgccctcggttgggtcatcaaaggctctaatcccctcccctctttcaactccgacaagaacaaaaatgactccgacactaacaaaaatgacaatagcaagtgatcttccaaccatcctcaatcttctgtggatatgtttggtttcaccacaactgttgaagaggccagtttgatcaaaaagaanagactgaaattggaagagattgtagtgtgtactggcatcatag

SEQ ID NO: 4644 - DNA, 513 bp, Gossypium hirsutum
  Clone ID: uC-gsronu33B156c09b1
gttctaccttaacgttgtctctgagcgacttggttgcagcattagcttttcagaatgtggagggattgaaattgaagagaactgggataaggtcaagaccatatctgtcccaaccgggtcgcttttgacatcagaaacttgtgctccacttgttgcaacccttcccttggagatcaaaggagaaatcgaggagttcatcaaagtgatctttaatctgtttcaagatctcgatttcacattcctcgaaatgaaccctttcacgctggtcgacggaaagccttatcctttagacatgagaggcgagctggatgacactgctgctttcaagaacttcaagaagtggggtaatgtcgaattcccattgccttttggaagaacaatgagtgcaaccgaaagctatattcacgggctagacgagaagaccagtgcatcgttgaaatttactgtgttgaaccctaagggacgcatttggacaatggtagctggaggaggtgcacgtgtcatctacgctga

SEQ ID NO: 4645 - DNA, 381 bp, Gossypium hirsutum
  Clone ID: uC-gsronu33B156c10b1
cgtttctatacagattcagaaagaaataaaggaagaagaagcaatggccactcttacagtgcccacgacagttccttcggtgtctgaagattgtgaacagctaagaaaagccttttcaggatggggaactaatgagggcttaatcatagatatattgggtcacagaaatgccgagcaacgaaacttgattcgaaaaacctacgctgaaacctatggagaggatctcctcaaggcactagacaaggagctctcgaatgactttgagaggctggttttgctttgggctcttgatcctgctgaaccgtgatgcccttttggctaatgaagccaccaaaaggtggacttcaagcaaataggttcttatggaaatagcttgtacaa

SEQ ID NO: 4646 - DNA, 155 bp, Gossypium hirsutum
  Clone ID: uC-gsronu33B156c11b1
tcataatatacttggtacctgatcatcttatagatggaagaaacaaatggtgtactttgtacttaaatttttaccacagaatttgggtcatattcgatccgtcacttgggacttgttttgatggatagtctgttttaatgaattccttttttcca

SEQ ID NO: 4647 - DNA, 381 bp, Gossypium hirsutum
  Clone ID: uC-gsronu33B156d05b1
cccactcttccggttttcatagttttatttgagattgaatttaaagcaatgcgttgctcggtagcttttgttggtaacattttgttcaattgtctggctatcgtattgaaactaagacagatgttgtgtttgattttgttttactaaacatggtctttggctagcattaatccccaaatttccttccccttaacccatttggtcaagttacagcttatgaagaatgttacttgaagctctttgaatcaagggcaaccacccactatatcgtccatgaatactcctacaatatgaccctactctttttgccggcttttaacaagaccatggcagttttttaattgtggaaggtagtttaagctcactcatttctacccttca

SEQ ID NO: 4648 - DNA, 537 bp, Gossypium hirsutum
  unsure (1)..(537): unsure at all n locations
  Clone ID: uC-gsronu33B156d06b1
cccactcgtccgcccacgcgtccgagctttctcagctttttatatattcctacttattttctataaaaatcaaaatggcttctttccttactcaaagtgtcctcaaacttttccttgtcatctctttgtttcaaatctctttggccgttaggaagctgagtgaagtggtgcaagaccagcctcagctcttgacataccacaatggtccccttctttctggcaaaattactatcaatttgatttggtatggcaagttcaagccttccgagagggctattgtctctgattttgtcacctccctttcctccacggctccatcgcaaagcaaccggccttcggttgcccaatggtggaaaaccactgagaaatactaccacctcacctncaagaaatcttccctttccctgtctttgggaaagcagattcttgacgacaagtattcgcttggcaaatcactcaaaaacaaacaaatcgttgagctagcttcaatgggtgaccaaaagaatgctatcaacgttgntttaacagcaatctgat

SEQ ID NO: 4649 - DNA, 557 bp, Gossypium hirsutum
  unsure (1)..(557): unsure at all n locations
  Clone ID: uC-gsronu33B156d09b1
gtgttgggactgtaaattatgagaacagttgacattcaattgtattggtgaagaccggaaggaacgtgtaattaattagagagtaaacaagacagagatgttcttactcttttatggactttataagtacctatttagcaagacagagtttcatgtactcattcttggaatcgacaaggctgggaaaacaactttgttggagaaattgaaatccgtatactcaaacttggaaggtctaccacctgatcgaattgttccaactgttgggcttaatattggtcgcgtcgaagttctaaatacaaaacttgtgttctgggacttgggaggccagcctggtcttcgctcaatttgggagaaatactatgaagaggcacatgctgtggtattcgtaattgatgctgcttgcccttcacgttttgaagattcaaaatctgcacttgagaaagttcttagacatgaggatctttagggggcccctctcttgatattagcaaacanacaggatctttctgaagctgtacagctgaagacttcgccgattctagaccttaaaaatt

SEQ ID NO: 4650 - DNA, 427 bp, Gossypium hirsutum
  Clone ID: uC-gsronu33B156d12b1
tccttaaggacttaaaaccgtatccacttgcttcttgtggacttccatggcacttggctactacctcagtaccattctggttcagatagtgaatcgtgcaacaaaacatattacaaacagtgggggttggttagctggcaacaatattaacaagaatcatctcaatctcttctacttgatacttgctttgctgagtttggtcaatttctgtgtgtatttgtttgtttcttcgcgttataagtacaggtctaagaactaagatggacccaagacagaagccaactagaccttcattttatttcatttccgctttatgtttatgccaaattaagttggtaacaagatgtagagatcgagttccaaatgtatttgaatttgtattttcatattatgttgcttgaagatattaaatgaaaaccccaaactc

SEQ ID NO: 4651 - DNA, 351 bp, Gossypium hirsutum
  Clone ID: uC-gsronu33B156e04b1
gttgtgtgtagaagagaagggcctctcttctggtgccatccagttcttagcccaccaatcttcttcttcctcctcctcccttgtttccctttcctgcccatttccatcttccttctttccttcctctttcctttgtcttcttgctttatcttccctttatcttcaatcttttctgttctgtttttttcttagattcataggtaagttcgttttggttggcttgattatttcctcacttcccttcttttttggttcatcgtgatcttttcatcaaccccttttgattgttatatagattgttactattcttttaatcttctaaatattattttttcatgaggagagggagag

SEQ ID NO: 4652 - DNA, 567 bp, Gossypium hirsutum
  Clone ID: uC-gsronu33B156e09b1
attgatccttaccatggtgatcaagctgctgacatactcgtcgatttctttgaaaagtgtaagaaagatccatctcactgggataagatctcccaaggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtcttttccttttccttttttcgccggcatttgttgaacatggcgtttgtgcgcccgtctatttcagttaaatatggtgcctttgtctttttcgattatgtaattcttctttctattaccccactcctatcttctgtctgctttgtgatccctattttcttacattttttgtatattatac

SEQ ID NO: 4653 - DNA, 403 bp, Gossypium hirsutum
  Clone ID: uC-gsronu33B156e10b1
ggcagcttaccatcaggcatttgggaaagggatctccctatctgagcagcagcttgtggactgtgctggagcttttaacaacttcggttgcaacggggggttgccatcccaagcctttgagtacatcaaatataacggcggcctcgatacggaggagtcatacccttacactgcaacaaatggtctatgcaaattctcttctgaaaatgttggtgttaaagtccttgactctgtcaacattaccttgggtgctgaagatgaattaaagcatgcagttgccatggtccggcctgttagtgtggcatttgaagatgttactagtttccgtttttacaaaagtggtgtttataccagtaatacatgtggtagctcacccatggatgtgaaccactcttgtttcttg

SEQ ID NO: 4654 - DNA, 102 bp, Gossypium hirsutum
  unsure (1)..(102): unsure at all n locations
  Clone ID: uC-gsronu33B156f03b1
gtcgaaatcacaaataacttgaaacttttacctcttattatgcttgttcttctcatatctaaggctgttggtgatgttntcaatgaaggtttatattatgaa

SEQ ID NO: 4655 - DNA, 547 bp, Gossypium hirsutum
  Clone ID: uC-gsronu33B156f12b1
gaatggtggacaatgactcttcgaggactaagaagacgggcgatgacgcctcattatgtattgcgtagtctaatagctcaatggtgtgaggcaaatggggttgaaccactctagagacccaggactcgttccagtaaaactacatctgcctgctcaccagctgagcgtactaagattgaaatactgctccgtaagctcgaatccagcagttctgaagaccagagaatggctgaaggtgaaatccgtgttcttgacaaacgcattgcagataaccgtgtggccattgctgaagctggggccatacctttccttgtgagccttatttcaacacctgattgacgcatccaagaacatgctgttacagcacttcttaacttttctatttgtgaagataacaaagcatgtatcatatcctctgaggcagttcctggtatagttcaggtgcttaagaaggggagcatggaagctagagagaatgcagcagccactcttttagcctttcagtagttgatgaaaataggtgacaattgttgcctcggagcaatcc

SEQ ID NO: 4656 - DNA, 103 bp, Gossypium hirsutum
  Clone ID: uC-gsronu33B156g05b1
ctgtatggattactttattctagcgttaattctataaatttttaagaatcctccctttatgaagctctagtagctgcagcatgtaatatcaagtattgggtac

SEQ ID NO: 4657 - DNA, 69 bp, Gossypium hirsutum
  Clone ID: uC-gsronu33B156g06b1
attgctcatcagttgtcactctactattgtaaattttttattttttcatctgtaaggatgtgattcaga

SEQ ID NO: 4658 - DNA, 507 bp, Gossypium hirsutum
  Clone ID: uC-gsronu33B156g09b1
cttgtatggcagccaatttgaagagtggtggagggatcgccagcttggggaagcgacttcttaaccgcacctacactcgcaccccttctcttttcatctccacttcttcacctaccaggagtcctcacgcgtcggcatacgacaagaacctggatgatcaggtccatgcggctgtggttcctgatgatgtgattcagcctcaatcggacaagtactgggctcctgacccgcggacaggggtatttggccctgctacggagcaacttaacgcatctgcgggtggcgagcagggcatccattcgagtggagcaaactcggtcctggaggaaaaaggcgtggtatccgccccactagtatttgaggacttggagaagccacaccatcactaagtcgctgataatgagcctgctactatatagtctataggtaaaacaaagacaataggtgtggtttgcttggatcaaataaactggaaaaacgtttaatgttaatgtactatttctacct

SEQ ID NO: 4659 - DNA, 604 bp, Gossypium hirsutum
  Clone ID: uC-gsronu33B156g12b1
ggataaccctctctcaaatcttggctcgccagtcgcctctctttctccttcttcttcttcattctgttggctgctgctgctgctttggcggcgtgatttagaagccacaactcaatttcatataaagaaaaaaaaagtgagatggatccagacgcagtagccaaggccttcgtcgagcactactactccacattcgatgccaaccgggccggtttagccaatctctaccaggaaggtaccatgttgaccttcgaaggtcaaaagatccagggctctcagagcatcgtcgttaaactcaccagccttcctttccagcagtgcaagcacaacatcaccaccgtcgattgccagccttccggctccggcggcatgctcgtcttcgtcagcggtaacctccaactcgttggcgagcagcatgctctcaagttcagccagatgtttcatttgatgccaacgccacagggaagcttttatgtgttgaatgacatattcaggttgaactacgcgtgaagacgatgattaatcaagggatgggaatacaatgcctgaggaattaaaacacgttttgcctatttaggctctaatgaaattggaaatttgtttt

SEQ ID NO: 4660 - DNA, 244 bp, Gossypium hirsutum
  Clone ID: uC-gsronu33B156h02b1
cccactcttccgtgaacggcccttgcacatgtgtaccagacgatcctaagagacggaggaggaggctctaccctgaaaatgaaaatgaaaatggcttttcctgaccatactgtgaatcatgattcaacatttgttaacaccaaatagcttacacaaccatctagatgccgcacccgcttacaaaacttgcatgtatttatgcctcaaacattatgaatcgagccaaccattacttatgctagct

SEQ ID NO: 4661 - DNA, 59 bp, Gossypium hirsutum
  Clone ID: uC-gsronu33B156h05b1
attactagtacatcttcgctttgagattagaaccaaaattcttctttcctcttatttgc

SEQ ID NO: 4662 - DNA, 222 bp, Gossypium hirsutum
  Clone ID: uC-gsronu33B156h11b1
ccctcgcgtacgcccacgcgtccgatttaactggtttcatgcgctcacttttgaagtcaatgcatgaccatgttgatgcttggccattcaaggtaccagttgatgttcgtgaatttcttgtctattatactttatcatcgtcctcatgtttctttttttctatctctatattttgttgtatttgttctatttttatctttctattttattattcatctatat

SEQ ID NO: 4663 - DNA, 527 bp, Gossypium hirsutum
  Clone ID: uC-gsronu33B157a01b1
caaagctaataatacttaaattaaattattaattatttaaaaagctaaaattaaaataaatccatttaatcaaatgttaaaagctctaaattgaattttttaattttagggagaggttaaaaatcaattattttaaaaaataaaaaaatgaaataaattttccaaaaatcaaattatatcttcttgttgaaccaatgaaaccaatcagatgttttaacccaactcaaatcttcgtaataatatatcttaaacggtagcttcaacaaagatgagatttggtgaaagtgttgccggcttgagaagatcattttgatcacaacaatatcacattaagggtgggtttagatggatgatgcgtttatctgtggttagtgtaaaaataatggtgacagtgagattaaatattattataatactgtaacgtgagacaaaaataagctaaacacaccacgcttcaccaccaatttaaacccacccttatacacatatgataaatacttactacaccacacaggtgcactacaccc

SEQ ID NO: 4664 - DNA, 102 bp, Gossypium hirsutum
  Clone ID: uC-gsronu33B157a09b1
cccatgcgtccgaaaaaaaaaaaaaaaaataaaaagagagaaaatctaaaaaaaaaaaatagataatagtaaatcaaaacaagtaaatccaggggggggcct

SEQ ID NO: 4665 - DNA, 193 bp, Gossypium hirsutum
  Clone ID: uC-gsronu33B157a11b1
cccactcgtccgcccacgcgtccgctttaatttgtttctgcatctctcgttttatttctcgtatattaatgacgggtcggggtaagactctcggatccggagcctcgaagaaggcaacatcaaggagtagcaaggctgggcttcagtttccggagggtcgaatagctcggctccttaaagccgggaaatatgc

SEQ ID NO: 4666 - DNA, 400 bp, Gossypium hirsutum
  Clone ID: uC-gsronu33B157b01b1
cccacgttttcgcggacgcgtgggttcaagtttcaatttttaaaccttattgacccttttttcacttaccttttttacttcttgtttctagatatatcaaaaaagtccaacaaaagagtaattgtgaagagaaaccaaggggaaaaaaagcaatagaaaagagcaagcaagcttcaaatcccagatctctctttgttttctctttgaaacccaaattttcccatataagaaaagattctgagaaaatggtgcccaaatcattgatctatgcatttgtatcttcgtggaggagttatattagctgagtatactgaattcagtgggaattttcaattccatagcttttcaatgccttcaaaagcttccttctttaaacaacaagttcacttacaactgtgat

SEQ ID NO: 4667 - DNA, 558 bp, Gossypium hirsutum
  Clone ID: uC-gsronu33B157b04b1
cccatgtgtccgcccacgcgtccggtagcccttcaagacataatgctggacaagattctcgatgaagccggccgaaagagcctatgcaccgagttctcaaagatcatgcaacaggggtttgcacatctaccagcagggatatgcgtatcgagtatgggaaggccgttgtcctacgagcaggccattgtgtggaaggttgtcgatgatgacaacgatgatgctgccaatcactgcctcggcttgatgtttgtaaactggtcttttgtgtgagatctttactgatagatgtatcgaaaaattaactcttaggtatctatctatctatccatctatatatattaagttatatatatatgtttttagtgcttaaaaaagattatattatatatatttatgaagttattggcaggatttaatggatattatcaagtgttttatgggatatatatggctagacatggatgttggtttgcttatttcttgatatagaatggataatttatgctaaaagaatgcggctggatatttcatttagaaaataaaaattggattgttgtg

SEQ ID NO: 4668 - DNA, 391 bp, Gossypium hirsutum
  Clone ID: uC-gsronu33B157b09b1
cctgtcatacaccaccaaagaaagagaagcttgaacctaagccaccagtgtatgaaccgccaaagaaggaaaagcccgagccaaagccaccagtttatgcacctccaaagaaagaaaaaccagaacccaaaccaccagtttatcagcctccgaagaagccaccggtttatgagcctaaaccaccaaagccaccggtttacacaccaccaaagaaagagaagccaaaatctaaaccaccggtacatgagtctcccaagaaaccaccatacggtcactatccaggacaccctccattggggaagcctcaatagagagatcctatcggctagccatcccaagaactgagctactttggctatatagaaaaatttgtatctatacaatatgagtt

SEQ ID NO: 4669 - DNA, 375 bp, Gossypium hirsutum
  unsure (1)..(375): unsure at all n locations
  Clone ID: uC-gsronu33B157b10b1
gtcgtangcggacataagaaagcttgtagctcaaaagcgctggaatgaactaatcaactatgatcagcttcacaaggaactgcgtagtggttatgtatactaggtattggaatgaggtatttattcatatattaattttatttaagtacttttaatttattatttgttttattcatttttatatttatcttaatcttttaaatttcatttactatttatttcatctacttaattattcctatttaattaacttttttatcctattcttttttttttaatatttatttatcatcattattattttattttctttacattatttcttttttaacttatttatccttctttacttatatttttttactttttatatta

SEQ ID NO: 4670 - DNA, 80 bp, Gossypium hirsutum
  Clone ID: uC-gsronu33B157b12b1
caaatagtactgtccgtttgacgcaaaaaaaacaaagacagttaggaacgtaagctaaagccttttctcctttttcatac

SEQ ID NO: 4671 - DNA, 319 bp, Gossypium hirsutum
  Clone ID: uC-gsronu33B157c01b1
cccactctatcgcccacgcgtccggcttgacacaagattcatgcttttgggccaaggtagaagaagcaaaggaatggctagataatgtgagaagtgtgagggatgcaatgaaacaacagcagttgtggcacaagatcgactaacttaagcggttaccggcggcagaagcaagtcaggagacgattctaaccgtctggaaaaatatatattcttatgatctataattggcatttcgggtgttcgatatctaatgtgttatttggtttttttagggattgatttattacatggattggcaaatatgggttgagaattcttc

SEQ ID NO: 4672 - DNA, 260 bp, Gossypium hirsutum
  Clone ID: uC-gsronu33B157c04b1
cccattcgttcgaacacgcatacagaaaataattaaggacataatgctggacaagatactcgatgaattccggtcgtaagagcctatgcaccgagcttctaaagatcatgcaacaggggtttgcacaattaccagctgggcatttgcgtattgagtatgggaaggccgttgacctacgagtaggccattgtgtggaaggtttgacaagactgacaacaatgatgctgtcaatcactgacttggcttgatgtttgaaaact

SEQ ID NO: 4673 - DNA, 340 bp, Gossypium hirsutum
  Clone ID: uC-gsronu33B157c08b1
gtttttgtttcttctgtctgagttttgagctcaaactttgagaccaaaaacatgtggagaagaaagaagaagaagaagaagaacactgcaaccattagtaaccatccctcttctgcttactcctcgtagaggatttgaaagggggcttaaaaggcaagtcatttgaggcaaagggaaggccatgcctttctttctatttttactttattgtgtctttatcttcatttctgcatctttgatttcaatcagagttcagatcaaaatgagcataaaacacatgaagaaagtccaaatttgtagcagactaatttggttgctttcaagctgtttaatgtttttt

SEQ ID NO: 4674 - DNA, 56 bp, Gossypium hirsutum
  Clone ID: uC-gsronu33B157c09b1
gttggtagtacagaatcaaagaactgagggtttagaggacatttttatttataact

SEQ ID NO: 4675 - DNA, 187 bp, Gossypium hirsutum
  Clone ID: uC-gsronu33B157c10b1
cccatgcgtccgagcttttagacccgaacccgaaaacccgaatcgccatcttcaagatcacggaatcatcttggttcaaaaaatctatcccctaagacttatacaattattgatgaaattgaatttgtagctatctaattgtaagatattttttattcttattttttaaatttttttttatattatt

SEQ ID NO: 4676 - DNA, 188 bp, Gossypium hirsutum
  Clone ID: uC-gsronu33B157c11b1
cccactcgtccggtcgtcaggcaagagcttgcaaagcttaaaaaggagaatgcatcttgaagtaattctgaattatgggattttttgctagttttttcatcaatgttccgcgagttctttttgggattgatttcgttctcctattaaacatcgggtttatggtttttgtggacaccttactttgcttt

SEQ ID NO: 4677 - DNA, 476 bp, Gossypium hirsutum
  Clone ID: uC-gsronu33B157d04b1
gaacattgtggttaaacccgagatattgaagaatgttggcaaagcaatcacaaccctcccagataattttaagcctcatagagcagtgaagaaggtttatggattacaacgagcgaatgaataagtacatgaaggagagatggtctaggcgacgccttcaagcagttgaatttttgggtggatgttgcaaacagtgtgggtcaattgaatcgttggaatttgaccacattgacccaaacccaaaccctaactcgctttccctttgattttttgctgacactgactcattgagtccaaaattccaccagctccttccttcatcagccatgagccggttcagggtaactgacatcttcgacccttactctccctctctctgtgttaaagaaacctccattctcgctcacaagcccttagcttttccctcatttttcgaagcagaacatgaacttagctccgtcctcgacctactgagt

SEQ ID NO: 4678 - DNA, 491 bp, Gossypium hirsutum
  Clone ID: uC-gsronu33B157d09b1
cccacgcgtccgcttttagtgtcggttgactcgtaatcttgttgttctcaaggctggaaccttttacacgaatgacaaaggtttttcccaacgctagttttaccatcggtgatgccatctcggagaaacagccaccgcagcataagctgttaccggcgggtgaagcaagtgaggagacgattctaaccgtctggaaaaagtcattgcttttcaactgtaatggcttcacggtgttcgattctaaaggtgacttggttttcagggtcgataattacatggatggcaataagggtgagatccttctcatggatgccagtggcaaccctctcctcactatccgccgcaagaaaatgagcctcggtgatagttggctggttttcgagggagaatccatggagaagccccgactttgcgttaagaaatcagtgtatatcttaagcaagtgcttggcttacctttgcttcggcaacaataacagctggattacatca

SEQ ID NO: 4679 - DNA, 92 bp, Gossypium hirsutum
  Clone ID: uC-gsronu33B157d12b1
cggatgcgtgcgccgagagctgtaatccgagggaagaaggtactctaaggcgatattcttttacacatacatatatataataaatatatatt

SEQ ID NO: 4680 - DNA, 419 bp, Gossypium hirsutum
  unsure (1)..(419): unsure at all n locations
  Clone ID: uC-gsronu33B157e01b1
cccacttgtccggttcgatcaccttgtcctaaaactatcagacatttctcagcaattggaatcatgttacagggatggacttcagctatttgccattttaaaacgtaaataaatcaacgcttcatttcgatatcgtaacgatgctatccgaaaagactctatcttgcatgcaaacatttttaataagattcaggtttcttggattattttattaaagcataaatttgtactttgcttggatagattgctggtatgaatgagcaagtttgttctctgatggtttggatctataataattagaatcccattttctgggtttcttttctgtncaaaaaaaaattattgataaatatatcaattatataatcaaaaaatatatttaatataaatatccaaactaaatttataaaatacatatg

SEQ ID NO: 4681 - DNA, 584 bp, Gossypium hirsutum
  unsure (1)..(584): unsure at all n locations
  Clone ID: uC-gsronu33B157e02b1
cccactttttccgccaatagttagatctcagtttcctttgctaccaaactttggcaatggcggatccagcacttcaccaccaaatccaacccatcaaagaaatagccatagactacaccccagaggcctgcacccactgccctgtctccaactccatcacactcacctttgatcatcgtggaggcgccaggtggcgttccaccactcgcttcctctacggcactttcacttccctcatccaatgccctaaaggcaacaccagtggtctcaacttcaacatttacctttcctcactcgaaggcgacaaatcgcaagacgagatcgacttcgaattccttggcaaagacaaaactattgtccaaaccaattactacactacaggaactgggaacagagagcagattcatgatctgggttttgactgttctgatgggttccatgaatacaccatcaagtggaatcccgattctatagagtgggttattgatgggaaggtggtgaggaaagcagaaaagaaggaaggtgaggcatttcctgagaaacccatgtttttgtatgctttagtttgggatgcangctacatt

SEQ ID NO: 4682 - DNA, 578 bp, Gossypium hirsutum
  Clone ID: uC-gsronu33B157e03b1
aaattttataatcaaaatgtcactgttgagtgttgaaatttagttaaaacaacaccccccttaattgttccatctatcaaatgctttcttctttcaaatcctgggttttcagcagctactagtctgccactgctccctcatgggattgagatgtgtgctaatttacttgcagcattttgttttacttacaacagggttaactaaaggagctttgtgcggtaaagcacatggtctaattaacaagtaactatcatttgaaggaagggagcttttacctatgttggtgcttcatctgtacattttagggaattagtgatcaaaacgaggtgtaaagttttactattgcttacatttcccatcatactttttccattttttgctctggcttctttattcatggtccgtggaagctgagcaacagaacacagcaaagaaacagttgattagaagtttggcagagatgagatgagtttatctaggcctatatcagggccttagggtacacgtatccagtagcttgtcacccagcattcatcgtccactacattcagtaataatcacatgactgttcacaagct

SEQ ID NO: 4683 - DNA, 567 bp, Gossypium hirsutum
  Clone ID: uC-gsronu33B157e04b1
cttagttatgcgacaacctcagacagaagagcaagccaaggcttgtgctgattcttcagagtctgcaaagaaagatgaaataaatggcagggatacttgttccaccacagaaaagtccagttccttgcctctagaatccacttccactcaagtggtacatgttcaggtaccttttgagacacaatccaccttagtaatcaatggctccaatgttggcctggagcatgcatcccctgatactagcatgtcatctttgggacgtgcatttgatagatctccgtcaaccgaggaaacagtgagcacatcctgtgctcgaactgatacatcagcaagtacccaaagttcatctgatgctgacatgtcaggtagcacaaaagccactgtaacagttatacggaacccctctaataacatcatggatggtttgatgcgtcgctgggatcttaacttctttcgaaacagtcgatgaaaggtaagatgagcttgtttgagctgccttgggattgaattatttttggaactaagtataggatccgtagctttgaaaatgttacaaaaaaggggggg

SEQ ID NO: 4684 - DNA, 255 bp, Gossypium hirsutum
  Clone ID: uC-gsronu33B157e09b1
gctgatccattgcttccctgtttcctgtaagcaaaaaagagagaaaatgaaggttgttgctgcttatttgttggctgtacttggaggcaatgcctctccttcagctgatgatcttaagaacattcttgccagcgttggagctgacgctgaagaggaaaggctccagcttcttttatctgaagcgaacggaaaagatataaccgagcttattgcatctgatagggaaacgcttgcctctgttcccagctctctttg

SEQ ID NO: 4685 - DNA, 123 bp, Gossypium hirsutum
  Clone ID: uC-gsronu33B157e10b1
cggatgcgtgcgcaagcaaatcgaacgcgtcaatcatatatctacgaaaccgaaagactaccgagacacacttataacatagaaaaagaaaagctcaagagagaagaccaagaccgatcaatt

SEQ ID NO: 4686 - DNA, 645 bp, Gossypium hirsutum
  unsure (1)..(645): unsure at all n locations
  Clone ID: uC-gsronu33B157e12b1
cccactcgtccggagacttgctaccagattgccttggccatcaaggacgaagtggaggatcttgagaaggccggtatcaatgttatccaaattgacgaggctgctttgagagaggggttgcctcttagaaagtcggagcacgccttctacttgaaatgggctgtccactccttcagaatcaccaactgtggtgtacaggacactacccagatccacactcatatgtgctactccaacttcaatgacatcatccactcaattatcgacatggatgctgatgtgataaccatcgagaactcacgttcagatgaaaagctcctttctgtattccgtgaaggagtgaagtatggtgctggaatcggccctggtgtctatgacatccactctcccagaataccatcaaccgaagagattgctgaccgaattaacaagatgcttgctgtgcttgagacaaacatcttgtgggttaacccagactgtggtctcaagactcgcangtatgccgaggtgaagccagcccttgacaacatggttgcagctgccaagctgctccgcacccaacttgcgagtgccaagtgagaggcatatccaaggtcggacatcatcctttatatcgaagatgatccagaggaaattgtcttaaat

SEQ ID NO: 4687 - DNA, 100 bp, Gossypium hirsutum
  Clone ID: uC-gsronu33B157f01b1
aattggcggggacgacacacgccgcgttattattaaactttaaaaggaaggacggaaagggagtatattggggctgcgagcttacctatcaaagataacg

SEQ ID NO: 4688 - DNA, 592 bp, Gossypium hirsutum
  unsure (1)..(592): unsure at all n locations
  Clone ID: uC-gsronu33B157f03b1
gttttgttttaccggtcggattcatgatcttgtgattgaatgcgacatgatcggggtaaatgatccgtgtcttgtgattcgtgtggacggcaagagtttgatgcaagtgaagcggctacgatggaagtttcgagggaattatactattttggttgatgggatggctgttgaagtttattgggatgttcataattggctcttcggatcatcggtcgggaatgctgtttttatgttcaaggcattgccttcatcggaggagaagttgtggattagccaatcgatcactaatccgagtacgttgcaatggtctttctcacaacggtttcaagattcgaagacacgaaatctcggcttttcattggttttgtatgcttggaagaatgagtagaaaaacagactatagattcttcttcaactctctcaaaagtgctaacaaaaaaaaacttttattgagtggtgatgtttatatacacttatgatcaaagttcgattaattcgactgaaaaatcgatccatttgnttttctttttcgtgttcttagtctgctgtatatccttgatacattagtttaattatcgatatctgttatatg

SEQ ID NO: 4689 - DNA, 513 bp, Gossypium hirsutum
  Clone ID: uC-gsronu33B157f04b1
catgttttttgctcttgtttactgcactgctggtatctcaggtggtcatatcaatccagcggtgacatttgggctgttcttgggtaggaaattgtcgtggacaagggcaatatactacatggtgatgcagtgcttgggagccatatgtggggctggagaggttaaagggttcatggggaagacaaggtatggcgctttggatggcggagctaactctgcgaatcatggctacaccaagggagatgggctcggtgctgaaattgttgccacctttgtgctcgtttacactgtgttctcagccactgatgccaagcgcagctccatagactctgacggtcctattctggcaccattgccaattgcgttcgcagcgttcttggtgcacttagccaccatgccaatcgctggaaccggtgttaacccagctcgtattctcggtgcagccatcattttcaacaaggacaagggctgcgatgaccattgaattttctgggtgggtccattcataggagc

SEQ ID NO: 4690 - DNA, 580 bp, Gossypium hirsutum
  Clone ID: uC-gsronu33B157f07b1
ccttttcgtccgtgcgtaattgaatcgaatattcatactgtctcccttccctttcttctacctccaattcatatcttgctctgcaaatcctcagttttaacaatttttctgagattcaaagccaaacacaaatcataattcggaaggcagagaaaggagaagggaaaccatgataacgcgatcgaatttagctgagcaattgagagagtatcagcttcgatctaagcacgattgggcttccgtttcgtttttctcatccacgtctaatctatcatcttacagggtggatgttatggtctttgtgatatgggaacttgtcattttagctttcctggttttttcagctgtttctttgtattttgggcatatgcagcttgcctttatcctagtatgcatcacaatgctattgcttctctgcatgaaaatcacaaagcaagtaaagttggccaggaaaaagaaaagaaggatgcttcttccattatctatttagagctacttgaagcttggattagtttaaaagggaccaaatttcgtggtgcaaatttgagatttattgatcattgcattagggccacacatg

SEQ ID NO: 4691 - DNA, 476 bp, Gossypium hirsutum
  Clone ID: uC-gsronu33B157f08b1
cggtctcgtgggcggacgcgtgggaaaaaaaatatatagcaaaagacacttcactcaaaaaaacagaagacaaaagcgaaaccaaaagtcgagatccccaaattttggttacagtgaaatgcgaagatccatcggttcaatggcgcaacttgaagaaatagatgaatcgaagaataagaacactaagcagcagaaacgaaatcatggatcaaccatgtttttcgtaatggtggactaccttttcctgctcatcttcttcggtttcctcgttttcattctctttaagatacttcatttcttctgattattcttcttcaggttactcttttatttcttttatcaattacccttgtttttcgccatttcaattcaacaaaaaatgtattgtacttcttttcgtgatctttttgcctgcacattcaattaactgcaactctgtcactctttcatgctgaaaatagaagagctaaaatgat

SEQ ID NO: 4692 - DNA, 558 bp, Gossypium hirsutum
  Clone ID: uC-gsronu33B157f09b1
cccactcgtccggttttccttgttctcttctacattcagcaaaggggggctctgagatcacataccaaaatggtgaaagccgttgccgtccttagcagcaatgaaggtgttagcggaactgttttcttctcccaagaaggagatggtccaactaccgtgactgggaacctttctggtcttaaggccggactccatggcttccatgttcatgcccttggggacataactaacgggtgcatgtcaactggaccccattttaatcctgctggcaaagagcatggtgctcccgaagatgagaaccgccatgctggtgatctaggaaatgtcactgttggtgatgatggctgtgctagcttctccatcaccgacaaacagattccactcacaggcccaaactccattatcggaagagctgtagttgtccatgcagatcccgatgaccttggcaagggcggccatgagctcagcaaaagcacaggaaatgctggcggcagagtagcttgcggtattattggtctgcaaggctaaatccgagccaaatgcgtttgaggatgcaat

SEQ ID NO: 4693 - DNA, 528 bp, Gossypium hirsutum
  Clone ID: uC-gsronu33B157f10b1
cccactcgtgcgctcgcagaatagcacgctctcatcattttcctacgggaccgacagtctccccaaacaccttctttccgagaaaaagaaaagctcaagagagaagaccatggccgatcaacttacggacgatcagatctctgagttcaaggaggctttcagcctttttgacaaggatggcgatggttgcattactaccaaggagctggggactgtgatgcgatcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagaagaggaagttgatgagatgatccgcgaagctgatgttgatggagaatggcagataaactatga

SEQ ID NO: 4694 - DNA, 656 bp, Gossypium hirsutum
  unsure (1)..(656): unsure at all n locations
  Clone ID: uC-gsronu33B157g07b1
gcagatcaacgggcaaaaaccaattaaacccgcacttaggaaataaaaaccataaaggaaaagagagtaaaaccaccttaagccaaaataaacaaagcagaaaccaacaaaatatcagccaagtagcttccatatcctatgaaaggatgaccaaaatgtgaaccagaggaaacccaaaagctttgagtccagccatggagattccaagaaccttctccattttcaaagccttctacgacaagctgtgatgacttcgttagcaaattctttgatcccttgctatcaacatcttgacagaaaccgaaacctcatcgacccaaaatccagaccgctgtcttctccttccttccatcgccagggtatgggccactccattaactaaacgggaagaaacaggtaacatatttcgtcaaaacacttttccaagttacacatttggtgaatattggtcagataaccctctcttctcctgctccttttaaatcttcttctttgtcaccatctttgccatcatctctagtctcatcctcctcttactctccaccacttncaccaccatcatcattgtaatcatcatcatcatcatcatcatcatcatcatcatcatcatcatcatcatcatcatcatcatcatcatcatcatcataccatcacca

SEQ ID NO: 4695 - DNA, 259 bp, Gossypium hirsutum
  unsure (1)..(259): unsure at all n locations
  Clone ID: uC-gsronu33B157g08b1
atngtaanccggcaaagagggatcataatgccatcaaaaaagacaacatctaagactccagcaccagctccaaagactggagcagctcctgcaaagaagacaagcaccaataagaatgcagctctctttgaaaaaagacccagagttttcagcattggtggaaacttgagaccaaagtctgatttgacaagatttgtttgatggccaagacacgtcaaatttcaaagtcagatgagattcttgtttgcaaagacttaag

SEQ ID NO: 4696 - DNA, 170 bp, Gossypium hirsutum
  Clone ID: uC-gsronu33B157g10b1
cggactcgtggggccgcacgtcaaccgtactgattaccaattgatcgacatttctgaggatggattcgtgagcttgctgactgagagcggagacactaaggatgatctgaggttcccaacctgatgaaaacttgatgaaacagatcaaggacggtttcgctgaggggaaa

SEQ ID NO: 4697 - DNA, 122 bp, Gossypium hirsutum
  Clone ID: uC-gsronu33B157g12b1
gttatctagctaattttcctttgatggacttaagaccaggagctaaaggtacttgactattcgcgattagtcgacacattgtggtgactgcagatggagctggaattactgatcgtgaatac

SEQ ID NO: 4698 - DNA, 180 bp, Gossypium hirsutum
  Clone ID: uC-gsronu33B157h04b1
accgaatgccggcattttcgatgctcaattgcaatcgagtctagactatgcatgtggccaaggcatcgattgcagtccgatccaaccgggaggtgcctgttacgaaccgaacaccatagcgtttcacgctgcttatgccattgaacctttactacccgctgttcctgtcaagaatcatgt

SEQ ID NO: 4699 - DNA, 455 bp, Gossypium hirsutum
  Clone ID: uC-gsronu33B157h05b1
agaaactggtggtgaacggaagagatagccggagagggtgaaaaatgtcacaagcatacgggataatatcacggcctagagagcagtgaagaaggcttatggattacaacgagcgaatgaataagtacatgaaggagagatggtctaggcgacgccttcaagcagatgaatttttgggtggattgttgcaaacagagtgggtcaaatgaatccgagaaatttgaccacattgacccaaacccaaaccctaactcgctttccctttgattttatgctgacactgactcattgagtccaaaaatccaccagcttctttcttgataagccatgaaccgttttagggtaactgacatcttagacccttactctacctttctctgtgttaaagaaaacttcattttcgctaacaagcccttagcttttccctcatttttttgaagcataacaatgaactt

SEQ ID NO: 4700 - DNA, 148 bp, Gossypium hirsutum
  Clone ID: uC-gsronu33B157h06b1
cccacgtgatcgtgacagagaatttggaccaaggcttaaggagcacatgcaatattgtatgaaccatccagaagaaatgagtaagctctcgaagttaaaagctcaaatcactgaggtgaaggggattatgatggataacattgagaag

SEQ ID NO: 4701 - DNA, 52 bp, Gossypium hirsutum
  Clone ID: uC-gsronu33B157h08b1
tgagtgggtgatgcaaatggaaaactaaggattaagttgcaattgagagaag

SEQ ID NO: 4702 - DNA, 262 bp, Gossypium hirsutum
  Clone ID: uC-gsronu33B157h09b1
atcgtcatagatcaagatccttctctgcggttgcgtcgtgttaagtctactcgcaatcgcgaaccgaaaccgcgacagttcttcgtttatgggatggaccggtgactttgaccgctcttcttctccaaggggaagatactcgattgtaatgaatacttggaaaatgatatgatcttttgaagaagccgatttcccactacacgttatgtccgaggcttgattctgtacatattgtatggtgtgagctgtatcctccatcttg

SEQ ID NO: 4703 - DNA, 113 bp, Gossypium hirsutum
  Clone ID: uC-gsronu33B157h10b1
cccatgcgtccgtccagagattgctcacatgtacaagactgatcgggccaagtacgaagctactgcacgcagctggacccagaagtatgcaatgggttgatgaagatgatggt

SEQ ID NO: 4704 - DNA, 427 bp, Gossypium hirsutum
  Clone ID: uC-gsronu33B158a01b2
cccatgtgtccgcccacgcgtccgggttactattgggattttattaagaatttctctatgggttcttcaccgctgattagattgttactgaaaaatgttgagtttgtttaatcagacaagtgccaacagaattttgatcagttgaaaaatatattgacagaagcccctgtactaactcagcctgaatccggaaaatagtatgttgtttatagtgatgcgtcacttagtggcttaggttgtgttttgatgcaagctggaaaggttgtagcttatgcttcttaatagttaaaaccacacgagagaaattacttgacacgatctcgaattggccgcggttattttcactttgaagatttggccacattacttgtatggtgagagatgtcacgtttactctgatcattaaagccttatgcatttgatgact

SEQ ID NO: 4705 - DNA, 530 bp, Gossypium hirsutum
  Clone ID: uC-gsronu33B158a03b2
cccacgcgtccgggaagcctcatcttcacaccatgggggggcaatcctcttcattgggcggacttcacaaatagccttaaccttagcttatccaccatttctcaacgatagaaacattgaatacatcaaatcttcatgcagcaccacaacatatcccaaattatgttaccagtccctctcagtctatgcgagcagcatcagcaccagccccaaattgttagtccacactgcactcaatgtaactcttagagccagcaaagcgacttcgaggttgatggtaaagatctcgagattccacggtttggaaccaagggtagctgccgccatggctgattgtatcgaggtgatcggggactcggtggatgagctgcaacagtcgttaggggaacttggtcacattagtcgctcgaacatttcacttacgatgagcgatgttcaaacatgggttagtgcggcactgacagatgaggatacttgtatggatggatttgctgggaacaacatgaatggatatgcaaagacaatggcga

SEQ ID NO: 4706 - DNA, 346 bp, Gossypium hirsutum
  Clone ID: uC-gsronu33B158a04b2
cccattcttacgcccacgcgtccgctgaatcaggacatggaggcaaatgtagatcaagggggtcttgtgatccatgcaactgttgaaaagcttgatgaaagccctagattatgaaaaaagaaagcagcaaaataacaggcctctgtaatgatttattttcaaggatgaatgcctgcaagggctatgactataattatgtctctggctgcggcttgggtaatagaagctttgtttgtggtgaaaataatgtataagccagttggctgggagcacatttttcttttgtccaaagggattttctgctgctcatctcatggggacttcggtttatggtttttatctggtg

SEQ ID NO: 4707 - DNA, 365 bp, Gossypium hirsutum
  Clone ID: uC-gsronu33B158a06b2
cccacctttccggcctgactaccatgatttagggaggggggttcttttatacctttgggggcgtgaaagcgaatattcaggacaaagaaggaattccaccagatcagcaacaggtgattcttgctgggaaacagctggaagatggaacgactttggctgattacaatattcaaaaggagtccactcttcaccttggtcttcgtcttcgtggggggttctaagccttaagggcttccttaatgggggttttctggttttacctgaaggattgggccctttgatggccttttaaataatttctaggctttggttaccgggtgcatctatgtatgggttcttttttgatggaatttgcatatttacct

SEQ ID NO: 4708 - DNA, 210 bp, Gossypium hirsutum
  Clone ID: uC-gsronu33B158a07b2
gtgaaataaaaacagtttcatttccattctaagggggtgttttttatttgcctttggggggttttatataaaaaaaattcagcaaaaatgtttattgagagtttcaaggtagagagccccaatgtgaagtacacggagaatgaaaattagtctgacacacctatgaaactacagagctcgatcatgagaacaaaaatggaacctatcaat

SEQ ID NO: 4709 - DNA, 524 bp, Gossypium hirsutum
  Clone ID: uC-gsronu33B158a08b2
gcctatgactgtagagtccacaacacaagctctgtgggacctggcccttcgatttggtgaaggagatgaagaatccatgtcccgtccatttggggtgtctcttctcattgctggtcatgatgagaatgggcctagcttatactatactgatccctctggcacattttggcaatgcaatggaaaagctataggctcaggttccgaaggtgcagacagctctttacaagagcaatacaacaaggacctgactcttcaagaagctgaaactattgctctgtccattttaaagcaagtaatggaagagaaggtgactcccaacaatgttgatattgccaaagtagcaccaacataccacctatacaccccttcagaggtggaagctgtcattactcgcctatgagaatgcgctgccatcataagatcttaccatgcaacaacctgctttaccgtcataatgatacatgacttgagggggagaagcttgtatttgtttcttgggattcacgctgggaaacgttattttg

SEQ ID NO: 4710 - DNA, 362 bp, Gossypium hirsutum
  Clone ID: uC-gsronu33B158a12b2
cccttgcgtccggtaagaccattactttagaaggggggagctcggatacgattgatggcgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgtggtgggttctaagccttaaggtcttccttaatgtgggttttctggttttacgtgaaggattgtgccctttgatggccttttaaataatttctagtctttgtttaccggttgcatctatgtatggtttctctttgaatggaatttgcatatttacct

SEQ ID NO: 4711 - DNA, 497 bp, Gossypium hirsutum
  Clone ID: uC-gsronu33B158b01b2
tgaatcttttatttttctctcaaactcccttctgccaaaatctagactccggcatcagaccaccatggcagccgtctgttgccggcgacggagccgctgtccgtggttgccaaaaaacaaaaagtctcattttttggggttttttggcttcccgagtctaaagacgccatctttcatcggagatggtaacctcggccccccttttcacaacgatataactgaaaaggtaagatttttttttcgtttgtttctttaaaaaataaacaaaataaaaaaaaagatgaaaagggaaaacagaaaaataaaccgcctttagaaaatttatattattttgattgctatctctgtgtattcgtctgtaaaaaatttacatcgattcttgtggctttttatagccgaaaaataaatacaaaggttcttttttttccatattttctgggttgttgcgttcttgtccttcttgcaagtaccgtgattgcgacttggagtgcggtggt

SEQ ID NO: 4712 - DNA, 82 bp, Gossypium hirsutum
  Clone ID: uC-gsronu33B158b02b2
cccacgtgtccgctaaggcatacaagacccttgttggattgaagggtgttaccgcttacggtttggatttggttcggggaac

SEQ ID NO: 4713 - DNA, 489 bp, Gossypium hirsutum
  Clone ID: uC-gsronu33B158b03b2
gattttatggtgatcaccatcgacgaccccccagaaaactgtttagatttcagtgtgttatcagaggcaaatgagaatgagatccctcaagttaccattcaccccgatgaccctgttgctttgcccttctcttcgggaacaacagggttacccaaaggagtcgttttaacgcacaaaagcttgatcacaagcgtcgctcagcaagtggatggagagaacccaaatctttatttaacacatgaagatgttgtcttgtgtgtcttgcctttattccacatttactcactcaacagcgtgctcttgtgttccttgagggctggagctgcggttctgttaatgcagaagtttgagatagggacgttattggagctgatacagaggcataaagtttcggtggcagcggtggtgccgccgttggtgttgttgttggctaagaatccggtggtcgtccagtttgattgagcttcatcagggtggtgctttcagggg

SEQ ID NO: 4714 - DNA, 512 bp, Gossypium hirsutum
  Clone ID: uC-gsronu33B158b05b2
cttgaaccttattttcctctttcaattgaaggtggtagcggattgcgtagcctttcaatcttttctgccttaggaacccgagttgttacagacaagtctctgcatcaattgtttgaaaaatctccgtgcctaagggtgctagatttgggcatgaataattcatgtgatgatttgattcccgagatttcaagcaaaataggtgatttgatacatttaaggcatctcaacttattttgttgcaagatgatacatagattacctgatacaatctgccaattgcatgatttgttatccttggatcttcatggatgcagtcgtcttggaaaactaccggatggtctggggaacttgatcaatttgaggtatctttgtactacagattgttccagtctaacttactaccccaaagggattgggaaattaacatctctaaggactctaacagatatcattgcaagagcggattgcgatgatcctaaagtgttctgcattggagatctcgaaaacttgga

SEQ ID NO: 4715 - DNA, 301 bp, Gossypium hirsutum
  Clone ID: uC-gsronu33B158b06b2
cccatgtttccggttgaatatcgcaatgatggtggagccgtggtccctatacgtgttcacgctgttcttatttcaacccaacatgatgagaccgataccaatgagaagattgcagctgatttgaaagagcatgtcattaagcctgtcattccagcaaagtatctcgatgacaaaactattttccacctcaacccatccggtaggtatgttattggtggacctcatggagatgcaggactaactggtcgaaagattatcattgatacctatggtcgctgttacgctcatggtggtggtgctt

SEQ ID NO: 4716 - DNA, 525 bp, Gossypium hirsutum
  Clone ID: uC-gsronu33B158b07b2
ttctgcttttgcaggttttgcagttagtcaaaatatggggttaagttcttacctatggaatgcactcccttttatggcaacgattacagtggaatgcacagatgtgggtatatcagtgataagtaaagcagctttgagtaaaggaatgagcaacgttgtttcagttacttatttcaatgctttgggtactttgatccttcttccatactacatttttttcagagataagcaagctcctttgactttctcactgctttggagattcttcctcttaggcttgatagggtttaatttcatataactataattattttttaatttcttcaggaattttgtttcctatttttgagaaataaatttgtgacagctgacatatttgttcattaattttcagaagctcaggacagattatatttcttactggagtcaaattcagctcccctactctctcatcagctttagtaaaccttatccccatttttactttcctgcttgcggtcatattaggatggaaaagttagaaat

SEQ ID NO: 4717 - DNA, 467 bp, Gossypium hirsutum
  unsure (1)..(467): unsure at all n locations
  Clone ID: uC-gsronu33B158b09b2
cccacgcgtccggatacagccccatcaaaaagcttgactgcccttatccttgcaaccctacctgcccaaaagttgactctgattcataaatcctatacatataattatggactacagtttatttattagatggatattagtccattgtttatgtctatttatccatctataaatctctcttgttgttttattttaataaagaagcgtatgatcttggaaacaaataaagttgcttgagcttgtatcattaccactagattgtagtggtatttttatttatgagatgtttccgtaattttcaattccagtgaataagttaattaagattttgtcaaanaaaaaaaaaaaaaaaaaaaaaaaaaaaaaaaaaaataaaaaaaaaaaaaaataaacaaaaaaaaatactatccctcttattatataattaaattttattatttttcttttttaaaaaaggggcgcccttt

SEQ ID NO: 4718 - DNA, 500 bp, Gossypium hirsutum
  Clone ID: uC-gsronu33B158b10b2
tccacgcgtccggtttaaagttgttttataaaaaaaataaattgcaaaagagaagggaaatgagagttttcagttggtacatgtgatgcaaacaaagaagatcatataacaaggaatttaacagttaagtgaattaaatgaaaacttagttttatgaaaattttgtaattttttaaagttaagtgatcaaaacttaaatatactaatagtttagtggcattaggtgtagtttacccaaaaaaaagaaaaatatcttatcgatttttcacctaaaagctatactcgcttttttccgttcctcttcctcttcttgtttcattgtcagaagcttcaatcaaaagaacaaagaagcagtgagagatgcatctatggccatcagttagactaagggattcattcaaaatcgcttatttaagaaaactagaatggaacctccatcgaatgaaatcagagaaacaatcttcttctttttccccgaggattccaagcaaccacaaaat

SEQ ID NO: 4719 - DNA, 470 bp, Gossypium hirsutum
  Clone ID: uC-gsronu33B158b11b2
tccacgcgtccgcccacgcgtccgcagccgtcacctggggtttggccatcggaggaaacatcaccatcttgaccggccttttctactgggttgcccaatgccttggctcaattgttgcttgccttcttctccagtttgttaccaacggattgagtgtaccaacccacagcgttgcttcaggaatgaatgccgtcggaggcgttgtaatggagatcgtaatcactttcgccttagtctacaccgtctacgccaccgcagctgatcccaaaaagggttctctaggaatcatagcacccatcgccattggtttcatcgttggtgctaacatcttagccgctggtccattcagtggtggttcaatgaacccagctcgttcttttggaccagccgtagtcagtgggaactttgctgataattggatctattgggttggtccattggttgggtggtgggttagctgggttgatttt

SEQ ID NO: 4720 - DNA, 216 bp, Gossypium hirsutum
  Clone ID: uC-gsronu33B158b12b2
gaatataaagccgacgttcttggccaccccaattggtgttaacgggtcgtattatttgggtgacaatagtgaaaagcgatgttgctgtagtgatcaaaagggagaggaaggcaagcaagatgagaaagaggtctgccgtggttgtgatggtggtggtgacggtggagctgaaactacggtgacccaacaatcttcaagtgatgatcattgattttg

SEQ ID NO: 4721 - DNA, 527 bp, Gossypium hirsutum
  Clone ID: uC-gsronu33B158c01b2
cggacttttgggttcttcactttgatttgtcattctaaaaagcaacaaaagtataggatacccttttttttccttcctctttttatctctctccctctctatatattttgcacccaccatttgttttgctttagattctcgattctcatgttcatctttgaggatatattgccgctgctccgccttgatcgtttgaggtcgaagagtaggcttttcccagagtcctttttgcaaacaataaccgattcaatgagcaacacgagctgccaatcctcggagctagagatttgccgtgacgaatcagcggcgttgaagttaaagctgatagctatagcctcaatcctcctcgccggtgtggccggggtcgctattccactcatcgggaagcaccgtaagttcctccgtacagatgggagcctttttgtcgccgctaaggcctttgctgccggcgtgattctggccacgggcttcgtccacatgctcgccggtggtaccgaagctctcacaaatccttgcttgccggaata

SEQ ID NO: 4722 - DNA, 532 bp, Gossypium hirsutum
  Clone ID: uC-gsronu33B158c04b2
atcgactttacagacacatttgactacgatttggcaagcgagaaatcccaatcgaaccttaggaatagattaggatacaagtgacatgtcactaatgttttatgttatgtgatccagatgctggtcctgtatgttctaccggtggatgaatataccggcatatgttgcggttacttgacatcttatgtgagtagcaccgtgtagctatgtctcgactgacagcttctgtgagcaggcccgttaatggctcgagagcgagcatatatatgttatgagataaagcgtcaccaagctagctcggtttggagattgtcggagatggtatcacactattaaactattattttgggtactgatgattttaaacattttaagaatatggcatgtatagagatttggtaattttgttatatgtgtcattatgaatttagccaaatgtattaacttgtaattgtcaaaggctcgatgtggtatttggccatgtaacttggcttattttggttgattggttgtaagttatatatatttatat

SEQ ID NO: 4723 - DNA, 380 bp, Gossypium hirsutum
  Clone ID: uC-gsronu33B158c05b2
cccactcgtccgcccacgcgtccggttcgttggcctgacgtcatcatctctgcctcctggggtctatcggtcgaccgtcgtccttaccaagtctgtattttgaagtaaccctaaaaaattagcagccacagtcctattaaggttgctggttatgctgttggaggagggcatgttttacatatggtttgtgatctgaccattgctgcggataatgctattttcggtcaaactggtcccaaggtgggaagttttgatgctggttatggaagttacataatgtcccgtttggaagatggtggaaatgcgacacccatattttatggaactgaagaagggaaacgaggggaaaatagcatatggggtgaatagacgctcagatt

SEQ ID NO: 4724 - DNA, 529 bp, Gossypium hirsutum
  Clone ID: uC-gsronu33B158c07b2
ttcttttggcggtggtgcaaacacggtggcttctggctacaacaacggaactgctttgggagctgagattattggaactttcgtacttgtctacactgttttctcagccaccgaccccaagagaagtgctcgtgactcccacgtccctgtattggctccccttccaatagggttcgcagtgttcatggttcacttggctaccatccccatcaccggtactggtattaaccctgcaaggagtttcggtgctgctgtaatctacaacaacgacaaagcctgggatgaccactggattttctgggttggtccatttgttggagcacttgcagcagctatatatcatcagtacatccttagagcagcagctatcaaagctttgggatccttccgcagcaaccccaccaactaaaaaaaaatcaacccaaatagctttgtctccacttcactctttttctattttctccatttgttcgtttgtgtgtatgagaagattattattatgaatgatgatgatgaccctctccatgat

SEQ ID NO: 4725 - DNA, 475 bp, Gossypium hirsutum
  Clone ID: uC-gsronu33B158c09b2
tttttgctcaagagcaaggctgctttgaaggattttgcagtgctgatatagaaaaatgctgtggagcaataaaaaatattaagcctgaaactcgagaagaggatcatatgccatctgtttcacgtggacttgacttaaatgttgtctcagtacctgatctaaatgaagaactaactcctccatttgaatcctcgagggatgaagataatggttgcactttagagctggctgtggaggcggatgacgatgctgcttcgcttgaaatagagaagaacaggctagcaagatcacatggtagtggagattcccagacctggactaatggggcgacaggggaagtgcctgctgtggattctataccgagttgtgcaggataagagcagcatactcaaatgaagagacacatgactgtgatagtactcttattaatggctcgccattccgaatcaccaatgattcaggttccttggatgag

SEQ ID NO: 4726 - DNA, 504 bp, Gossypium hirsutum
  Clone ID: uC-gsronu33B158c10b2
cttttgcgtccgattctctgatgaagattcttactgagagaggttatatgttcaccaccactgctgaacgggaaattgtccgtgacatgaaggagaagcttgcctatgttgccctggactatgagcaggaactggagactgccaagagcagctcttctgttgagaagaactatgagttgcctgatggacaagtaattactattggagctgagagattccgttgtccagaagtcctcttccagccatctctcattggaatggaagctgctggaatccatgaaactacctacaactctatcatgaagtgtgatgtggatatcaggaaggatctctatggtaacattgtgctcagtggtggttcaactatgttccctggtattgcagaccgtatgagcaaggagatcactgctcttgctccaagcagcatgaagatcaaggttgttgcacccccagagagaaagtacagtgtctggatggaggatctatcttggcatactcagcacc

SEQ ID NO: 4727 - DNA, 523 bp, Gossypium hirsutum
  unsure (1)..(523): unsure at all n locations
  Clone ID: uC-gsronu33B158d01b2
ccctcttgtccgcccacgcgtccgcccacgcgtccggtcaaagacggtcaatggttgagaatcccaccgtcgaaaaacaacaccatattcgtcaacaccggcgaccaaatcgaagtgattagcaatgggaagtacaagagtgtgttgcatcgtgtaatggctgagaaacaagggaataggctttccattgctacgttttataaccctggtaatgatgctgtgatttcgccggcaccggaattgttgtacccgggcaattaccagtttggggattacttgaaactatattcgactacaaagtttttggagaaaggaccaaggtttgaatcgatgaagacgacgatggttaatggtcaccatggttgaaaaaagcagtgatttgcatggcctcaaagtgggtttttttttttaaatacagttttatatatgtttttatgagttatgttgctttgtttcctatctaaaaatattngtatttgtattctcttttttttttaatggaaacagcttttttttatatctt

SEQ ID NO: 4728 - DNA, 521 bp, Gossypium hirsutum
  Clone ID: uC-gsronu33B158d02b2
ctttttcttatcacccttagccaccaccacaactcttgggttgtttttctttttccttttgttgaagctttaaaaaaaatgctgacagtggaggaagttcgtaaggcacaacgagccgaagggccggccaccgtgttggcgatcggtacgtcgactccacccaattgtgtggatcagagcacgtaccctgattactatttccgtatcacaaatagtgagcacaagactgagctgaaagagaaattcaagcgcatgtgcgaaaaatcaatgatcaaaaagcgttacatgtatctaacggaagagattttgaaagagaaccccaatgtatgtgaatacatggcaccatcactagatgcaagacaagatatggtggtagttgaggtaccaaagctaggtaaagaagccgtcacataggctattaaggaatggggtcagcccaaattcaagatcacccacctcgtgttttgcaccaccagtggtgttgacatgcccggtgcctattaccagcttactaagctttg

SEQ ID NO: 4729 - DNA, 526 bp, Gossypium hirsutum
  unsure (1)..(526): unsure at all n locations
  Clone ID: uC-gsronu33B158d03b2
agaaatcnctcaacagtttgtattctacttaacttattgtacaacttgctaaactttgaaaattgaaaagtatttggtcctaatctgcaattttccattaagcacaacaactgcaacaaaaatacgtggtcaatttggctttgagaaaatagagattcagatccaggaagagaaacaaggaaagaaaaaaacgaaacagatgggaatcagattcatattaatggtgaacaagcaagggcagactcgtcttgcccaatactatgaatggctcaccctcgaagaacgacgtgccctcgaaggcgagatcgtccgcaagtgcttagcccgcaacgagcaacagtgttcatttgttgagcatcggaattacaaaattgtatacaggcgttacgctttgctgtttttcttagttggagttgacaatgatgaaaatgagcttgcaatattggaatttatacatcttttggttgaaaccatggaccgtcattttggcaatgcgtgtgagctagatatcatgtttcacttagag

SEQ ID NO: 4730 - DNA, 496 bp, Gossypium hirsutum
  Clone ID: uC-gsronu33B158d04b2
gcttgtgctcaactcgtgtccatcgcgtggctttcctgggttcatttcttcacactctgcgacgaaagaaaccagagaaaaatgaccaagtgttacccaaccgttagcgaggagtaccaaaacgccgttcaaaaggctaagaggaagctaagaggtctcatcgctgagaagaactgtgctccactcatgctccgtctagcgtggcactcagctggaacttttgatgtcaagaccaagaccggaggtccattcggaaccatgaagcaacctgctgagctcgctcatgctgctaacaacggtctcgatattgcagtcaggcttctcgagccgatcaaggagcagttccctatcctttcatacgctgacttctatcagcttgctggtgttgttgctgttgagatcaccggtgggcctgaaattccatttcatcctggaagagtggacaagcctcacccaccacctgagggtcgtcttccaatgctactgagggagctga

SEQ ID NO: 4731 - DNA, 513 bp, Gossypium hirsutum
  Clone ID: uC-gsronu33B158d05b2
acagtttcaaatgttgaaggggatgctttgtatgcattgaggagaagtgttaaagaccctaaaaatgtgctcaagagttgggatccaaccttggtggatccttgtacttggtttcatgttacctgtgatgctgataatcgtgttactcgtctagatcttggaaatgcaaaattgaagggcagattggtacctcagttgggaaagcttgaacgtcttcaatatttagagctgtatatgaacaacttggagggttccataccagaagaaattggagggttaaaaagcttagtgagtttggatctttacaataataaccttactggatctattcctgcttctctttccaagctctccaatcttaatttcctccgattgaatggtaatagactgacgggaagaattcccagacaacttaccaagctcccaaatttaaagatctttgatgtctcaaacaatgacttgtgtggtacaatcctcaccacgggttccttctctaagttttcagaggaaagg

SEQ ID NO: 4732 - DNA, 533 bp, Gossypium hirsutum
  Clone ID: uC-gsronu33B158d06b2
cgccacaccattaccaatttcatcatttttatttttcatgtcattttttttgttttttaatctcatcactctttttagagtccttgttgtatacgctttaattaccaactattaggcaatagggtattacataaagctcatgaagaagacattactgttgattttgttaaaggtcacttcagtttttcagccatcatgttcttttcttcttgcattgcccatcctctaatctcaccaaagggttgccaacttcacaaattgctagcagcgtatttaccttgggaaccgcagcggttcttccattctatactcttatggtttttgctccgaaatctgaattgactaaaaagtctatggaaagtagcgtcccttttattgtgctcgggcttctgtatgcatatctgctgtacctgtcatggacgcctgatacattaaagctgatgtttgctagtaaatactggctgccagagctatctggtatggccaaaatgttctccagtgaaatgacattagcttctgcatggattcattta

SEQ ID NO: 4733 - DNA, 522 bp, Gossypium hirsutum
  Clone ID: uC-gsronu33B158d07b2
gtaaattgatgtttgaaatatctttgtatggtggattgaatgctgctgtatatgttgctcattaccgaattagtgctgaaactaagctaattaaatggtggataatttgctgtcgattatgatggaaatgcctattaaatgtttaaaattcctcttatttaattgatggttgctgctgtttaaatgctgtaaattgaagtgtttatatgctgtaaattgaagtgtttaaatgttgtaaattgaagtatttaaatgttgtaaattgaagtgtttaaatgttctttgtttagcattttaagaacttcaaagctcacagatgatttgttatactctatatgagttcattgattctatgtttttgcaattttaggtatgatcatgggtgcagcagcttcaactgacaaggacttgtgcaggtctggagcaagtcaatcaagaagctctgctagaattaaactgacaagtaattgtaggatgcttgtagttgaagtttcttatagggaacatcctggtgtttattcg

SEQ ID NO: 4734 - DNA, 333 bp, Gossypium hirsutum
  Clone ID: uC-gsronu33B158d08b2
ttatagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttctgtccaaaggatttctagctgttcattcatggtgactagatatatggctttatttgtc

SEQ ID NO: 4735 - DNA, 519 bp, Gossypium hirsutum
  Clone ID: uC-gsronu33B158d09b2
gtttcaacttcttcttctacatctcaactcttgcaagattttcttccaaacttccattccagaaaattactgttacattacacacaatcaaaccaatcatcagctcctcctccttaccctcaaaattccagttttgatcacaatgttttgatggttctttcgatcatcctttttgggttaattttttcattggggataaacttaataatgatcagatgtgtgctaaggggctcaaacggggtggattccgactctattcgaaacccttctgctgcaatagtcaacagcggaatcgagacaaaggcaatcaagactttccctgtggtgaattactcggcgcagatgaatctgccagggcaggactccgaatgtctgatatgcctgtcggagtttacggctggcgagcgcctgcggtttctaccgaaatgcaaccatggatttcatgttcgttgtgttgataagtggcttaaatcgcacacatcatgccccaaatgcaggcattgtttgcttgaaacatgc

SEQ ID NO: 4736 - DNA, 526 bp, Gossypium hirsutum
  Clone ID: uC-gsronu33B158d10b2
aaaaacaaactaccttccgggagagaggttggtggccctcctcagcctccaaagccaggtcaagacaagaacattcttgttccttctgcaaatgagcattccaatgctcctgcttcaaaggcacaggtggtaggatggccaccaatacggtcattccggaagaatacgatggcctcaaattcggcgaaaaacagtgaggatgccgctggttgcctctatgtaaaggtgagcatggatggtgcaccatacctgaggaaggttgatctcaagacctacaaaacctataaggaaatctcatcagctttggagaagatgttcacctgttttacacttgggcactgcagctccaatggacttgctgtacgagatggtctgagtgagagtcgtttgatggatcttctccacggatctgagtacgtgctgacttatgaagacaaggacggtgattggatgctggttggagatgttccgtgggagatgctcatcgatacctgtaagagactacggatagtgaaaggttcagagg

SEQ ID NO: 4737 - DNA, 426 bp, Gossypium hirsutum
  Clone ID: uC-gsronu33B158d11b2
cttgagaaggaacccaagttcttgaagaacggtgaggctggtatgattaagatgattgctaccaagcccatggttgtggagaccttctctgagtacccacccctgggtcgttttgctgtgagggacatgcgtcagaccgtggctgttggtgttatcaagagtgtcgagaagaaggacccaaccggtgccaaggtcaccaagtctgctgctaagaagaagtgaagaggccaaaaggttttagcggtgaagcagattgagtgtttttatctttggttatatgtggtttgaagtttttgcctgttttatgtaggatttttaaagtttgagatgctttggtttgccaaggcatcttagtcaagttttgtgtctgatcttgcggaactatactttgttttttctatatattcgtcctggttctttttttct

SEQ ID NO: 4738 - DNA, 449 bp, Gossypium hirsutum
  Clone ID: uC-gsronu33B158d12b2
gccttgcgtgcggtacaatgcggctgcatttattgggttcggaatggaacctcgagcttgtgtcgagatgacctttgcaatcaatgaaacaaagactgctctttccatgattctacaaagatacaccatttctctctcccctgcgtatgttcactcacccggacctggtatcacagttcaaccacaacatgggattcaagttatgctcaattcactgtctaatgatgcttaaactaggcgctggtgatctgtaacgccgtaatcaatgagtaaactctggtgtcggactctagtaatggttgttcagtttgacctgccatgcactttgccaattccccatgttcgcatgtctgtgaatgttaggttgtagaattattagagttctttattttctctaaaatatatgtaaatgcttctattagatccggagatctgatatgagaacatat

SEQ ID NO: 4739 - DNA, 261 bp, Gossypium hirsutum
  Clone ID: uC-gsronu33B158e01b2
cccactcgtccgggtttttatggagttgaatgattatccaggttcaggagctaataatcgtcacactccaaggccacaatttggcagatgtgccgattgttgagtgtagatgtatgttttctcatagtataatcctttaaaaacaatgcttttggtccataatctctcattttattgcttcttaaatttgtttctttgtttcttgtctgttttcagagttgggaagttaatctgtatttagagctattcatagaaaaataa

SEQ ID NO: 4740 - DNA, 255 bp, Gossypium hirsutum
  Clone ID: uC-gsronu33B158e02b2
cggtctcgtgggggcggctgacggcaacgttagggagtccggagtacgtcggcgggggcctcgggaagagttatcttttctgattaacggcctgaccaccctggaaacggatcacccggaggtagggttcagcggccggaagagcaccgtacgtcgcgtggtgtccggagcgcccccgacggaccttgaaaatccggaggaccgagtgccgtccgcgctcggttgtactcataaccgcatcaggtttccaaggtg

SEQ ID NO: 4741 - DNA, 516 bp, Gossypium hirsutum
  unsure (1)..(516): unsure at all n locations
  Clone ID: uC-gsronu33B158e04b2
gattatgaaggggaaataaatgaaggttagggttaaggtgaaagaatgaacagttggtatttgatagagagattgaaaaaccaggggccatggtctttggatactacttcacctgcaaacgcaaatctatgggctaatttcaaacagcggatttctatctttttctctctctctttttatatacgcatatataccccccaattttctttttcctgcttttaccccttcgctttcctggtttctacaacattatgacccctgctctcacactatcatctaaatatctccaatttattttatgtctggcttttctcttattgttttttctacatcttttctgttgattttagtcataaaacagtgatttgccctgtatgcccttagttttaaaaatgcagtaaaatattttaatttttcatttaagaaatacttttatttttttatgaattataataacangtctgtctcgaacaacaagcgactcaaatccaaactacacctagagtaataaacacg

SEQ ID NO: 4742 - DNA, 308 bp, Gossypium hirsutum
  Clone ID: uC-gsronu33B158e06b2
cccactcgtccggttgatggtaatagacagcgacgttgaacggcagtggatgactcaaaagaaagaaagaacgacaagtttattgtagcacaagagaaaaaaagaaaataaattaagcaggaagaataataatggagtggaaggttaagaaaagagacgataataaatgataattagataaaaagaaaaaaggaacaaagaaatggcaaaaaatagttcaaaagtggaagaaagtagtggtaattgtgctgttgtggtggtgctagaggtggttcgatggtggtgaatttgtgattgggtggtggtgg

SEQ ID NO: 4743 - DNA, 524 bp, Gossypium hirsutum
  Clone ID: uC-gsronu33B158e10b2
atcttattgctcgcagggtctggaaagattactatgctaaggtggatgctgtggtgtacctggtagatgcctatgataaagagaggtttgcagaatcaaagaaggaacttgatgcacttctttcagatgagtccctcgccaatgtcccgtttcttattctaggaaacaaaatcgatataccctatgctgcctcggaggatgagttacgttaccatcttgggctcacaaactttaccactggcaagggcaaagtaaacctagcagactcgaatgtccgtccactagaggtatttatgtgcagcattgtccgcaaaatgggatatggtgatggcttcaaatggatgtctcagtatatcaactaaggtaacgatccgtgaaatgcgattgtatgatgttacagccttccaagctctgatcccatctgatcactcctgacttcaggaaaaaaaagggttgtgttcatcaaacctgttgaaccagttcctaagtgggtttttacgtttgatgtatttggttttggatct

SEQ ID NO: 4744 - DNA, 279 bp, Gossypium hirsutum
  Clone ID: uC-gsronu33B158e11b2
gtgatcattgccacaagagaacctactgctccacagggcagcaggcagcatcacatgtctggcgatggcaccggcaccagcgctgaatgtgatcgccaatatgcagcagcagaaccatagggtggttttcgatgtgccaaattcgagggtgggggtcgcccgtgagcgatgttcttaaaaagtgtggggtctttttcttctaacttttgggaaacagtgttggtgttgattaaaagcagaatatatctgattaataatgaaagtcaaatttttgtagtt

SEQ ID NO: 4745 - DNA, 540 bp, Gossypium hirsutum
  unsure (1)..(540): unsure at all n locations
  Clone ID: uC-gsronu33B158f01b2
cccacgcgtccggtcgtgctgttttgagcagggatggtgctgctgaagctctcacctctgatcaccgaccttcaagggaggatgaaagaaacagaattgagactttgggtggctatgtggacttatgccgcggtgtttggaggattcagagttgcctagccgtctccagagggattggagaccatcaccttaaacagtgggtaatagctgagccagagacaaagatcattactatcaaacctgaatacgagttcttaatattagcctctgacggcttgtgggataaggttagtaatcaagaagcagttgacattgctcgtccttcatgtgtnggcatcaataagcaaaatccattgtctgcatgtaaaaagcttgtcaacctttctgttttacgaggctcatctgatgatattagtgtgatgctggttcagctggggcagttttgattctgctagtatctaaatggtgggcaaccattaaattaactcatagaattgactctgcctcctagtttactgatcgtttaggatgggaggagaa

SEQ ID NO: 4746 - DNA, 126 bp, Gossypium hirsutum
  Clone ID: uC-gsronu33B158f02b2
gttaattttacttggtttaattgatattgccattgaaaaaaaaccataaagaatagattaattagcaaatacacagaatgagaaggataaaaacgctgattacatagacacccatggaaaagggag

SEQ ID NO: 4747 - DNA, 407 bp, Gossypium hirsutum
  Clone ID: uC-gsronu33B158f05b2
tgagatgtctccctgtgagaaaatggcatcctaccaaaggttagctttcgcagctttgttcttgatcttgttacccgtagctgttaatggagatttagatgacttatctcctgctctatctcctttctatgataggttgtgtgatgatgttgattgtggaaagggaacatgcaaagcagacataagctaccctttgaactacatctgtgagtgtgatgctggttggaaaagaactcaagatgacagtgatgatgatgatgatcataagtttctgccatgcgttattcccaactgcactcttgactactcttgtcaaccagctccttcttcagtacctcagcgagaagtcccttgcaattcatctttatttgatccttgctattgggcatactgtggagaaggaacct

SEQ ID NO: 4748 - DNA, 541 bp, Gossypium hirsutum
  unsure (1)..(541): unsure at all n locations
  Clone ID: uC-gsronu33B158f07b2
ttgtgactaattctgagaagatgttgaccaatgttatgtcggaaaataattcagatactcctagtcctacactaacttctcaaagaaacacgaatcctttgactattggagctactgttgaattgaagcaaactgaagtagcaacaccatgcacacaacatagactatttcctgtcccagtaccagtgaagggtataagattgaataatccgtgcaatggatataatactataattcctccaatgttttgtgcacggtcaagttcatccatggcgccaagtccaagcacagccaaccaacaggaacctgcctttcatttgaatctgtttcgtcattccagttttgaagctaactcctctggacagttgtatgaccgacttgcctccaatacaaaccagtcaaccagccagctcttgcacanactggaccaaaagttggattcaatcgaggatagaggacatatttctcccaccactgatcagagtgcaagcagcagtttctgtaatggctccttaagccaacttaatggtgttgcatatgg

SEQ ID NO: 4749 - DNA, 449 bp, Gossypium hirsutum
  Clone ID: uC-gsronu33B158f09b2
ttttaataacttagtcatgattttacttaatcaagcatcttaccgaggcctataacaacataaacacaattttaacattttatgtaacaccccttacccgtatccgacgtcggaacaaggtacaaggtattactggacttgagtacttgtaatcatttaaaaccgagacataaaatttcatcaattttaaacttttcaaacatattcaagactatctatattaaatgactttatgcaatagagaccttcaaataacataggtcagtattttaggccaactcctagcaacttaataataattaaacgagtccccatacatgtcaaagacttaaaaatactttaaaatgtttatatatcgatcaatagtttgatagtgtgatttaacctctggcaacctccaagcccaagaaaaaaggaacgaggggaagaatcgacaaggaatccataac

SEQ ID NO: 4750 - DNA, 85 bp, Gossypium hirsutum
  Clone ID: uC-gsronu33B158f10b2
tccattcgtacgttggcttgaaaatgccccgagtgttgtcaggctgtcccctccttgccggtttatctcaaacgtgttgtgcctt

SEQ ID NO: 4751 - DNA, 91 bp, Gossypium hirsutum
  Clone ID: uC-gsronu33B158f11b2
attttgcatgataaaaagtgttggtgggttttgtgggggtgaaacctcttgtatatatgtatttattatatatgaataaagttatacagat

SEQ ID NO: 4752 - DNA, 451 bp, Gossypium hirsutum
  Clone ID: uC-gsronu33B158g03b2
cccttgtttccggaaagattcctgacaaagaaatcctccaaattgtgaaggagaacttcgacttcaggcccggtatgatcaccatcaacctggatctcaagaggggtggcaatggccggtttttgaagacagctgcctacggacactttggaagggacgacccggacttcacctgggaaggtgtgaagcccctcaagtgggaaaagcctcagtcttaaaatccagctttggctgtcctcgaatgtctctaatctcatacatatgatgccccccattcattttcattttcattttcttatttgttctctttcacctttaattgtgtcctgtcaatgtcgtgttgcaaaaatgtatgagaaatttgcttatattgatgccacctggagtaaacaaatcttccttttatgattgcttaatggaattcttggctaccttaatcaaaatatggttg

SEQ ID NO: 4753 - DNA, 308 bp, Gossypium hirsutum
  Clone ID: uC-gsronu33B158g04b2
cgtaaattggagaatggacactccaatggtaatcatgttgagatggaagaacctagggcaggtgttgttaatggtaaagaaaatactagctccaatattagtgcttttgatgtaagtaagcttcagaaaagaactaaaggtgtaaagaaaactgatactgttgttaacaagggttccaagccggaccctaagaaaaaggctacaaagaagaatagagtttgggatgatgcacctccggaggaaaaactggactttactgatccagtggatggaaatggaagtgggaatgacaatttagaagttgttgc

SEQ ID NO: 4754 - DNA, 491 bp, Gossypium hirsutum
  Clone ID: uC-gsronu33B158g05b2
cccatttttccgatcaaaatgtagagttcatatttgcagggattgaaccaccattttattgggtagccgatgacgcatgaacaacatccagatcttaccatcgaaggctccactcggggaaaatctggtgagccaaattattttatttttttttagaaaaaaaatattaaatctcacattatttgttcaagagaaaaaagaaaatgttgaaaatcgaaacattcaacagcctgagaccctcgcccttattttagagatattagggacctcactggtgccatcttgaggcttgatgaataatacttttaacttcctctttcaactttattctcaacgaagtgaacagaggctaaaaccacttcgaaaggtataatctaactcttttttttcttttgtgtttccacatgcaaaaatgatgaagataactgctggaaaaataaaaagaagggaacattaaaaagctaaagaagatcaccttttgaaatccattt

SEQ ID NO: 4755 - DNA, 501 bp, Gossypium hirsutum
  Clone ID: uC-gsronu33B158g06b2
caagtgtttatcgaatgttccgttgtgttgtaagatatggatataaggatttcatgggagcacctgtagagttcgagcaacaactggttgagaagttgaaggaattcattcgtcatgaatatttcatggctgaaggagaggccgcagctgtagagaactcgccccagagctccaatattctagcaaatcaaggtaaagataaaggaagtagtagaagggctgtttttgtggaggaaacactgaaccagctcaaccaatctcatagttcctcagcctccatccagtcattcaatgtggccaaatcaaataactcgacgagtgggatcatatcagcagcaccacccatactgggggctgaagaagagattcagtttgttcagaaagcaaaggatgaaggaattatttacctcctaggagaagctgaagtgatggctaaacccaattctttctacacaaagaggatgattgtggattatggctataattttctgaggagaaact

SEQ ID NO: 4756 - DNA, 429 bp, Gossypium hirsutum
  Clone ID: uC-gsronu33B158g07b2
gtgtatattgagtgggatgctgttgagttgccctcccaattcatggagaattggtgttaccacagggatacattgatgagcattgcaaagcattatgaaacaggagagagtctccctgaagaggtatatttgaagcttcttgctgcaaggactttccgtgctggttctctaagtcttcgtcagcttcgatttgctagtgtggatttggaactgcatacaaaatacatcccagatgggtcagaatctgtttttgatgttgatcagagagtttccaaaaaaacacaagtgatccctccattgccagaagataggtttttttgcgggttcaatcatatatttgctggtgggtatgctgctggatactacagttacaagtgggcagaagttttgtctgcagatgctttctcagtattagaggatgaaagactg

SEQ ID NO: 4757 - DNA, 454 bp, Gossypium hirsutum
  Clone ID: uC-gsronu33B158g11b2
gcttccttaacacaacttaccaactcaaaaaccccggggtttcactttcaaaaaactgggcacattcaccatgtctggcacgtgcggcaactgtgactgcgctgaccgcagccaatgcacgaagaagggaaacagcaacaccatgatcgttgagactgagaagagctacatcaacaatgttgagatggatgctccagctgagaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgtgtggtgacttatatctgtcagttaacctttctctcctttactatgatgtaatggctatgcttatggccttatctggttaatgaagtatccttact

SEQ ID NO: 4758 - DNA, 443 bp, Gossypium hirsutum
  Clone ID: uC-gsronu33B158g12b2
gcatctagctaaagttacagggatgcttgttgagatggatcaaactgagggtgcggatggggttcaactacctgaagctctattagcagacgacgctgaatcattggaggttactagaactgagggtcatctgcaggaacatgatggtgctgccgctgatcaactgactgaattggcatttagtgacaaccttggctattgcgctataactgtatggtagagtttggtacttgaacaccatctgacccaggactttgatgctatagaatcaattgctatgtgagaagctggtgctgactatgtactactacagagtgttgggaacgaaagacggtctgacacatggctttcatgctttataattaattgctatgtgattgagttatgcatgggatgcatcacacgatatctcagggattgaatcgattgcatctcttttgagt

SEQ ID NO: 4759 - DNA, 370 bp, Gossypium hirsutum
  Clone ID: uC-gsronu33B158h01b2
cggtctcttgggcggacgcgtgggcggacgcgtgggcgggcgcgtgggtttccgaatgaaggttctatgtcttcttatgctcttccatgttggtctctttaattgctctcttggtgcattgaattcaaagcttttcaagactttatgacattggctacccttaatttcactctcactggtgatgaggggagtagcctctaatcttctccgagataatatttgggtgttatcaattttcaatttctctaaaagtttaaatatctctatatatatcatgttacattagtgacataaatttgattttgtaatgtaattggtgtgattttcttatatatcatagatatataagggtattgatcctatttttttg

SEQ ID NO: 4760 - DNA, 257 bp, Gossypium hirsutum
  Clone ID: uC-gsronu33B158h02b2
gggcggacgcgtgggcgccgctaggggggggggggatttcttccggtgcggggagcagcaaccatggttctcaagacggagctttgccgatttagtggtgccatgatataccctgggaaaggcatgagatttgttcgtggtgattcccaggtcttactcttttccaattgaaaatgcaggcagtacttccacataccgctgcagccatcaaaacttacatggacggtcatgtacaggaagcaacacatgaaggacat

SEQ ID NO: 4761 - DNA, 332 bp, Gossypium hirsutum
  Clone ID: uC-gsronu33B158h03b2
gccattttaaggttcacggatctctagctcgtgccggggaggtgagaggccaaactgggagagtggccaagcaagacaagaagaagaagccccgtggccgcgcttacaagcggatgcaatacaaccgacgcttcgtcacagcagtggttggatttggcaaaaagaggggacctaactcatctgagaagtaagagatctatgtaggtgaagaaggcaagaagccttgttgaaagctttgatggattttaaggctttgttttcttttgataatgtttttatgataatgggtcgaagggatggattgaactgtcattatgtttgctagatactat

SEQ ID NO: 4762 - DNA, 419 bp, Gossypium hirsutum
  Clone ID: uC-gsronu33B158h04b2
ctattctagtgttttagaggcgctggcggttgaattgaaagcatcaaaggacttctctaagttatatgcaggcattgcaatactttggcttcatcaatgaatattgttttagaaatagtaatactttgtgagtgtgtctgtgtgtgttttttttatgtattaaattacatattgaatcaatgtttatgtattaaatttaaattcattaatttttatatttagttctaaagtgtcaaaaaaaaaaaaaaaaaatatatgatgatactgccgacctaaaataggaaaaatgctttccttgataacttaaaacatatatcggaacctcatattataataattattaatggctatttattatggggggggcctgttatgaggccccagattctctcccgcgggaatgtaaaggaaaccctttt

SEQ ID NO: 4763 - DNA, 341 bp, Gossypium hirsutum
  Clone ID: uC-gsronu33B158h05b2
cccttgtttccgggtatttgtctcttaattagaaggggtgcttttaatgaagtgacactgaggaatgcttcctttttgaattatatgtttgattcaatcaataaaatttggtactatcatatcactgcgctatatactcatgcttggttcaataaatatatttttatgattttggttcaaaaaaaaaaaacacaaaagaactaacaaaaaaaaaaataaaaaaaaaaaaaaacaaaaacaaacataaaatacggaactaataagaattgctttgttggtattttggaccatctcaatcaggattcttcttttcctgtttcctttttggatatattataacc

SEQ ID NO: 4764 - DNA, 491 bp, Gossypium hirsutum
  Clone ID: uC-gsronu33B158h06b2
cacttcttgtgtggtcgttacatcaaaatacggatggagggctaatatggagagaatgaggcaatctcaaaccctatctgattctagcaagcaagcttacatgcgcggcaagaggatcctagagattaacccaagacacccaatcatcaaggagcttcgtgagagagttgccaaggactctgaggatgagggtgtgaagcaaacagctcagcttatttaccagacggctctaatggagagtggtttcaatctacccgaacccaaggattttgcttcacgcatctacagctcagtgaaatctagcctaaatatcagtcccgatgcaacaattgaggatgatgatgatgtagaagaaaccgagacagagtcggagacaaaagacagtgcagtcaaagatgagttgtagattgcctgaaacctcggggacatgccttctgagttaggttttaccctctgatgacaagccgaaggaactgtaacatgcaatttca

SEQ ID NO: 4765 - DNA, 408 bp, Gossypium hirsutum
  Clone ID: uC-gsronu33B158h09b2
tcctcgcgtccgattatcttaaagcctgccatatgaggatataaccaggctccgtgggggtactcttcggccaccacaatgccgaaaatcgccttgggaacaagccaagaggctgctcagcctgactgcatcaaagcccttgtggtcgagtttatcaccactttcctcttcgtattcgttggagtaggagctgccatggccgccgatgagtcgggggcaaatgcgctggtgggattgtttgctgtggcggtggctcatgcccttgtcgtcggcgttatgatatcggccggacacatatcaggcggccatcttaacccagccgtcacgcttgggttgctattcggtggtcacatcacggtggtccgtgcgatcctctactggatcgatcagttgttggcatcttcagct

SEQ ID NO: 4766 - DNA, 502 bp, Gossypium hirsutum
  Clone ID: uC-gsronu33B158h10b2
ttaattcattggataagcgtaaagtgaattcactttgtttgcttattataaataacattttggaattgtaggtctttttaaaaaaaagggggggttcagtttttttttttttaatttttaattataagaaagctttctctggagaagatgataaaagtgtcgactatggcggagctgttaggagaatgcacggcggcactagcgacggtgagggagagggtgttagcaccatggccgacccttcatttccgtcgtctcagcttttcatattctgctgcttctgccgtcctcaatcaggattcttctttccttgtttacttttagtatatatcagaacctcttattattataattattattgtttatttattattatttttaattgttatcacttatcagaactcttccatgtaaattttgaggaaacccattttgtttgtttattttttttttcaattaagtgcttaattatatatgtgagagtacttaatttaattcatgg

SEQ ID NO: 4767 - DNA, 326 bp, Gossypium hirsutum
  Clone ID: uC-gsronu33B158h11b2
gtttatattctaatcctatttaatttatgaactggaggtgtagttcatctgcaacagttgtgattcctgccaactttgatatcaatgtttttgtaaggtgttggcacagagatagcgttgaagtttgatgttgcactgtcacctctactggcccttgtgataaccagtgactggcaacaatgtcattgatcttttgcttgtgcttcgccgtgatttttctgttgaccgaagttgctaggtaggtcaaacggtcttaagaagaaatgccttgtatgtattctggaacatttggtcagctattggaattttgtcttggaccgttcaaa

SEQ ID NO: 4768 - DNA, 244 bp, Gossypium hirsutum
  Clone ID: uC-gsronu33B159a01b1
cctatgcgtccgcccacgcgtccggaaaatgaaggggtatatattataaggtattttgtatagtattcagcaataaacctatatatagagagagaatgtattttatatatatgccatatattataataccaagtttgcaagcttaatgcttcatgaatgttaaagtacaatgaaagacactcatggcatgtttgggatatcattttatgattgaatcatgtcgcgatcgtgttcgcttaatgtt

SEQ ID NO: 4769 - DNA, 502 bp, Gossypium hirsutum
  Clone ID: uC-gsronu33B159a02b1
ctttgtttttgactttgtgactgctgagaattgccggggaagcttgattttcttcattgcatggactcctgacacctcaagggtgagaagcaagatgatttatgcaagcctcaaaggacaggttcaagagagagttggacggtattcaagtagagctgcaggcaactgacccgactgagatgggacttgatgttattcgaagccgtgccaactaaattggcatctccaaatggcaggaataatggagatggtaaaatgctttctgcttttgtttcaagtgaaatgttaatagtttggcggggtggtatgattttgtgttgttgtttagatgttatatccaagtctttgtctagaacaagtttagcaatttccatttgaatcttatgattctgttatgcatgtctcaaagttatctgacggagtgtcttacagttgagtcgataaacataagtctcatcttcttcaatggtatatgaagcactctttttgaggggttttttcc

SEQ ID NO: 4770 - DNA, 422 bp, Gossypium hirsutum
  Clone ID: uC-gsronu33B159a03b1
gtcttctgctatgctgtcatgagagaccctgattggtggaaaatccctgatgaattcgatcctgaaaggttcttagacagctctgatgagaaaatcggagagcatcaaaatggaattcaagggtcaaaactttaggttccttccattcgggagtggtcgaagaggatgcccaggagcttcacttgccatgttggtgatgcatgcagcagtagggtcgttggttcagtgctttgattgggaagtgaagggtggtgagaaagttaatttaaacccagggccagggttcggttcagaaatggctcaaccacttgtgtgctaccctattctacgttttaatcccttctaagcaacaccatatttgtgcttgaaatctgtagctgctgagcaaataaaataaatgtaaagcctgtagcttacatctt

SEQ ID NO: 4771 - DNA, 456 bp, Gossypium hirsutum
  Clone ID: uC-gsronu33B159a05b1
ctttattttctttggcttatctatcgctttgattggggatccttgctgagcactcgatggcaaatcgatggccgaggcctgaggtgtatccgctgtttgcggccgtaggtgttgctgacggaatctgcgggttgtagttggcgcgcactatctggatcgaccctgaagtcagggtaaccaaggagaacagggctgctggggttctggacaactatgctgagggagaaaaatattctgaacatttcttgagaaaatatgtccgcaacaagacgccagaaatcatgcccagtatcaacagcttcttcactgacccaaagcgagggtgcactcttgctttatgctgaaactaaaaaataaaaaaaatagaagaactaagtcttattcaatcaataccaagctatgaccttgatctctgctgactgtgatgcaatttgtgatggttctgcacttggatga

SEQ ID NO: 4772 - DNA, 283 bp, Gossypium hirsutum
  Clone ID: uC-gsronu33B159a06b1
tcctcttcttgaacgtcggacactactataagatggggggttctcagaccatcatctggggagtcgccccatcgatgactaccttcagagggaccagagatgagcactactcgcactaacacaaggatgcagtgcggatcaaactgctcttgagatccatgcccctgtggaaaaggctgtagaaaagaccctgacactgacaccagacagcctgaaaaattacatgcctgtggaatgaatgatcgacacagcatgaagcctgcaaggtctataattatgtctc

SEQ ID NO: 4773 - DNA, 363 bp, Gossypium hirsutum
  Clone ID: uC-gsronu33B159a07b1
ttctcgcgtccggagcaggtacgcaagcgttggggtgggttttcaattccttttgggccccctacgaagttttctggtcttcctcagcctcccatccgcgtcaatcttgggcactacctacactttggtcttgtgggtttataggacttttactgatttggtgaactttattttatttgtgtctagtcatacaagcaatagtatgagcgtcagagtttggagctattgaaagactttgttacagagatgatgtatagtcaatagcagtgatgtttaccttttacttttcttcgctttttctttcttaatggaagcgatcttttatacttttattatatgtatgggtatcctctttctttcttt

SEQ ID NO: 4774 - DNA, 534 bp, Gossypium hirsutum
  Clone ID: uC-gsronu33B159a08b1
ttttcgcgtccgcccacgcgtccgggaaactggggggtattgagaacttgtatgcagctttaagcaggaaactcgatcacccaaatggccagaatgacgattcgagtagcgagttgagcgggttgggttgggttgtagcgggattcgggtttcacgatgtggtgattgaaactccagttcactcggttcagttgtcggatttggatccgagtgagattggtgatgttttgattgcctataagaggaggattgagcagattaagcagtttgattcaatcaaatatattcaggtgttcaagaaccatggagcttcagctggggcttcaatgagtcactctcacagtcagatgctatctcttcccattgttcctcctagtgtttctactcgactcaacagtatgaaggagcattttaatcggacagggaaatgtagtctctgtcaggtccaatcaaaggacctcttgattaatgaaaccagccgtttcttttccattgctccatatgcttctttatttactttcgagatatggataa

SEQ ID NO: 4775 - DNA, 475 bp, Gossypium hirsutum
  Clone ID: uC-gsronu33B159a10b1
ctttttctttattttgaagtgtcaaaccccacagttgttgttgtaaacatcttgtggaaaaatggaaaaacagatgatatttgcatgggcaatgatattttgccttgccattgcaccagtgtatggccaatactattccagaactgttaaggcaggtcctcgggtggaaaagattacccacctccacttctactaccacgacattcgcagtggcaataaccctactgcattcctgatagccagtctcaacatcacccaggacccgccctcatatggcaccttgcttgcaatggatgatcctctaactacagagtttgaactaacatccacgctcgtcggaaatgcccaagggctctacttagcattgagtcgagaccttaccaagttttctgcagtcttttacgctgactttacgtttaccactggcaggtacaacggcagctccttcagtttattctcacgatttccccccaca

SEQ ID NO: 4776 - DNA, 516 bp, Gossypium hirsutum
  Clone ID: uC-gsronu33B159a11b1
gtttaatcagaatcagggtttgaaaaaaatgcagatcttcgtgaaaaccctaacagggaagaccataaccctagaggtcgaatccagcgacactatcgacaatgttaaggccaagatccaggacaaggaaggtattccaccggaccagcagagattgatcttcgctggaaagcagctcgaagatggccgtactcttgctgactacaatattcagaaagaatcaaccttgcatctggttctgagacttcgtggtggcattatcgagccttctttgatggcattggctaggaaatacaaccaggacaagtatgatctgccgcaagtgttatgctcgtctgcacccccgtgccgtgaactgcaggaaaagaagtgtggacacagcaatcagttgaggccaaagaagaagatcaagtagattacatatctcgacggaggattatacttttattatcagatttctggttggaaactattgttctataacagacatctttaatttcgtttagctggaaactc

SEQ ID NO: 4777 - DNA, 511 bp, Gossypium hirsutum
  unsure (1)..(511): unsure at all n locations
  Clone ID: uC-gsronu33B159a12b1
ggatccttaaccttggatattcggagaagacaacgagcactcagaccatcatctgcggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggcgaaaataatgtataagccatttggttgggagcaaattgtccttttctccaaaggatttttgctgctcattcatggtgacttgggttatggctctatctgctggtggtaaaatcttataaaaatatatatncggntgctgctcttgggttgtatcaaatcattgtctgaaaatatatggcatcttttattactttt

SEQ ID NO: 4778 - DNA, 415 bp, Gossypium hirsutum
  Clone ID: uC-gsronu33B159b02b1
ccctctcgtccgcccacgcgtccggccagttgtcgcagcttcttgcctcatcgctggttttggtctctttctaccagctgttgtaaggcccattctagattccttaaatcatcaaagcaagtccctcagcctgctttaagagatgtggttgctggtgtgactggtaaaaagcagggctaatgtgatttatgagttgggaagaagcagaaactcaaatgtagctagtaatcagcaacaaaataaacttgattttaaagttgaactcttgcgccttcaacttcatctttagcatgagaatttgagtgttaatttgtttttattttcagtggtggaggattactcaaaaatcatggataattcatatcagactggaatttgatatcatctaaaaaaaaaaaaaaaacctaactccatt

SEQ ID NO: 4779 - DNA, 579 bp, Gossypium hirsutum
  unsure (1)..(579): unsure at all n locations
  Clone ID: uC-gsronu33B159b04b1
atttctcnttaattaatttattttccatcgaaacgcgggtttcttataaaattcctatctcctgtctccagaaatctctggaaattcctttgggaaacttgacctctacttccgatggttggaggaatccactgcctttttttgatcagcaaaccgaggctggtagtgataagcagccaaagcttctttgccctctttgtcgaggagagatttatggctggagcgtggtagaagctgcacgtcagtttatgaactccaaacccaggagttgttcgtcagagacatgcgatttcagtgggacttacagtgaactcaggaagcatgccaggtctgctcatcctttggtccggccaactgaagttgatccagaacgacagcgtgattggtctaggttggagcgtgaaagggattatgaggacatgctgagttcaatccaaccagttgctggtgaagatagtaatggagaaagcatttcaaatctcgaggattttcgttcgggttgactataatcctgcatacttgacacttgcacttgagttcattagtgattcaagatataatgaacatgatagatttagg

SEQ ID NO: 4780 - DNA, 514 bp, Gossypium hirsutum
  Clone ID: uC-gsronu33B159b05b1
cctatttttgctattgcagtcagtatttttgctagttgtagctttgctgctatgtatggcattgctgttgctgcccttggaatgctgagcaccatagctactggactggctattgatgcttatggtcctatcagtgacaatgctggaggtattgctgagatggctggcatgagccacagaatacgagagagaacggatgctcttgatgctgctggaaacaccactgctgctattggaaagggtttcgccattggttcagctgcccttgtgtcccttgccctctttggtgcttttgtgagccgtgctgctatttcaacagttgatgtattgacccctaaagtttttattggcttgcttgtcggggcaatgcttccttactggttttctgctatgaccatgaagagtgtgggaagtgcagctctgagatggttgggaagtgcgcggcaattcaacacaatccggtctcatgagggtactgctaacctgactatgctcctgtgtaagactcactgat

SEQ ID NO: 4781 - DNA, 71 bp, Gossypium hirsutum
  Clone ID: uC-gsronu33B159b06b1
atcctatttaccaaaaaaaaaacaaaaaaaaaaaaggggggctttcgaaacagttgttccaaggctccgcc

SEQ ID NO: 4782 - DNA, 538 bp, Gossypium hirsutum
  Clone ID: uC-gsronu33B159b07b1
ctctagagtgcattccatagaatcaattattttgctacgatcacccttattgttgctcagaagcgacaccaaactcgtttctttcccgagggaaagtgggatgggggtccccactggtaatatttcacctggcacagttgttgacactaaaattgtgcatcctttcgagtttgacttctatctttgtagtcactatggaagccttggtactagcaagcctacacactaccatgtcttgtgggatgagcatgggttctcttctgatcagttgcaggagcttatctacaacatgtgctttacatttgcacggtgcacaaaaccggtatctctggttccacctgtgtactatgccgaccttgttgcatatagggggcggctgtactaccaggcaatgattaaaagacaatctcccatttcaacattatcctcatcttcatcaatgacatcgtcatcatcaatgtcatctgcagcttcattccatgactggtttaagctgcatgcatacctggaaaacatgatgttttttctttgaagcatg

SEQ ID NO: 4783 - DNA, 437 bp, Gossypium hirsutum
  Clone ID: uC-gsronu33B159b08b1
tttttgagcgcaatgacaaaaatgaactatttggtgcccctgacccaactttgggcttactacagacacaagctcaattatgtgaggcagtgaaaaaggaagggatcggacctcggtgaagagttcacagctgactgttggattcccttatgtgcagcatctcaggatgtgccactaacatgaatagctgaagcttggtgggcgtggagagagcacaaatagactgtacctggatatgcaatggacactggattgctggagtgatcacccgctcgagaatatttaccatttgaacttgagaatactgctgaggcctgagactttgtgggctcataatgacaggatcagatcgaaacttactgccttatgcgatcatttgcctaccttgtatattgtagcattactaaactctattcaatgagactaaataatggatt

SEQ ID NO: 4784 - DNA, 540 bp, Gossypium hirsutum
  Clone ID: uC-gsronu33B159b09b1
tatttactgttttgactactggtttctggccaggggacatgtcttttgatctcaaccttcctgctgagatgattaagtgtgttgaagttttcagggacttctatcagatcgaaaacgatacacaggaaacttacttggatgtattctttgggtacttgtaaccttattgggaagtttgaaccaaaaacaatggagttgattgtcacgacatatcaggcttctgccttactgctattcaattcctctgatagactgagctattcggagatcatgatacagttgaacttaaccgatgatgacgttgttagacttttgcattcgttgtcatgtgctaaatataaaattctgaacaaggagccaagcacaaaaaccatctcctccactgatcagttcgagttcaactccaagtttaccgataaaatgaggaggattaaatttggagaatattgatcaatggcatgatgatgaagggctttgtattataaaatatgcaacatctccagcatatgatagaataaagtactgcaatatattccagtt

SEQ ID NO: 4785 - DNA, 406 bp, Gossypium hirsutum
  Clone ID: uC-gsronu33B159b11b1
gttggattcaggtgtagacgtatcatacaatgaattcgagtatggacacttagacttcacatttgcccaccacgaagaactcttagcattcgtgatgtcgcggctgctgctcgtggagcctgatctgaagcgccagtctagtccgaaggaggctctaaagttgaaaaaaacagggcaagctaggtctggagtctcctccgattgatccatcatcgatcaagtacgtacaaaaaccatgcatttccatgtgttttagcttttggatttggcatgcatttccatgtgttttagcttttggatttggcatgtatcttgttgtattgaatgttttggatgcttggtagatgcttttttggtgtacgtgagtgaatagttggatcatcaaagacatcttttacatcattgg

SEQ ID NO: 4786 - DNA, 388 bp, Gossypium hirsutum
  Clone ID: uC-gsronu33B159b12b1
tgttctttttctttttttttaattttttaaagggggggttttttttaaattttttgggggttaccccccccaccggggggccgcttttggggggcccgggttttcgtggcgctggcttgctacccctgggggggcccttttggggggccttgtttggtgtccccgggcgtcgcctcccttcgtgggggggggggttccccgggcttcgcccccctggggggcgctcgccgcccgtgccccttttggctgttggcgtcttctccccttggcccgcgcgggttgtccccccccctgttgggccccccgtttggcgccggggccgcgccttggggcggcccctctcgcgcggcggctgggggggtttcgggcggggggcccctttcccctg

SEQ ID NO: 4787 - DNA, 540 bp, Gossypium hirsutum
  Clone ID: uC-gsronu33B159c01b1
catgcctacagaaactcaaggaacgagaagtcgatctggtgggatgagtgtatctttggcaagtgctgatggccgtgttgtaggaggaggagttgctgggcttttttatagctgcctgccctgtacaagttgttgtcggcagctttttacctggcaaccagcatgatcaaaaacccaaaaagcagaagatcgagtccataccagctactgttgcaccaaacccgagtattgccgctgcaccagcttcaaatgctgagaaagaggatggcatagatgttgtttcgccgcaacaaaattcgaatgccctgaaaccaagcctcaccggtgctaccttccggagagaaaattgggcggccaccatgcaggagccaaggaattcagcaacggatatcaacatttcgttgccagcaggttaatcttataaaatcagactcggaggctgactagactaaaatccctgatgtttttcgttcatcaaagagtacggagtgttatgtgttgctgaatattactgcaggatgatgaggtaggattaatatc

SEQ ID NO: 4788 - DNA, 121 bp, Gossypium hirsutum
  Clone ID: uC-gsronu33B159c02b1
ccctgcttccggagaaaacaaactgtttttgtttatcacataatttggttctctaaaaaaaaaaacaaaaaaaaaaaaaaaaaaaaaaaaaaaaaaacaaacaaattcttctgccccctcc

SEQ ID NO: 4789 - DNA, 451 bp, Gossypium hirsutum
  Clone ID: uC-gsronu33B159c03b1
aggctgctatcaaggcggaatctgaaggcagcttgtagggaattcttggttatgtggaccaagatttaggctcaactgacctcatcggagacaacagggtcaagcttttttgatgccaaggctggaattgctttgaatgacaactttgttaagcttgtgacttggtatgacaacgaatggggttacagttcccgtgttatcgacttgatccgacacatgtctaaggctcaagtgagtgagtgattgtgctttgtgtatccaagctctagcaatcttaatttagaagagatgttatgagagaataaacgaattgtacggagcatatctctgtgtgaagaagggttgtttcagttttattacccaagtacttgaatgtttcaagtttcattgcagttgtttctctactttaatgcatatgttgtgattatggattctctacctaacttgatat

SEQ ID NO: 4790 - DNA, 566 bp, Gossypium hirsutum
  Clone ID: uC-gsronu33B159c04b1
ggtttttgtggggcaaattggagaccttctcttcctgctcgaagcggagggaacgcttctggttataccggtgggagtgccgatgacaactacagtttgggagggggaggatatggaagaaacatcggcattgttgcagcaccaccatcatcatttgctgggtcaactggtaatattgaatgttcctatggagatctttaccgtaatgcttcagtttatggtgactcaacttgtaagtttgcatcacctgacttggatggttctagctcgtttggttatggacttggcaatacatccgcagatgttactacaagaccctgtgaggattatgttggaagttacaatgtcgcaagtagacagtccaatagaggaattgctgcctaggagatccggtattcggatatcagatactataatgtagggtgaatggatttgcacaaattcgatatgacttgttactatgttggcttacatggatattgatcttatggcactaacgacggttaatggtttgaaatatacacattcagagtgagcggtttcagcgattttcacaaggttgagat

SEQ ID NO: 4791 - DNA, 551 bp, Gossypium hirsutum
  Clone ID: uC-gsronu33B159c07b1
tttttaaagatcgattcatcagtcttcttctctgagtagaggttttggatttgtaagcatttacaatgtcttcgtcctatctcccagcaaccactgactcaattgctctgggccttagaagccaaaacaccatctgaagccatctcaatcctttaccgtgtactagaaaatcctgcatctgctcccgatgctctacggattaaagagcaggccataacaaatctatctgatcttcttagacaagagaaccgagcagaggagctcagaagccttctgacccaactgaggcccttttttgcactaattccaaaggcaaaaactgctaaaattgtccgtggtataattgatgatgtagctaagataccaggaacatcagatctccagatttctctttgcaaagaagtggtgcagtggactcgtgctgagaagcgaactttccttcgcaacgagttgaggcatagcttgcggcacttttgatggagaacatggagtactctgaagcactgaatctcctttctggtctaatcaaggaagtcagataggtggatgac

SEQ ID NO: 4792 - DNA, 437 bp, Gossypium hirsutum
  Clone ID: uC-gsronu33B159c08b1
tatctatgagatcaagttgcatatcaacttgttggatttacttaagattacttttcaaactaaacaaaatgaatgcttctggtcctgctcgaatgttggtctggtatgttggacatcaccatggtcgactgttgcattgcagttcatgcttaacactttcaaatgattgtatattccaagacctcatattttacattcccttcggtggaaaagagagtatcatgaactttcggcaaaatctaatggaagcaatgggacaaaatgttcatttcgtgattgatagttggatggaaggcgacaatttaactgcaagtgtaatttggcatcttgagtggaaaggcaaagagataccacatacgacaggttgcaatttctttgatgtcaacagattgatggaaagcttattatcagcaaaatcataggagttgaggagttgc

SEQ ID NO: 4793 - DNA, 161 bp, Gossypium hirsutum
  Clone ID: uC-gsronu33B159c09b1
tctcttgattgtgagaaatggtgtggtattttggtttcttttcctaagagcattatttttcttgcagttaccttggaattatgtactctttccaatgtcttgagtctgacctgaccttaatgtttgtttggctcataagcgagtgaatatcatctcatctc

SEQ ID NO: 4794 - DNA, 547 bp, Gossypium hirsutum
  Clone ID: uC-gsronu33B159c11b1
ctctctctctctgctacgccgcctttgcttccctttctctaaataaaaaatcccaaactgaccaaaaaaaaacagagcatttagttttttctttcaattaagagttcaagctggcgatcgaaaatcgagaatccattgtccgtgaaatcaagcccaagaacagaagaatcatgggtgctggtgggcctgatgaagaagacaacaggtggccgccatggttaaaacctttgttaagggaacatttctttgttcaatgcaagcttcatgttgattctcacaagagtgaatgcaatatgtactgcttagattgtatgaatggcgctctctgctctttttgcttagctgatcacaaggaccatcgttatattcagataagaaggtcttcataccatgatgtgataagggtgtctgagattcaaaaatacctagacatatctggagttcaaacatatgttatcaacagtgctaaggttggtttcatcaatgaaaggccacagccaaggccctggaagggtgtcatcaacacctgtgaagtctgtgagcgtag

SEQ ID NO: 4795 - DNA, 143 bp, Gossypium hirsutum
  Clone ID: uC-gsronu33B159c12b1
tttttgtggaatcttttatttatttattttaggggggccattatcatcttatgcgggggaaaaaaaagaaaaaaaaagagagggaggggggaaagagcgaatggcttcgaaagggcaaaggaacaaaaagaggaaaggggggg

SEQ ID NO: 4796 - DNA, 474 bp, Gossypium hirsutum
  Clone ID: uC-gsronu33B159d03b1
gattttctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaagtttgttctctattgaaagaatggcagttcctttctctttgacta

SEQ ID NO: 4797 - DNA, 536 bp, Gossypium hirsutum
  unsure (1)..(536): unsure at all n locations
  Clone ID: uC-gsronu33B159d04b1
aatttatctgctttttcttagttttcctttttgtccgttgtttatttgatatttccccctcatggccgccgctgatgtcgagttccggtgcttcgtcggagggctcgcatgggccaccgacgaccgggccctcgaagaagccttcagtgcgtttggtgaaatcgtcgaatcgaagatcattaatgatcgtgagactggaagatcccgaggctttggattcgttactttccgtgacgagaaagctatgagggacgcgatcgaaggaatgaacggtcaaaatcttgatggaaggaacatcaccgtcaacgaagcccaatcgcgcagaagtggaggcggtggcggaggatttggaggaggaaacggtggttacagccgcggtggaggcggcggcggatatggtggtcgccaaggaggatatggtggcggacgccgtgaaagtggatacggaaatggtggagggatggcggagtggntacggacgaagtccggcttttatttgttatggtgacggctgttcttgttcctttttaggggcg

SEQ ID NO: 4798 - DNA, 567 bp, Gossypium hirsutum
  Clone ID: uC-gsronu33B159d06b1
ccttttcgtccggaaaaggcagtggccgttcacatgagcactccaattgtaattactggaacacctcctttccctccttcctgcgccggtgattggaatcttgtagagtaaacggactcgatccctaagctagatttgtactaatgggagcagatgatgctgcagacaaggatatcaatgttagcttagctgaaaaaaagcctagagtggtttgggtttggggggccctggcagtgggaaaggtacccaatgcgcaaatatagtcgtgcactagcattacacccatctcagtgctggagatctgctccgagcagaaattaagtctggttcggaaaatggaaccatgattcagaacatgatcaaagaaggaaagattgttccttccgaggtcacaattaagcttctcgagaaagcaatgctggaaagtggtaatgacaagttccttatcgatggttttcctcgtaatgaagaaaaccgtgcagcattcgaagctgttacaaaaatcgagccagaatttgtctgtttttcaattgccctgaagaagagatggagaagcgtcttctgagt

SEQ ID NO: 4799 - DNA, 458 bp, Gossypium hirsutum
  Clone ID: uC-gsronu33B159d08b1
catagacatgttcatcataacaacaaaaaaattataaggatagggtataagaatcaaatccggtgtttctccgaggcttgactagtttgctctgctcttggcttctcctcttgctcttgttgaaccgaggcttccacaaacacttgaatactgctccaaatggtggttgaaggacactttctcaagatgtgaaatcaacaaaggaacaggggaagaaaatgaagaacaatggaagggaatgaagagagaaaagtgagagagaagcgaagaaatgaatgagtttgagatgtatttgaagtgagcagccaaggggggtatttataggtttattgatacttcaattataaatatttcgaagatgtacttttttttattgtaccttgttaatgttcaagttataatttgattaaggcttctaaatcaacttgtagctaattatcctttatttaaacgtcatg

SEQ ID NO: 4800 - DNA, 399 bp, Gossypium hirsutum
  Clone ID: uC-gsronu33B159d11b1
gttccctgcactaaccatttccaaggttctgctctcaatctgctcgttgctgaccgatccaaaccctgatgaccctcttgttccggagattgctcacatgtataagactgatcgggccaagtatgaagccactgctcgtagctggacccagaagtatgccatgggatgacagtggttggtgtgtaatacctatcagctttcttatgtgttttggggaaggaagggggtgttttttcttaaagtaacttgtcattgtgctttggatatgggaaagatatggaacattctttttatttatttcgtgctttataacttgtgtgaaacccttgtttcgttcaatgtcaaagttgctgtggaaccctttgtttcgttcaatgtaacaaaaaagtctttagttct

SEQ ID NO: 4801 - DNA, 525 bp, Gossypium hirsutum
  Clone ID: uC-gsronu33B159e01b1
ccctttttccgcggacgcgtgggcggaattctccgatttagttttgcatggctgcgcagttgatccaatcgagttttcatccaagaggtgtgacggcacgcaaagttttccactcacaaccagtatcaccccatcacaaagaagcaagatggatagctttaggaggaagcacatgacatactcttactgctatgaccaaaccagatacaaggttgctcctctggagtgtgtaatcaatcctcgagaagctgaaagactgaagaagttcgatcctgtcacatttggaggaggcaggcgccaccatgggaaacgacaccaccacatgcaagcaagccggtctgaggctgattccatctgatggaagacgtttgaccattgttttcctctcctttccattcagcttggggatcagttttgtgtatagagagagggggaagactgcagagcacagcacatatacatatatatattgagggtgatatgagtcattatatatgttcaatgatgtggagggtatgtgtatag

SEQ ID NO: 4802 - DNA, 425 bp, Gossypium hirsutum
  Clone ID: uC-gsronu33B159e03b1
ccttctcgtccgcctgattcagatagttgtagtactgaagtagctgaatgtgtgcagctggagtgtccagagaaggatgatagctccgcatccgaatgtagcgacgattatgccggtgcagtaaatgagacagttgctaccgataatctgacccgaagtgcccatgatgattatcagggtggtgttgtagatgcttaagattaatctaataccctaccaagctgttagagttaattttcgggtggcaacaaattggtccctgctttgaaaaagggtattcattgctagtaaaaaatttaccatgattgattaaattttttttttttactatttgtaattttttgtatgacataaatattatcactatttgtttcttttactttgataattcctgtttattgaactaatggatcagttaatttaac

SEQ ID NO: 4803 - DNA, 132 bp, Gossypium hirsutum
  Clone ID: uC-gsronu33B159e04b1
ttcctctgtattaaccttcatgcttatatggtatcaattctattgtattacaaatttaaaaaaaacaaaaaaaaaaaaaaaaaaaaaaaaaaaaacaaaaaaaaaaataccttccttctttatttcactgac

SEQ ID NO: 4804 - DNA, 558 bp, Gossypium hirsutum
  Clone ID: uC-gsronu33B159e05b1
ctctctttttggtcccttcttccattaccaaccctttcaagctttaacttccaatttcctccatggatttttagtgaaatcccaagaacaacttcatggcaagttaagtccgttgtgaagttagctagaatacatatttgtgggaagagaaaagaaaagttaaggatttgagaaggaaggttattgaagagaaagataaaagaagtgaagcacagattagggataaaggcaagggagttgcaaaagagtgaagaagaagagaatgactcatccaagtattagattgtgaagattgttttgaaactttagagtgaagatcaattctgactcatctcaatacaaactgaggcttggaagagagtatgttttgatttttggcaataattgatggcatgtacatagggtcatgttaacaatgttttggatgaactttcatggaaacatttgatagtatttgattcttcatgcaaattttgtaaacttggacttgtttaatttagttttaagcggcattatatgatgtcttgatggggaaccatgtgtgataatgtttaggaa

SEQ ID NO: 4805 - DNA, 565 bp, Gossypium hirsutum
  Clone ID: uC-gsronu33B159e06b1
ctcttctcgtaaggtatcattggttcgagccatactgtatatgtctgctcaatgtttaggagccattcgtgggtgtgggttagtcaaggcattccaaaagagttattacaacaagtatggtggaggagctaatagcttggctgatggatacagcactggcactggtttggctgctgaaattattggcacatttgtgcttgtttacactgtattctctgcaactgatcccaaaagaaacgcaagagattctcatgttcctgtgttggcaccacttcccattgggtttgctgtgtttatggttcatttggcaactattccgatcaccggaaccggaatcaaccctgctcgtagtttcggagctgttgttatgttcaaccaggacaagccatgggatgaccattggatattctgggttggaccattcattggagctgccattgctgcaatttatcaccagtatatcctcagagcaagagctgctaaagctcttggatccttcagatgcagctcagccatgtaaaacagaggggttgccattgaagaatggatcaagttttatctatga

SEQ ID NO: 4806 - DNA, 549 bp, Gossypium hirsutum
  unsure (1)..(549): unsure at all n locations
  Clone ID: uC-gsronu33B159e07b1
tttgtcccaagtagtattagaatcatgggtgttggcacttataactatgactctacctcccctgtcgctcccgccaggcttttcaaggccttcgttcttgaagctgacaagggtctggcccatagctgcccctcatgcaatcaagagtattgaggttgaagctaatcctggccctggatgtatcgtaaagatcaactttgttgaaggccttccattccaatatatgaagcaccagattggaggacatgatgaaaacaaattttcatacagttacaatttgattgaaggtgggcctttggggaacaagcttgagaaaatcaactacgagaataagtttgaggcagctgtaggtggaggaagtgtttgcaagagctcgatgaaattttacacttttggtgactatgtaatcactgaagatgaaatcaaggctctcattaaagggagtgagggagtttacaaagctattgaagcttacctcttagctaaccccgatgctggcaactaagatataggttggcttgaatnttcatgcttcctttaagacgggtc

SEQ ID NO: 4807 - DNA, 532 bp, Gossypium hirsutum
  Clone ID: uC-gsronu33B159e09b1
cacttcgtcttctccaatttcctccgaaagtaagatggctgtggatccctcagagcttcggtattatgaggatgatgacactccaacaatgaaaaccattcaagggtgcaactactggttttgttgctggaactatctggggaaccgttgttgctacatggtatgatgtgcctcgtgttgagagaagtgttgccatacctgggcttgtaagaacgctaaagatgatgggaaattatggaatgacatttgctgcaattgggggagtctatattggtgttgagcaactgttgcagaattataggatgaagagagactttgtcaatggtgctgttggtggtttcgtggctggggcttccattctcggtttcaaagggaggagcatctcaacagctatttctgccggatcagcactggcattcacctctgcggtgattgatgctggaggtcagactacaaggctggacacagggaaggagtattacccatacaccaccaagaaaaggcctgttgagtcataaatcttgcatgtcgc

SEQ ID NO: 4808 - DNA, 523 bp, Gossypium hirsutum
  Clone ID: uC-gsronu33B159e10b1
ttttcgcgtccgcccagctcccagtaaatcaagttcaaagaaccaggaagagaaaaacttcagcaacaccaacaattaccaagggctcaaggacagaattcagggaaactttataactgatcgcccatcaacaaaagttaaatcggttcctggtggagattcatctctgggttacctgtttggtgagaagtaatgcttcctcctttataagtttaagtatattgcctgattgcctgattgcctgcagttctcaatagtatgtctgcagtagtactgctggctaaataatggattcagttcccctattagtgttgaaattgcagtgctccttctactactatattagcatgatgtggtattaagcttttcataaattaatctgccagagaagtggatttcagtaatgaagcatacaggtaaaacaatgtatggttttacttttaccagatttgtataataagcagaagttcaagttcctgtcaatgtgtataatatacatataaaccttgagcagtgcactaag

SEQ ID NO: 4809 - DNA, 381 bp, Gossypium hirsutum
  Clone ID: uC-gsronu33B159e11b1
ttttcgcgtccgatagcattgtgttaaattcattgctatcatttcgcagtgtggcagttgatagaagttacctatgcctataaataacagaatccacctcataaattacgagagtgaaaacttggcgttatgctgtggacaaaaagtggtggaggccttcaatgagaacataaatcttcggaggcaaatatatttacacatttcagtttgcagatacccttttgtattttgatacctataggtagttgatcacgttacccttatcgtgtattcatggttttaaaacatgtagtttgcagcatatatttccctttttttatttgccgtctattaaaaaagaaagaataaggggcgtgcaatatatgaccattacatcggctt

SEQ ID NO: 4810 - DNA, 505 bp, Gossypium hirsutum
  unsure (1)..(505): unsure at all n locations
  Clone ID: uC-gsronu33B159e12b1
tgtttgtaccaaaaccagaattgcccaaagtgactgagttgccaaaacctgaattaccaaaagttccagaggtgcctaagccagaattgccaaaagctcctgaattaccataacctcaattacctaaaattcccgggttaacaaaaccagaattgcctaaagttccagagctacccaaaccagaactacctaagttacccaatctaccaaagccggaaacacctaaacaagaactgccttaagttgcctgatttgcctatcgtgccaaaaccttgaatcatggtactatgtttgttttccctcgacaataaacatatgatttttagatattcttcttataagagtgtgttgattagcatatttaaattcatttcatggattacttgtagaccagattatttatatatgtttggtttgagtgattttattgttatcatctatatattatacatgtatactttctaaataaatttatagttatacacannagtttggtttttctttt

SEQ ID NO: 4811 - DNA, 453 bp, Gossypium hirsutum
  Clone ID: uC-gsronu33B159f01b1
attatgtttaattgcacctccaacaaagattgagaatgcattttatggtgattccattgcttctattgagacaccaaacagtgttaaatgttagaacaatatctatctataccatggatgtatcaccattgtcatgttaagggctttggtgttaagggcttaatggtttcttggttatacgtggttttgtgttgattgttgcattcttgtctttttgagggtagattttcgcgaggagggttgggagtcttagtggtttgatattaagatgttctcattttaagatttggtattattgctttgggtgtgggactattttgtgggagatgttgcatcttgttaattgtaacattcttcgcttttgcttattgtgtattaattaagcaaaaaaaaaaggataatttgtaccattttagtcgctatcaaagaataaaaattatatgttctttggat

SEQ ID NO: 4812 - DNA, 577 bp, Gossypium hirsutum
  unsure (1)..(577): unsure at all n locations
  Clone ID: uC-gsronu33B159f03b1
ctttctctcagcatatcccctgcaactccgacatcttttgggtccctttgtccttcaattagatcacagcttttcgttcaaaaatatattccccctgttattgttcttaatnttcaagcaacaatggcggagcacttggcctcaatcttcggtacggagaaggaccgcgtgaattgccccttctatttcaagattggagcatgccggcacggggacaggtgttcacggctccacaaccggccgacgatctctccaactctcctcctttccaacatgtaccagcgcccggacatgatcactcccggagtggatgcccagggccagcccatcgatccccgcaagatccaggagcacttcgaggacttctacgaggacatcttcgaggagctgagcaagtttggtgagatcgagagcctcaacgtttgtgacaacctcgccgaccacatgattggatacgtgtatgttcagttcagggaggaagaccaggccgcagccgccctacaggctcttcaggaaggctctactctggtcgtcctatcattgcggatttttcccggtcaccgatttccgcgaagca

SEQ ID NO: 4813 - DNA, 574 bp, Gossypium hirsutum
  Clone ID: uC-gsronu33B159f04b1
catgttttgaggaacataaattcactggctttattttcaaatattgaagtgaatccacgacctgatgaaaagaacgagggaggcatagttgttgagataaagctcaaagagctggatcaaaaatcagctgaagttagtacggagtggaatattgtacctggacgcgggggacgtcccacattgacttcatttcaacctggtggaactgtctcttttgagcatcgaaatctcaaagggcttaacagatctattcttggttcactgaccaccagtaactatttgaatccacaggatgatcttgccttcaagctagaatatgtacatccatatttagatggtgtttataatccacgcaaccgaacttttcgtgcaagctgcttcaacagccggaaattgagcccagttttcactggtggaccaggagttgatgaagtcccaccaatatgggttgaccgagctggtgttaaagctaacattacagagaattttacccgtcaaagtaaattcacttatggactcgtgatggaagagataacaacacgtgatgaaagcagtcatatctctgcatatggtc

SEQ ID NO: 4814 - DNA, 515 bp, Gossypium hirsutum
  unsure (1)..(515): unsure at all n locations
  Clone ID: uC-gsronu33B159f05b1
gtttttaaaccactgggcagaagaacaaaatcaccattacaaatgacaagggatggctttcgaaggaggaaattgagaaaatggttcaggaagcagagaagtacaagtcagaggacgaagagcacaagaaaaaggtggatgcaaagaacgcgttggagaactacgcatacaacatgaggaacacagtgaaggatgagaagattggtgccaaacttgctgcagcagataaaaagaagattgaagatgcaattgacgaggccatccaatggttagacaacaaccagcttgcagaggcagatgaatttgaagataagatgaaggaattggagagcatctgcaatcccatcattgccaaaatgtaccaaggcgctggtgctgacatgggtggcatggatgaggatgccccagccagtggaaccggcgcaggccccaaaattgaggaagtggactaagaaatttctctccattcttttcgaccctttcatttgttcctttagtcngttcatgttggtttc

SEQ ID NO: 4815 - DNA, 533 bp, Gossypium hirsutum
  Clone ID: uC-gsronu33B159f06b1
ggtttttacagcattgacccttctcaagagacaccttttcaactatcaaggctatgtttcggctgctctggtacttggtggtgttgatgtcaccggaccccatttacatactatatacccccatggatctactgacacgttgccatttgctacgatgggttctggttctctggcagcaatggcagtttttgaatcaaattacagagaaggccttaccagagatgaaggaataaaacttgtaactgaggccatatgctctggtatcttcaatgacctaggaagtggaagcaatgtcgatatttgtgtaattaccaagggcggcaaagaatacttgaggaaccatcttcaacctaaccctcgcacttacaccagttccaagggctattcgtttccaaagaagacagaggtcctcttgacaaaaatcacgccattgaaggagaaagttgagatcattgaaggaggaggagatgtgatggaagagtgacacgcttatttatgttactacatcatctttatagcctcacttatgctct

SEQ ID NO: 4816 - DNA, 570 bp, Gossypium hirsutum
  unsure (1)..(570): unsure at all n locations
  Clone ID: uC-gsronu33B159f11b1
ttttcgcgtccggtttacaatttctctcaggatgatctcttgacagaagatattttgatactcgatacacatgctgaagtgtttgtttgggtcggtcagtgcgtagagccccaaagaaaagcaaaatgcttttgaaattggtcagaaatatatagacatggctgcatctctagaaggtttgtctccacatgttccactttacaaagttactgaaggaaatgaaccttgcttcttcacaacattcttctcatgggattccacccaagctactgtgcaaggaaactcattccagaagaaggtggctttgctctttggggctagccatgctgtagaggcccaggatcgatccaatggaaatcaaggaggacctacacaaagagcttcagctttagctgccttatcatctgcatttaatccatcatcagctagcaaagcctctactccaaagccttccagcactagtcagggatcacatagagcagcagctgtcgctgctctttcctcggttcttactgctgaaaagaagatacaatcacctgatgcattcnctataaaatccactagcagcac

SEQ ID NO: 4817 - DNA, 541 bp, Gossypium hirsutum
  Clone ID: uC-gsronu33B159f12b1
ttttcgcgtccggttcttttgccgtcgtatttttgttccagagatttgttcttttcgcttctttcgttatggggaagatcaagatcggaatcaacggatttggaaggatcggggcgtttggttgccagagttgctctccaaagtgaagatgctgagctcgttgctgttaacgatcctttcatcaccaccgattacatgacctacatgtttaagtatgacagtgttcacggtcaatggaagcaccatgagcttaaggtgaaggactcaaaaacccttctctttggtgaaaagcctgtcactgttttcggcatcagaaaccctgaagaaatcccttggggtgagactggagctgattatgtcgttgagtctactggtgttttcactgacaaggacaaagctgctgcccatttgaagggtggtgcatagaaggtaatcatctctgctcccagtaaggatgctcccatgtttgctgtgggtgtcaatgagaaggaatacatgcctgaccttcacattgtatccaatgctagctgcactaccaact

SEQ ID NO: 4818 - DNA, 461 bp, Gossypium hirsutum
  Clone ID: uC-gsronu33B159g01b1
gcggtcaaattccctctccctaatatggagtggccggccatgctatgggtggaaacatgttgggaacatgttggctagtgaggtatgtggataaatttaataggaagtatggggaataaagaaatggaaaaaggaaaggatgtgtggtaattgtttctttcctgcccttttgccgtgaaagtgagaaggaaaaacaaaaaaaagtgtccatctttcttcatttccccttggccgaatgttctaaagaagaaagaaaaaaatttgttcatcttttatcatccttggccgaaaatgctaagaagaagggggaaggggaagtaagacattcggccactccttctagtcttgaataaggtatgtaatgcatggcagcttttggaaattgcagaatgtattaagctagttactaagtaccttacttagcccatgttcaaatcttgaatattggtggtaacatgagc

SEQ ID NO: 4819 - DNA, 577 bp, Gossypium hirsutum
  unsure (1)..(577): unsure at all n locations
  Clone ID: uC-gsronu33B159g02b1
ccctttcttccggtcactccctgttcatattgtcttgttcttttcctctttaatccaaaaaccaaaatctgggtctctcttctttgagttcaaaatccattaccccatcataaaaaatcctttcttttctcaattcaaaaaagctgcctgcttggtgtgcttgatattgcctcaaccaaccattctcaaagttttctttttatataaatttccaagtttttgtttttcctaacatcttcatgctcaatcttctgttcttgatgtttgagattcatgtctccaattctcagtgaaatcttcttttctgggtttatgatcaattctacattcattcgaaggacccaactcgttcaatctttatcagttgttttcctttactggctgtactacgtttcatgattttctagccctttatcttctttcaaggtttctatctctctatatataataaataaataaataaattcaactactataatattctactactctgcatattattcatcttttatctacaactgtccatggcttcctcaagtggcacatcatcangctcatcaaccattgtcacaaactc

SEQ ID NO: 4820 - DNA, 247 bp, Gossypium hirsutum
  unsure (1)..(247): unsure at all n locations
  Clone ID: uC-gsronu33B159g04b1
cggttctggaagacatcgaaatgtagggtaccgttttctgcatatgttcggagtttccggcatcgagattttatactgtactcatatttctcccccttttcggtcatatatatataatgtgttaatcagtatttgaactgtatcatatccagatactagcgagtatttaatcaactctagaagtgtaacattatttcattcagtgtgttatggaaataaaatatttaattcaaaagttttctgcntt

SEQ ID NO: 4821 - DNA, 491 bp, Gossypium hirsutum
  Clone ID: uC-gsronu33B159g05b1
ccctttcgtccgcccacgcgtccggaggtattcaaaggaggcagccctttggttgttagccggccagatgatgcatcggaggtaggtcgagcgctagccaacagctgccggactgtttccggggtgctagtcgatgctcacatcggggacaagctcagcgaggagctgtttttacgggtggaaagccgaggcacgagccatgctaaggagttgctagaacagttgcaattctttcacattgttgcgtctctttcttttgcttaaaggaaaaagaaaaaatgaaaaaggctttcatatcctttttttcccctttcccttttgtgtgttatttcatttcccattgtaatgaaaagggatatagtattaattaattcacacacaaaagagagaggggaaaggatctcttttcttttttctttcttgttaactttgttttgtgtgtttttttgtgtgtgacatagttaatgaatattattaatacttttgtgttc

SEQ ID NO: 4822 - DNA, 397 bp, Gossypium hirsutum
  Clone ID: uC-gsronu33B159g06b1
agtttttattggaaagcgagtcaggactgattttatggcctgggaaacagcgtctttcgtacaaacaacacagatatcattcgtaggcccaagctaatcttcaggcctcttctcccatctatggcttcctgacacaacggttgacatatgacgaacaccgcgctgaaatacgataatcagtccgagatgatgaaggctaacttggctagcgatgctggtcaagagctgaccaggaagatcagtgactgactaccatacctatactgaccccgataaaatcgtattcgatgagggttcttacttcgttgaccgcacgaacggggagggtaccaacggcaactttgaagggggcatgcctgatgctatagtttcgcccaaggatgatgcttgtatgaag

SEQ ID NO: 4823 - DNA, 460 bp, Gossypium hirsutum
  Clone ID: uC-gsronu33B159g07b1
tctcttggaaagaatactaatattcctgctattgcaaaagaaaacaaaactaataatcctgtagaccatgcccatacttcagccgataggagagatttctgtccatctggaacgagtagctgggaagttgagtatggatggagatgataagaatgttaaaaacaaccactctgtgctttcagaaccccaactgtgggcagcacctaaaaagtcttggcaacagttatttactcgttctccttctcttcctcccgtctcaaatgcaaatgttattagtagaccgacttcgaagaataaaccagaagctgagggctcacaatttcctagtcattcaacaatacaaacatttgataatcctataaattgtggactaccatcggcatttatatctatgtacagaaatggagtccccagcagtagtttaggtttctcaccagctattggacccactttcccgtcg

SEQ ID NO: 4824 - DNA, 476 bp, Gossypium hirsutum
  Clone ID: uC-gsronu33B159g08b1
ttttagctgatatgtccttcccggaagagggtttccctgtgaatctcacatcacttgaaatctcaaatggacccaaaatgtatgcatcacttgttgaatggggattaaaatagactcacctctcttcaagagctcaatatcggcggtgagggatgctcacatgtggtgtcatttccagaagaagggacaggaagaatgctgcctcctcctctcacatctatctgcattgaaaattttgagaatttggaattcatgtgctccaagggctttcaacacctcacttcgcttcacgaattggaaatcagtaattgtccaaaactcacatctcttccagaaaaggatatgcttctttcacttgagcagctacatattttcaattgcccgttgctagaagaagggtgcagtaggggtaacggtcgagagtggtccaagattgcccacataccttatgtgcgttttcagtataaaacagtcat

SEQ ID NO: 4825 - DNA, 458 bp, Gossypium hirsutum
  Clone ID: uC-gsronu33B159g09b1
tggtccttttgaaaatggacgaagaatacatggagagcctttgcttgcagattctgaaattcaaaccagacttggaggttacagaaaaaggacttagagacttggcatgccacttatcttagcaaggctggtgtcagtgcagtcaggagggtgagacagactgacaacaacagaatcgcaaaggcatctggagctgttattgtgaatcgtcctgacgaattgcaggaatccgatgttggtactggagctgggctatttgaggttaaaaaaatcggggatgagttctttgcattcattgttgattgcaaagatccaaaagcttgtacggttctcttaaggggtgctagcaaggatctcctgaacgaggctgaaagaaatttgcagtgatgccatgtctgttgctagaaacataattaagaatccgaaacttgatcccggaggtggtgctacagaattaa

SEQ ID NO: 4826 - DNA, 575 bp, Gossypium hirsutum
  Clone ID: uC-gsronu33B159g11b1
ttttcgcgtccggccatttgagccgacacttcactaaaataaccatccttcattaacagcatctctttttcttcatacatatgagagaaggagcaacagcatcagaaaagaagtagtggttcatcgtcgaggaagagtagtagtagtgtatgtgatggagaatcaggttgtttcgccaccccatgtggatgcatttcgaccgtccctcggcttccctcttggcactgccctcctcttaatcatcattttcagcttgagtggtatcttctcctgctgctaccactgggacaagctcagatcactccgccgatctcccgccgaccgcaccgatccccatcccgatatcgaagcttctccctccaaacccatgcctgatttcttggatttaaagaaaaaccaaagccaaagcctacctgtattaatgccaggagatgagatcccaaaattatagcattaccatgtccgtgtcagcctccacggcaagacaaggttgaagtgaaaattgaaaagccacccaagccagcgcgttgcccagtacctgttggattggctatttgaccacttgttgtacataa

SEQ ID NO: 4827 - DNA, 536 bp, Gossypium hirsutum
  unsure (1)..(536): unsure at all n locations
  Clone ID: uC-gsronu33B159g12b1
cagaggattcatacagcagcagcagcagccatcgaaattatctcaagaacagcaacaacaacaacaaagtccaaagctttagcccatcaacacccccaccaacatcggttaattaccgaactgctaaacgaagaaaggggattccacatagagccccaatggcaggtctaatcatagaatattaagccatactatttaactattattgccccacatatacaaaggtaattatcttgtatatagaagcagcaatggtgaacaaaaaggggataaacaagtggtataataagctccaaatctcaaggacttgaatgatattattaagttataaactttttttgttttggtcttttctattagtttagggcttagggtttcatttttagggtgagtttatacatataagtttctcttcctagtttttttttgaacaaatagtaatggggggatgaaaaatgtaaatagggttttctttttcttcttttcttatggntntagagaaaaagggtagtgaaaaataaagaaatagaagccat

SEQ ID NO: 4828 - DNA, 550 bp, Gossypium hirsutum
  Clone ID: uC-gsronu33B159h02b1
gagttcttacagcctaagatcgtcaacggtccaggtggttatgttcttgaagatgtccctcacttatcggattacatccctgatcttcctgtttattcgaatccgttggcatgacaatcctgcatactcagttgttaagcaatattttgtccatgtagatgacaccgttcctcaaaagattgttgttcacaagaatagtccaagaggagtacatttccgacgagctggaccacgtcaaaagatatatttcgactccgatgacgttcatgcctgtattgtaacgtgtggtggtctttgccctggactcaacaccgtgattagagagatagtatgcggcttgttccacatgtatggtgtgaagaaagcttcggtgatagatggaggattcggggtttttatgctaaaaatactgtgcatttagatcctaaggttgtcaatgatatccatagacgtggtggaactatccttggcacatcacgaggtggccatgatacctcaaagattgctgacagcattcaggatcgtggtattaatcaggtttacattattg

SEQ ID NO: 4829 - DNA, 546 bp, Gossypium hirsutum
  Clone ID: uC-gsronu33B159h04b1
cctatgcgtccgcccacgcgtccgttcaatttctgggggttctctgaaatccattgggtccagtaagcagctggggcaattcctccctcgactccgtcgatcccgaaatccatgacctcatcgagaaagagaagcgtcgccaatgccgcggcatcgagctcatcgcttccgagaacttcacttccttcgccgtcatcgaagccctcggcagtgccctcaccaacaaatactccgagggcatgcctggtaaccgttactacggcggaaatgaattcattgatgagatcgagaacctctgcagatctcgcgctatccaggctttccacctcgatcctaccaaatggggtgtcaatgtccagccttattccggttccccggccaacttcgctgcttacacggccgttctccagcctcatgataggatcatgggactcgatttgccttcaggcggtcatttgactcatgggtattatacctccggtgggaagaagatttctgctacttctatgtacttcgagagtttgccttacaaggtgaactcactac

SEQ ID NO: 4830 - DNA, 558 bp, Gossypium hirsutum
  Clone ID: uC-gsronu33B159h06b1
ccttttcgtccgcactagggttttaagagaagatcggaatggtttcaaaaaaatttgcttccatggccttctttttggcactcaacattctcttcttttccctagtcagtgcttgtggctcttgctcttcacccacccctaaaccaaggccaaacccaaaacccaacacccccacccctactgcatccgcacgaggcaggtgccctagagatgccctcaaattaggtgtatgtgccaatgtgcttaacttagtcaatgtcaccgttggttcacctccagtgatgccatgctgttcccttctcaatggccttgtcgacctcgaagctgctgcttgcctttgtactgctatcagagctaacatcttaggcatcaaccttaacatcccagtttctcttagcttgctcctcaacgtttgttcaaggaatgttccaactggcttccaatgctaattaagtcatcacttttccctccattctttctcaacttccttggggtgttttgtgttggtttttataaagctatgatgtcataacttcattgctttaattcggatcattc

SEQ ID NO: 4831 - DNA, 59 bp, Gossypium hirsutum
  Clone ID: uC-gsronu33B159h08b1
ttcacgcgtccggcttaagcacgtgtgctttaggggaaaggttcgagggttgttattcc

SEQ ID NO: 4832 - DNA, 490 bp, Gossypium hirsutum
  unsure (1)..(490): unsure at all n locations
  Clone ID: uC-gsronu33B159h09b1
ttttcgcgtgggaaattgtataagaaatggggcggtgagttgtactcgaagcttagaaggctccagctggtgaatcagttgtggagcaataacaaggatatgagccattgtaaaggacagtgctgccattgttgcaaagttaattaggttcgtagagcaaggaaaggccctgaaggaaatgttcgggcttagctttacacctccacacccaaggcgaagaagctatggttggaaaaacagcatggcatcacttttttgaaagctttttgttcatgcctacgttacaacacaggtttagaggtaatttctggaaaattgtaggccatttaacattgtttttgtgatttatttttttgcggggttaaataacagattgtgatgacctttcataaggtggtgtaaaaatatgtatgtaaaatcttaaccggagtggattagagattntaaatataaattgttggatgtaattgtacaaacttatgatgggttt

SEQ ID NO: 4833 - DNA, 339 bp, Gossypium hirsutum
  Clone ID: uC-gsronu33B160a01b1
attaataataccccaaaaaaaaaaaaaaaaaaaaaggggaattttttaaaacctttttttgttttacaccccccccccaccatcataattaaacactatctttctccccccctccctgccccctccctggcttccctcttcttctccccttacttctcttccctcgcccgccttctttcccccgtctcttcccttttcatcccctgccctttcccccccttttcccccctttggttcacttccccgtttgttcccgctctctttccccctcttcgactctccccccgtccccccctgccccctttttcccccccctttattggcccttgcccccccccc

SEQ ID NO: 4834 - DNA, 78 bp, Gossypium hirsutum
  Clone ID: uC-gsronu33B160a02b1
cccactcgtccgcccacgcgtccgaacctctctccctgtctcttttgacttgaatattataacaattctaagtactgt

SEQ ID NO: 4835 - DNA, 533 bp, Gossypium hirsutum
  unsure (1)..(533): unsure at all n locations
  Clone ID: uC-gsronu33B160a03b1
tgcttggctangagttcaatgaatttggcgtcgatggtggtccattggcgaaggttctgaggccaaagttcaacgtcttctcaaagactgtgtcgtctcacacagggttgcaagtgcctgaatttgatatcaagtatgtagttgctgctgctgtagcctttaaaggtgttgggagtattctctttacctttggcagcaccgtcggagcttatcttctggttttgcaccaactcgttcttactcccattgtttatgacttctacaatagcgacacggtacagaatgaatgtggtcccgagctcacaaggatgctcataacgcccgttgcgtacagtacaggcagaaaactaaaaggaggctagaggagcttgaacaggtgaagaccaagtactatgaaatgcttccaatcttcaagcagatgcaaactgaaaaccagcagatgaaaatggagttgaagcaaaacgagtctataattcaatatatgcaaaattgtattcaacagtttaagactacatttgaggcacaggggcaaa

SEQ ID NO: 4836 - DNA, 554 bp, Gossypium hirsutum
  Clone ID: uC-gsronu33B160a04b1
gatgatgcttgtttatgagtatttgccaaataaaaggggtgattactatctctttgacgagagcaagtctccttccttggattggactacaagatttaagataatcacaggcattgcaggaggtctcctctacctgcatgaagaggcgcctcaaaggatcattcatatagacatcaaagccagtaacatattgttggatcaacaattaaacccaaaaatctctgattttggtttggcaaggctctttcctggggatgatactcatgtaaatacttttaggatttctggcacccatggttacatggcccctgaatatgccatgcatgggtatttgtctgtgaagacagatgttttcagctatggagttgtggtcttggagatagtaagtggcagaaaaaaccatgatagccgtcttggttcagagaaggcagatctcttgaactattcatggctgctatttcaaagcggaaagatgttggatttagttgatccaaccctcaagaaatacaatcctgacgaggcagcaatgtgcattcagctaggcttattatgct

SEQ ID NO: 4837 - DNA, 407 bp, Gossypium hirsutum
  Clone ID: uC-gsronu33B160a05b1
actgttcccgccgccgttgtaagctgcctggttaaggccccaaactcgggggactttttaaagctaactagctgtactaacgcgaacctccggggctagcttctgataacgtgtatggccctgttgctagacgaagaagcaaagcagaattggacgggaaactcggagaccacaagttaggataaatgcgacatgaatttggcaagcaaaagcggtggctccaatgacgggatgctgaatgaccaatgatcgaaagctgatctagccctcggttcgactcgcgccgacggagagcgtgagttcatgttctgggggaatgctatcgacgatccacggtcgcattctagcggcgagacacctcgatcgtaacggagcactcaggagaaacactgtgcctcgctcacgac

SEQ ID NO: 4838 - DNA, 499 bp, Gossypium hirsutum
  Clone ID: uC-gsronu33B160a06b1
atggcttgtggggttgacatcaagacgaaatcatgcgcaacaaaatgcaagagatttaaatgatcacaagtagaaatttgactctagaggagattagtgtgtgtgaaggagctgcatatattagaaaatgaaagattgggctgctcccttcgtagctgcagcactgtttgcatttctatcaccaggggtaatcttgcaaatcccagggaagaatcaacccatcggttttatgaacatgaaaacaagtgtggctgcaatttttgtgcatgctgttctctatgctttgttcctcatcctgttccttgtggttcttcatatccacctctatgtctaacaacaaaggcactctctctatctaacaagattagattttcattttgtattatcctgttttctgctcccatgaagaagaatttgctactgttatttagcttttgttgtttattcacattgcttctatgttattcagacttcggttatgattatcaaacatagcatt

SEQ ID NO: 4839 - DNA, 488 bp, Gossypium hirsutum
  Clone ID: uC-gsronu33B160a09b1
tttcattttttttttcttccttttgttcgtatgggccctgtttttcagttttgttctttatctagaagtgttgacttcgagtcaatcatcaagttttcgaaagattcaggcaaatcaaatggtttggaacggaaaatagttgatagtagataattgtgggtaataaaatcgagatgcagctaaagttttacaacagaaaacaagtcaaaaacttagtgaaggttagaagaaaatagtggtatattactgaagctcattaatggagggtaaaggtaccaaatcggggaaaacccgagctcaaaaggatgctcataacgcccgttgcgtacagtacaggcagaaaactaaccggcggctagaggagctggaacaggtgaagaccaagtactatgaaatgctcccaatcttcaagcagatgcaaactgaaaaccagcagatgaaaatggagttgaagcaaaacgagtctataattcaatatatgcaaaatt

SEQ ID NO: 4840 - DNA, 265 bp, Gossypium hirsutum
  Clone ID: uC-gsronu33B160a10b1
tggttgagttaagttcatatgatatgtactctgggagtttatgttgcaggttgtacttttacgtacatgcaacgtgggctggtgtagaaggttccttttattttattttttttttatttttacatttatcagtacttggagttgaaattttacattccaatattattatcattcggacatgaatttggttttgtttggtttggtttcaatgttgtaatgctaaattcgagtttattgaatgttaattcagtcctgttttgaactt

SEQ ID NO: 4841 - DNA, 119 bp, Gossypium hirsutum
  Clone ID: uC-gsronu33B160b01b1
cccatgcttccggctcttcttgcaagatgtattatgttgttgtaaagcttgtatgatttatgctctggaaagttgtcacaaactctgtaactcctcttcaaatttcaatctattgcatt

SEQ ID NO: 4842 - DNA, 231 bp, Gossypium hirsutum
  Clone ID: uC-gsronu33B160b02b1
ctttttttgctttataaagccgatgttagtgcgtcagccctagaggctgctgaatgtttcgaggctgctgcatttcttgaagaatctgcaccaattgaaccctttagataaaagaaacaactttgcccgcattttgtttttatgtaattttggacatgccatttttgtaaatcttataggttaggctatctaacatctaaaaatgttgaaaatttttacgtgagttgcttc

SEQ ID NO: 4843 - DNA, 511 bp, Gossypium hirsutum
  unsure (1)..(511): unsure at all n locations
  Clone ID: uC-gsronu33B160b07b1
ctatgcgtccggacatttgcaagggatatgacccttaagtcaacgaaagctttagtgcagcccgcttcaatcccggatgaccttgatccttggagatccaagcttctatgggcttctcgtgtgctacctatgccactcgttggtcttcttattattagcggtgtttgtgctgatggaggaagccaagcatccaattatcccgagctagaagctttatcaaggcttgattttggtgccgccatgaaggttttcctggcaaaacgactaacctccgagttcactcaagtgacagccgatgtggaagagaaatcggttatcatcggcgagaggaacagggctgcaacagaagcattgagacgagcggtcaatgatggtcataacaagatagcaatactatatgggggtggtcacatgccggacttaggtaggcgtttaagagaggaattcgaccttgttccttcccgagtacattggataacagcttggtccattacgaaacangatctccaga

SEQ ID NO: 4844 - DNA, 399 bp, Gossypium hirsutum
  Clone ID: uC-gsronu33B160b08b1
ttctcgcgtccgtttatggctgcgcaaagaccgtaccatgccaacagtgttcacaacggtaaggccagagcgagtcatgatcttacccggactcattctgtggaacgaggggaccgcaacgttgcatgagatggctcacctagtgagcagcagagacgataggacagacgaatctgacgaggtgagagcaaccgctgaaacgaagaaaatggacgagctgattcacgaggacaaggggaacggcaccattaccaacgatctgatctacaatgaacagaattctaaatggtgaacactacgccatacatatgctacacgataggtgcctgtgtacagactgcattgtatgaaacctaactacagactgtggtctacgcacagactagcggttagacgacg

SEQ ID NO: 4845 - DNA, 542 bp, Gossypium hirsutum
  Clone ID: uC-gsronu33B160b09b1
ttttcgcgtccgttcaattgttgattcgagtattgagcgaaaggttacacctatgggtctgtattgtgggtcaaccctactacactagtaccaataggcggcatagaggaagaagcactacgcctaggaatcaacaacacgaaaactttgttattaatgattccctttctttatcgggatcggaactaagagaaatggttgggacaacaaacatccatcttgttcgtactttggatacccatataaccatcgaagattgttgaagtgactaattcctggaaattaaggagcgttgagaacaaagaaattgttggagtttacttttttatctagtacgaacacgcttgatggtaagaaaagatcttttgcaagagggttggctagagatttcttgtaaaaacattagccccgctcagttcataatgacaatatttcgaccttttttttaattccatggattattctcattatgcacataaaggaggagccgtatgaggtgaaaatctcatgtacgggtttggaaacgagaattctttgaatcg

SEQ ID NO: 4846 - DNA, 545 bp, Gossypium hirsutum
  Clone ID: uC-gsronu33B160b10b1
ctacgcgtccgaccacgcgtccgggcgctgatgggatcattacatcagagttttgtcaaaatggcaccgaaagatgtaatgaagctcttgaaaagctagagaagaagtatgacattgttgtgaatattcagggagatgaacctcttattgaacctgagataatagatggaattgttaaagctctgcaggcagcaccagatgcagtgtttagcactgctgtgacttctttgaaaccagaagatgattttgatccaaatagagtgaaatgtgtggttgataatcgtggttatgctatttatttttctagaggactaataccatttaacaaatctgcgaaagtcaatccacagttcccttacatgcttcatcttggaattcagagctatgattcaaagtttctgcaaatatatccgaagcttcagcctacaccactgcaactagaagaggatctggaacaacttaaggtccttgagaatggctataagatgaaggtgataaaggttgagcatgaggctcatggagttgacacacctgaagatgtggag

SEQ ID NO: 4847 - DNA, 411 bp, Gossypium hirsutum
  Clone ID: uC-gsronu33B160c01b1
cccactcggccggcaagcaaacataaatccgacgggggggtttttaaagaaaattttggaaaaaaacaccgctaaagcatatgaaaagaaacaaaaagaaaagggaggacggataggaggaaaccaagcagggggggggggtttgggggagcgaggcttcggttccggggcgggcgagggcaaagcttttgtttggggtgcccgacaccaaattccggggccggggtgttacaaccccaggttgggaaaaccgagggctttccccattttaatgttgtgggagtacatccccgttccccccggggcggactttcaaaaagggcccggcccggtagcgcttcccaaaagtggccatgcctgaagggtaaaggggaggggccctggaggggaccttaaacacagccggggggg

SEQ ID NO: 4848 - DNA, 545 bp, Gossypium hirsutum
  Clone ID: uC-gsronu33B160c03b1
ggtgatttgaagcaatttatgacatatgccgtcgttcccttgatattgagaggccaacttacactaacttgaaccgtttgatatctcaaatcatatcatccttgacaacttctttaaggtttgatggagctatcaatgtggatgttactgagttccaaaccaatttggttccatacccccgtatccatttcatgctctcttcatatgcacctgtcatctcagctgagaaagcataccatgaacaattgtcggttcccgagatcacaaatgctgtgtttgagccttcaagcatgatggcaaaatgtgaccctaggcatgggaagtacatggcatgttgcttgatgtatcgaggagatgtcgtccccaaggatgttaatgctgctgttgctaccatcaaaacaaagaggaccgtgcagttcgttgactggtgccctactggcttcaaatgtggtattaactatcagcctccaactgttgtacctggaggagatctcgctaaggtgcagcgagctgtttgcatgataagcaacaacacagcagtggct

SEQ ID NO: 4849 - DNA, 492 bp, Gossypium hirsutum
  unsure (1)..(492): unsure at all n locations
  Clone ID: uC-gsronu33B160c04b1
ctgtcttgtgggctctgggttggcaaacaagaaaacagtcaccattcaaagtgggggcaaagaccagtctgtgctgctagcaaccaccaagactaagaagcagaacaagccttcggccttgcttcacgagtcctttatgaaaaaggagttccccaggatggccaaggcggtcaaaaaccaggtgacagacaactactacaggccagatttaacaaaagcagcccttgctaggttgagtgctgtgcacaggagtctaaaggtagccaagtctggtgttaagaagaggaacaggcaagcattgaaggttcgtggctggaagtgagctagacctttcaggttgtatgagctctgctattttcattgccccagacatttttttactccttttttgaatttgtcttatttttcatggtttgaactgagttgttgaaactttatatctagatagattntgaaacaacagagatttggagctatttagccctttaattt

SEQ ID NO: 4850 - DNA, 523 bp, Gossypium hirsutum
  Clone ID: uC-gsronu33B160c05b1
cggtgaactcaacgcccaacagggtctcgagggcgcgggcttctatctgtctttgaaccatatcgagtcaatcgacgaacagaaggcagctaaagaggcaaagccatggtctcaccagcggagccaccgaaccaccaactccaccgcaacctcaccaacttgctccgcaccaccttctctacccaggccacttctaaaaccacaccgtcccttccaccttccaaaatctccatttctcctctcctattcgctgactcgcttctccacctcactccctcgcccttcgagtcaactcaacatgactccgtttcttctaaatccacaatcaagggcgtgtcttcggccgagtctacctccggcttcccatcaacggtcagggtttcgggactcgcttccagtggaaagcgtggtggccccgccttcgttggccaagtctttagcatgtgtgatctttctgggactggtcttatggctgtttcaactcacttcgatattccctttatttctaagaggacaccgcagt

SEQ ID NO: 4851 - DNA, 483 bp, Gossypium hirsutum
  Clone ID: uC-gsronu33B160c06b1
gttcgtgacaaaaatcaaggtacagataatggctttgggtagtcttatatacagatttgatgaaaaataaaaattatattttccttctatcatttggctgtatattctgttactgcttcttctcgtgtattcctgtgcaaactcggccatacagagaagcgaggagaagtgcgaaggaggccatgcgaggagccactcgtgggagccccaactctctggcctattccagaagcttctagtgctctcatctgctgtactctttttttgggcgtattgggcctcgggtttgggctattgggctttaggatttatttaattgggtcggattttattggacttttaatggattgattttttatttgtgcattttagtttttggggtttgaaatggactttggacctataaacgatttggcctgcatttatcttagttgctatattaaatctcttatttttggttaaaaaaaagaaaaaaagggcggc

SEQ ID NO: 4852 - DNA, 465 bp, Gossypium hirsutum
  Clone ID: uC-gsronu33B160c07b1
tcttcgcgtccgggagaaacgcagtgtgacatgggcacccaatgtgtacgatcctccaccgacatcgctattgcatatgattagaaacaaaaggcaacacaagttgaagaggaacaacaacgacaaaaagaaaataggaaggaaagggttgaaaggcaccaagtcgacgcgaggtaacgtcggcaggaaaggcgtcaaacaaattcgcagaagcagcgaaagttcttataggtggtttaaagaactggtggttgaagatagagtagttaatgagatcgacaatttcaacgtcgacaagccggacccttattgtggcagcggttttttaactcagtcgtcgaccggaatgtactactctgtggcagaggctctatgagtatgtcttcttattcacatcatggggaaatctatgcctttatttttttctattctttaatagggttcgtaaataaataagcattatgc

SEQ ID NO: 4853 - DNA, 509 bp, Gossypium hirsutum
  Clone ID: uC-gsronu33B160c08b1
ttcttcgcgtccgcccacgcgtccgcccacgcgtccgcccacgcgtccgcccacgcgtccgcccacgcgtccgcccacgcgtccgcccacgcgtccgcccacgcgtccgaaaaaaagaagaaagaaaagattaaagagctttgcaaaaatggtgcttcaaagattggagatgtgcgttgaattgatgaaactagccgtagagttcgtcgtggttgtggccgaagcagtcggaatagtcattcatcaaaaccactcgccgccagtaatgacggctagccggtccttcgctactccggttcccttagtcgggtttcttccttgatgatcagtttcaattttctgaatttttcttcttttttccttttcattagagaaaatgatcggtttgaatcctcttcaaatttttgctattgttgctttactagctacgtttgggaatttgaatgtgtaaatttaggctaatcatgtattttaaggactggaaaagtctattttctatttgaatttct

SEQ ID NO: 4854 - DNA, 545 bp, Gossypium hirsutum
  unsure (1)..(545): unsure at all n locations
  Clone ID: uC-gsronu33B160c09b1
tgtgatcaaaaacagcaagagaaagataagagtgaaagataaattcatgtatttttggcataagatgattttccctgttcgtagattttggtttactgtttcttctcctctcaaagctcgcaaaaacggtgcagggctattgaaactacgtgatgatatacaaacatgtgggtaccaagatgtgcaggtgatgtgggagatgctgagaagatccgaaactgagcatcatcatcctcatcccaagcgcaagcaacgacccttttggcgagtttttgtatggtcttcttctaacaacacttcttcatccacatccttgtcggccgatcatgcttgattttgttgacagccatttggatttggggtacttgatgatgatattatagtatactctatgtaataaaattttgttcctactgtcccctgcaatgctttttacataggcatcgttgttttagaaccccgatggacggcctgctggccggtatgcgtngcagtggcatggtacatataggtgttttgccaaccttgttcaaatggaaatatta

SEQ ID NO: 4855 - DNA, 502 bp, Gossypium hirsutum
  unsure (1)..(502): unsure at all n locations
  Clone ID: uC-gsronu33B160c10b1
tctttgtttatcagagcaagaaaaagaagggaaaatggaagggaaagaagaagatgttagattgggagctaacaagttctcagaaaggcaacctattgggacagcagctcagtcccaagatgataaggattacactgagccacccccagcacccttgtttgagcctagtgagttgacttcatggtcgttttaccgagctggaatcgctgagttcgttgctactttcctattcttgtacatctcggtgttgactgtgatgggagtccttaaggacaaaaccaagtgtacaactgttgggattcaagggattgcttgggcttttggtggtatgatctttgctcttgtttactgcactgctggtatctcaggtggtcatataaatccggcggtgacatttgggctgttcttgggaaggaaattgtctttgacaagggcaatattctacatggtgatgcagtgcttgggagctatatgtggngctggtgtggtttaagggttcatg

SEQ ID NO: 4856 - DNA, 403 bp, Gossypium hirsutum
  Clone ID: uC-gsronu33B160c11b1
tcttcgcgtccgtttctctcaaaactcaacctctgaaatcctctggaccttttttttttcttccaatccatacagcacccaattccatggccacctcttccccacgtgaggataatgtctacatggcgaagctcgccgagcaagccggcgctaccaggagatggtgaaggtcatggagaccggtgttttcggcggacccttcttcgaccaggttttcgtcgaggaaaggaaccttctttttggcgcataccagaacggcattggcgcccgacgcgccttctggaggaacggtttcttcattgagccaaaggaggaagaacgcggaaacgccaaccatgtttccgtaatccggaggtccagggccaaaatcaaggttgatttgtccaaaatttggcccggaatt

SEQ ID NO: 4857 - DNA, 543 bp, Gossypium hirsutum
  unsure (1)..(543): unsure at all n locations
  Clone ID: uC-gsronu33B160c12b1
tatacccaacatttgtacaaatctacattctcaggctgcttgtctagctttaggtcaccaaacttttctgggtcattgagacttgggcctaaaggtcagcctattaggatcaaatacacccaattgttgaagaaccctagaagaccctcactctactttgtgaatttgattggaattagggttggaaggagggttgtcgatatcccaccaaaggcattggctttcaacccttccactggtgctgggaccatctttgattctggtactgttttcacccggctagtagaaccagcctacgtagcagtccggaatgcgttccgaaggcgagttaaggtggccaatgtgacatccctgggagggttcgacacatgttacacggtccccatcgtggcgcccaccataactntcatgttcactggcatgaacgtaacactgccacangagaacctactaatccacagcacagcaggcagcataacatgcttggcaatgggcgtcggaccggacaacgtgaactcagtgctgaatgtgatagccaatatg

SEQ ID NO: 4858 - DNA, 74 bp, Gossypium hirsutum
  Clone ID: uC-gsronu33B160d02b1
ataataaatacaaacaaaaaaaaaaaaaaaaaaaggggaaatttaaaaaaaatttttggttaaaaaaccccggt

SEQ ID NO: 4859 - DNA, 546 bp, Gossypium hirsutum
  Clone ID: uC-gsronu33B160d05b1
gtgtatttcaatttgaagccttcttcgaaattcctctttcaagatgcaaattttcgtcaagaccctcactggcaagaccatcacccttgaggtggaaagttctgataccatcgacaatgtaaagaccaagatccaagacaaggaagggatcccaccagaccaacagaggcttatctttgctggtaaacagctggaggatggccgtacccttgctgactacaacatccagaaggaatccacactccatttggtcctccgattgaggggtggtatgcaaatttttgtcaagaccctcaccgggaagaccatcacccttgaggtggaaagttctgataccatcgacaatgtaaaggccaagatccaagacaaagaagggatcccaccagaccagcagaggcttatctttgctggtaaacagctggaggatggccgtacccttgctgactacaacatccagaaggaatccacactccatttggtcctccgattgaggggtggtatgcaaaattttgtcaagaccctcaccggaaagaccatcacattgga

SEQ ID NO: 4860 - DNA, 527 bp, Gossypium hirsutum
  Clone ID: uC-gsronu33B160d07b1
tgtgtatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgtgtcttgtgtaatagaagctttgtttgtggtgaaaataatgtataagccagttggttgggagcaaattttccttttgtccaaaggattttttgctgctcattcatggtgacttggtttatggttttatctgttgttaaaatcttataaaaatatatatcgattgctgctcttggtttgtatcaaatctttgtctg

SEQ ID NO: 4861 - DNA, 524 bp, Gossypium hirsutum
  Clone ID: uC-gsronu33B160d08b1
tttctctgagatgaaaagaaagataataggcaaagaatttatctgcatctttgatgcttttgctcatgaattggagcaaaaattaggaaagaagccggcttttctggttcaaggaaccttgtatccagacgtgattgaatcatgtcctccaccaggaagtggaagaacccattcacacacaatcaaaagtcatcataatgttggaggacttcccaaagacatgaagttaaagctcattgagccacttaaacttctcttcaaggatgaggttcgccaactcgggaggatattgaaggttcctgaaccatttttgaagcgtcatccatttcctgggcctggccttgcagttcgagtcttgggtgatgtaactgaaggcaatgccttggacattgtgcgccaggttgatgaaattttcattcaatccatcaaagatgctggtatttatgattcaatttggcaagcttttgctgtatttttgcctgtaaaatctggtggagttcaaggtgatcaaaggacacattcat

SEQ ID NO: 4862 - DNA, 546 bp, Gossypium hirsutum
  Clone ID: uC-gsronu33B160d09b1
tgataaagtctgggaaaacaaatgacaagcaaaaagacgccggagaaaaagctggtgatggtgaccatggtccaaagaataattcagcagagaagaagcctgaaccagccgctgccaaaaatagcggtgttggtggcggtaaaggttctgctaaagataaccagcatccaaaagcggaccaaatgggaggtaaaagcgaagaacctgaccctacccaaattactgctgctggtggtaaaaagaagaaaaagaaagggcagaaaagcaaccctggtcccaacggtgatacaccaccaccacccagtgacactcagtcagccatggcagtggcactcccagtcccagtcccagccccagaccataccccaccaccaccaccaccacccaatgcttcaatcgatctaaatcctacaaatcaaccaatgtatccttacacacctatgtactatggacctccattttgtggggtaagttacaacaccatttaccctagctcaagctcttcatattatgctcccgccatgcattctaatccatacggaccac

SEQ ID NO: 4863 - DNA, 541 bp, Gossypium hirsutum
  Clone ID: uC-gsronu33B160d10b1
aatagctctcttggtgcaggccactgtctctttggccatcctaacgtgtccctttggtccacaatccattcggccctagagttcctcttggctcgcgccaaccgcttcctggcttatatctgaccgtactcatcgaagaaagccatccttttttgctgtcggacaaaggcttgcttgctttgtcttattctctccttgctgtgcaactagcgatatttgtttggtcgcgataatttgaatcccatttgtggccctctgcactccaaattcatcttgtcacttggccactctaacggtgggcaaaactgtgctgtacaaaacaactctaaaattattatggaaaaacgaattgaactcgaaaaacgggggcgcagtcccgatcagatcaaagaacttaacttggacaactgtcgtagtgctaatatttgtggcctcgacgattcttttgtcgcttggaagtttaagcatgatcaacattggcttaactagccttaaaggtttcccaaaattactcgatcttacacgactcgaattgagtgac

SEQ ID NO: 4864 - DNA, 411 bp, Gossypium hirsutum
  Clone ID: uC-gsronu33B160d11b1
tctatcgcgtccgatcgatacttacgatgatcaccgaatggccatggcattctctctagccgcatgtgctgaggttccagttaccatcaaggatcctggttgtacccggaaaaccttccctgattactttgaagttctcgctagagttacgaagcattgaatgacttactttagagaaagcaagaaaagcacgagagagagaggtttgtaccaccgtccttaaaaatcataggacgaaaggcaatcaaacctcgtcttcgatgttccatctcgtaatctaataattccgcaatcggcagctcgggtttattaccgtttcttcctagataatttatttttctacttgtaatgagtgagtagttggtctttggtcgctgtcatgaagactgttatgttaaacaatatttgctc

SEQ ID NO: 4865 - DNA, 370 bp, Gossypium hirsutum
  Clone ID: uC-gsronu33B160e01b1
tcaaagctcaaagccgctcggatggtgctattcttgaggagaggaggtccaaattaccagaggggcctcgcgaaaatgcgggcacttggagaggaaatcggaatccctatcgaggtttatggtcccgaagctacgatgaccggtatttgccagcaagctatccaatatatcagtgcagctgcctaagtagtcggttcgggttcatgttcggtctctgttttttttttctccgtttcaagtgggtcattttcattagatttcccttttgccatgttactgaaacatttggaatttatttgctgaaaagtgaacatgaaatcttaggcataaatggcatttgtcagcaataaagatcttaaaaattttctac

SEQ ID NO: 4866 - DNA, 400 bp, Gossypium hirsutum
  Clone ID: uC-gsronu33B160e02b1
attttataacaaaacaaaaaacaaaaaaaaaaaggggggaaataaaaaaaaatatttgggaactacaaagccaccatataaaagaagaaaaaaaagaaaaaaatgggggggcaatttttaagggatctaggtttacttacgcgggcttcatgaattgttttcgtttttagggcacctatcttgtgaagatggaagagcataataactttactgatggggaaactcgcaatttcttctatgatgagcacgttgcaagacatcacttttttgccagtgggcaatggaactaaaagcccaagccaaatcgcccttccaaacagtggcccaccctgaaagaagacaggaacgcaccgtggggggtctaataaggcgcggggggggtgggggtaacgcccagggg

SEQ ID NO: 4867 - DNA, 533 bp, Gossypium hirsutum
  unsure (1)..(533): unsure at all n locations
  Clone ID: uC-gsronu33B160e04b1
gtttttctctttacaaatttccctctcctttttcgggggtttcctcttaattttgctttttggttatggattgtctcttctgaatcagagaaaaccctaccttttttttctcttttatttctttgaattggaacgatcaaaagaaggaatgggttctgaaggatcgagggttgttgtgccaaggaatttcagattgcttgaagagcttgagagaggtgaaaagggaattggggatggaactgttagttatggaatggatgatgctgatgatatttacatgcagtcatggactgggactattattggcccacctaacaccgttcatgagggacgcatctaccagttgaaactattctgtggcctggattatccagataatccaccaagtgtgaggtttcaaacccggataaacatgacctgcgtcaatcaggaaactggagtggtcgaacctagccttttccccatgcttgctaatnggcaaagggagtatacaatggaggatatattgactcagctgaagaaagaatgatgtc

SEQ ID NO: 4868 - DNA, 405 bp, Gossypium hirsutum
  Clone ID: uC-gsronu33B160e05b1
cccatgcgtccgcagtgacagcctggtggtggaaagagtggtgcagaaagaagtagtgggtaaagggtggattgatcaaatgaaatgggaagcagataatttgggaagagagatagaatggaggttgctagaagaacttgtagaagaggcggtgaccgatttaactggtaagttgttttgaggtgtttttagttttgtctgtttgtcgtctttccccatccactattgactatataactatcccctattatttgtgaatttgtgcatttgattttgaagaaggatgatcctagccagcttattttgttgaaaataaaaaaaaaaatagaacattgataataaaaaaaaaaaacaagtggtgaactaaaaaagtggtatctgagatatttttgtagaggaatcggg

SEQ ID NO: 4869 - DNA, 53 bp, Gossypium hirsutum
  Clone ID: uC-gsronu33B160e06b1
gtgttcggtcaaacttctacggaaattatatttaatagctggttttggaatat

SEQ ID NO: 4870 - DNA, 514 bp, Gossypium hirsutum
  unsure (1)..(514): unsure at all n locations
  Clone ID: uC-gsronu33B160e09b1
tttttaggatgctcgtgtcaattgttggaacttgagccaggcagcaatgagacatgagactgagacctgtttcgtttatgctgatcagttgaagcaaagatgtgtggaacagttcaaagaagggactttggggattgaacagcttgccgctgttgatgggttatgcgacttagtttctaaagtggttgatgcatctgaacctgctaggacataccatgttaatctttcgattttcacttcgatccctgatttttggagtattggtcagatttttcccatagtccccattcatcgattggatgaaaggcctgaagtgagggggattttgtctgatttaacctgtgacagtgatgggaagattgataagttcatcggaggtgaaacaagcttgcctttacatgggttggaaggtaatggtggtggtagcagtggtggtgctaatgggcggtactattatgggatgttcttgggtggngcttaccaggaatccctcgtggagttcacaacctctttg

SEQ ID NO: 4871 - DNA, 541 bp, Gossypium hirsutum
  Clone ID: uC-gsronu33B160e10b1
cttagttggaggatatgaaaatagttgcaacgggtgtatgttgccaatctcggatccattttattactgttcagaatgtgtttttttccttcataaagcgtgtgccgagttaactaagatgaagaatgtttggcatcatcattgccaagagcctctttcccttatttctgacaaagcttttgagtgtcaagaatgttggcacatatctaatgcctttgcttatgaatgttgtggatgcgaggaaaataaatgtctccgatgtgtgattgctcttactcctggtgctcgaacatgtttgaaacatgttcaccccctctatttctacagagactacgacggtcagtgcaatgcttgtggtgatacaacaaggggatatggggcattttgttgtaaggactgcaattttgtgctagatcttggatgtttttcacttccaattacagctcgtcacaaatgcgatgagcatcttctttcactcactgataatgatgataatagttattcagagagtcatcattgtgatatctgcgaagaaagtcga

SEQ ID NO: 4872 - DNA, 495 bp, Gossypium hirsutum
  Clone ID: uC-gsronu33B160e11b1
ttgtacaagactctattcatcaggcctcccaagaacacctactcatttaacgagctcatcgccctgtgggagaagttgattggcaaaacccttgagaaaacatatgttcctgaggaccaacttctcaaacagatccaagagtctccaatcccaatcaatattatgttggccatcagtcactcaatctttgtcaatggtgattgcaccaacttcgagatcgatccatcattcggatacgaagcttctgagctctaccctcaagtgaaatacaccactgtggaagaaggcctcagtcgttttgtttgagaaagctagaaatcaaatcagatcattgttgttattaaactgataccagtaataattcaaaaactgtcactgagagatttgtgcagaggacttggggattctgtgtgtatgcatgtgtgtgtttatgtcataaatttctcgttactatcattcaacataatgccaaacatgctattcttcttgtgtcgt

SEQ ID NO: 4873 - DNA, 494 bp, Gossypium hirsutum
  Clone ID: uC-gsronu33B160e12b1
tgttctttgcgtccgcccacgcgtccgggtttttaaggcccattatcgcacgacgctggatcaccgtggccccaccatgggtggtggtcggagccacacgaaggtcagattttcggcctttttaagagctcctgaaaacaaagcacaccaaactcagaaaacatgaaagaaatggcctctcccccttcctttttagcctgattcagacaacggagagtagatctcaggagacgtgaccacggggttattccggtgtcagaggtgcaccagaggcatgtgaggtcagtgatggtagtggaggcgcgtgcggggagggctgaagtgacctggtgcgacgcctagggttctctctcccttcttttgctgaaaatatttagtgggctagggttgatttgggtagtgggctgatgtgggttttaggattgtttatttgggttttaagtttgggctgatggttttttgttttgggctataagtttaggtttatgggtttt

SEQ ID NO: 4874 - DNA, 534 bp, Gossypium hirsutum
  unsure (1)..(534): unsure at all n locations
  Clone ID: uC-gsronu33B160f02b1
ccttcgtgtccgcccacgcgtccgaaaaaaaataagaagagaaggctcgccgccttctcacgtctgcgctagggtttcaatcctagttttacaacaccgaaggctccgccgatttctggcctcacagccctcgtctaaactcctactgaggcggagtgagcgaggtttcagtcgacactaacacccaggtgtacgagggcagaggtcgacatggaggtacggaggtagaggcgcaagtgtatggaggcctgtcacgtgtgcaggggtaggccgaaagcgtgtgcagaggagatgcacgcgcgcaaaggcgcagcacgcgggggggggggggaagccttaggtttgactgcggctctggaaggagggctgatgctagggtttcttttagttttcgggccacctagtgattgggccaggtgtagttgggtataagcttgggctaggttaactgatttgggccacgttgggccattgtatttggactgtggactgttattaaccctttgatnggttaatttttttattacttttttt

SEQ ID NO: 4875 - DNA, 377 bp, Gossypium hirsutum
  Clone ID: uC-gsronu33B160f03b1
ccttagtgtccgctcctgttcaaccctgctgctctctcatccaaggtattgctgatcttgaagctgccggttgcctttgcacggcaatcaaagctaatattttgggcatcaaccttaatgtcccactttccctcagcttgcttcttaatgtctgctcaaagaaagtaccctctggcttccaatgtcgctaaatcagttctctaaattctttctctgcttagtgctgcgtggttttgatgttcttaaggtctagtttgcagtgatcaatgttttcttggtaactggttgtttaatttacgttgttgtagtgttgtttccttttggattgatactgaataaatgtaacactatatgaaaaagaagtttaatttctttgg

SEQ ID NO: 4876 - DNA, 439 bp, Gossypium hirsutum
  unsure (1)..(439): unsure at all n locations
  Clone ID: uC-gsronu33B160f05b1
cctacttttttttcctccgcggctacatttgcactctcgttccctagatatcaaagtgaaatgaaggaggtcgacgcctacttgcttgccgagctcggaggaaacgcttctccttccgccgatgacttgaaggttattctcggatcagttggagctgaggctgatgatgataggatagagttgctattgtactgaagttaaaggcaaagatatcaccgagctaattgcaagtggaagggagaagttggcttctgttccttctggtggtggtgctgttgcggttgccgctcctacagctggtgggcccggctnnantattactgtactttctaaatattttggagacatcctatcctaatcagtacctttggacttttcttggctaggaaggtgtcgttggttcgagccatattttacatgggtgctcagtgtttgggag

SEQ ID NO: 4877 - DNA, 88 bp, Gossypium hirsutum
  Clone ID: uC-gsronu33B160f08b1
ttgttcatccacaaaacaaacaaaaaaaaaggggggggataaaaaaaaaaattgggccgaaaaaccccaaaaaaaaaggggcggccgc

SEQ ID NO: 4878 - DNA, 532 bp, Gossypium hirsutum
  Clone ID: uC-gsronu33B160f09b1
ggcctcctaattcttcgcctctggttttcaccagccagaagaccaagcaagcaagaaaatgacgtcgttttgcaggacagcattaatggcggcttctagatccctctcttctcgacccaaatcccttaatttaagaaccctaaccccaaaacccatttcttctcctttctcttctccatcaacaagaaccctcccttgcgcttcaaggatcgtatcggcgttgggaggagtagagtcgatgatgccacttcatagtgccattgcttctgctcgattacaatcaaacatcgccgttgattcttccttctggagctggctctctcaagacttcgcggttcctcggtgacaagagtgagagcttccgtcattccaaaccgaactgtcttgcagtcaaccagcagttcgttttcatcccttttctgcatttctcatctctttgctggaatcattttctacctggtgcagaaaatgagttttcttttcttttcccccaaaaacattgaggagacattggatattgtcacatttgact

SEQ ID NO: 4879 - DNA, 535 bp, Gossypium hirsutum
  Clone ID: uC-gsronu33B160f11b1
ttgttatccaagcttctattcagttttgtaagagctatggctaaggacattgaggttggtggtgagttccaggccaaggactaccatgatcctccacccgctccattggtcgacgctcaggagttagccaagtggtctttttacagggctgtcatagctgagttcattgccactctcctctttctctacatcactgtcttgactgtgatcggttacaagacccagaccgaccctgctaagggcggtgaagattgtggcggcgttggcattctcggcattgcttgggcttttggtggcatgatctttatccttgtttactgcactgccggtatctctgggggacacatcaacccagcagtaacctttggacttttcttggctaggaaggtgtcgttggttcgagccatattttacatgggtgctcagtgtttgggagccatatgtgggtgtgggctggtcaaggccttccaaactcgtactacaaccagtatggaggaggagccaacagcctggctgaaggatacagcactgggac

SEQ ID NO: 4880 - DNA, 511 bp, Gossypium hirsutum
  Clone ID: uC-gsronu33B160g01b1
gcggtttaatcccaattcagcatctgctcttacaacttctggcggtttatatggatggtggcgaggagaagccaagcagtaggaaaaagatgagtgtggtggtaggaccatggggaggcaatggtggagctgcttgggatgatggaatttataatggggtaagagaaatcactcttgtttatgatcgttgcatcgactccatcagagtggtttacgataagaacggtaagcctgtaacggcggagaaacacggcggtgtaggaggaaacaagacagctgagattaagctaaaattcccagaagaattcttgatcagcgtaactggttattactgtcctgtggtttatggcgggagccctgtgattcgatcactgacgtttaagagtaaccgaaggacgtttggtccgtatggagttgaagaaggaacacccttcgcttctccgtagagggagcgcgagtcgccgggttcaacgggagaagtggatggtatgttgattcaatcggatttcga

SEQ ID NO: 4881 - DNA, 478 bp, Gossypium hirsutum
  Clone ID: uC-gsronu33B160g02b1
ggttgatgttgactacattagcgtgcccattgagggtgctaacatgccaactcactacgggtactgacgagagaatacaagagagagagagggagagagttggactataaaaaggaaccatacgacgggatggcttgagtgtctgtctttactataattgattgatgattggaggttagatggttagatgctgatctggataggagttagcaggaggtatggatggaaaaggatgctgtaaaacaaacggggattgtgattgaagaagaccaaagggcagtctgaataacgtaattgcgatagggtgtgagaagagatataccaattgacgtacaaaagatttagtaggatggtttcacaacatagttaagaaaggaacgttgactctcttggaatgtggtagctgttactacagcctggatcaaaggagaaggtccaacaatttggtttcttgccattaggttggcatatctggggt

SEQ ID NO: 4882 - DNA, 526 bp, Gossypium hirsutum
  Clone ID: uC-gsronu33B160g03b1
ccttagtagatctcaaaagaaaatttcaggcaatttcagaacgctaagcctagatcttttcttcacacttcaaaagtaagatggaaaagatgggtcgtggagttagcagtggtggtgggcagagctcattgggctatctgtttgggagtggagaagctccaaaaccagttacaaacaaatccgaagctgctccaattgaagcacaggatgtgtccaaacctgctcctgctcctcaacaagttgccaagcaaattcctgcgggtattaacagtacgcgtgctgatggtcagaacactggcaatttcattacggatcgaccatccaccaagattcatgctgcccctggaggtggatcttctctggattaccttttcggtgggggacctggcggtagcaaatgagatcgaatgacttaatatatcttgataatggtagtattatggttggtgattcttagggaagccatagatttcagatgttgctggtttcagatattatcacattaagcaatggaaacttaccgcat

SEQ ID NO: 4883 - DNA, 510 bp, Gossypium hirsutum
  Clone ID: uC-gsronu33B160g05b1
ccttttcgtccgagagttttcgatagatccgtcgagtaaattaagaaaaaatgggaggagcagaacatggagggcatggagcagaggatttcaggacgaaggtgtggagcatgtctggtggcccatattgccggcccaagcactggcgtcgcaatactgcgattgctatgttcggcgttttcctcatttgtatcccgatcgccatgaaatccgccgagctcgagcaaaggcctcatcagcccgttcgtccaattccttcacagctgtggtgcaagaactttggaaacaaagattatagatgaagcagcaatgatagttcagacaaacctacgggtggcagttcagttgtgtatttgcagtggatttggtaacatgccctatgatttgaatttgagactctgatcggtttagatttctatatgatcaataagttgtgaccgtaactttgccggtcaccttcacaaaatcttaaaactggcttttgtaagtgtttcatggttttggtatggt

SEQ ID NO: 4884 - DNA, 541 bp, Gossypium hirsutum
  Clone ID: uC-gsronu33B160g06b1
ccttctcgtccgcccacgcgtccggttttgcttattgcttctgcctttgctttttgcttcttactctcaaccaaaaatgactgctcaggccgacaaagagatcgaagagattctggcagcccatctcgaccaacaaaaaatcgattccgagaaaccagagcaacctgttgttgaagatgacgacgaggaagatgacgatgacgatgatgatgaagatgatgccgaaggtcatcatgagggagaaggagatggaactgttaggtcaaagcaaagccgaagtgaaaagaagagtcgcaaagctatgttgaagcttgggatgaaaccgatctctggtgtcagccgggtcactgtgaagaagagcaagaatatcttatttgtcatctcaaaaccagacgtgttcaagagcccagcatcagatacttatgtaatatttggagaggctaagattgaggacttaagctcacaactgcagagtcaagctgcagagcaattcaaggctcctgatctaagccatgtgatatcgaaaccggagtcatcaaca

SEQ ID NO: 4885 - DNA, 500 bp, Gossypium hirsutum
  Clone ID: uC-gsronu33B160g07b1
tcctcgcgtccgcaggaaattactgtaacaaccgagtactaaattaagggagatgagaagatgatctgcatgagctacaaaaagctggctgttgatctgaagcctgggaataccattttgtgtgcggatggtacaatcactctttcggtgttatcctgtgatcctgctgctgggactgtgagatgccgatgtgaaaacacagcgatgatcggtgagaggaaaaatgtcaaccttcctggtgtcgtggtggatcttcccacactcactgagaaggataaagaagacatcttgggatggggagttcccaacagtattgatatgattgctctttcctttgtacgcaaagggtctgatcttgtcaatgttcgtaaggtcctcggtccccatgctaagaagattcaattgatgtcgaaggttgagaatcaggagggtgttatcaactttgacgagatcttgcgtgagactgatgcatttatggttgcccgtggtgaccttggaat

SEQ ID NO: 4886 - DNA, 418 bp, Gossypium hirsutum
  Clone ID: uC-gsronu33B160g08b1
taatataaaaaaaaaaaaaaaaaaaaaaaaaaaagagagaaaaataaaaaaaaaaaagcgaaaaaaaacaaaaaaaaaaaaaaaaaaaaaagggacgacaaaaaagggggggggggtttgccgaacccggggttccgcccccggggtgccccggctgtcccccggattttacggccctggcccccttttaccggggttcggcttttgaaaggtggggcgcggaagaaccaaagctgtgcgcgggggggaaccccctggcgttcccggccagttttttgcgtgcgggggttgtcgcgtttggggcacggccctcattgtgttcacgcgccctggcagtgggccgtgcccccaggggggggccctttctcgcgggggtggccccccccgcttgggggggtttctccccaggggggtgggt

SEQ ID NO: 4887 - DNA, 341 bp, Gossypium hirsutum
  Clone ID: uC-gsronu33B160g09b1
ttgttcgcgtgggcggacgcgtgggcggacgcgtgggctcttcttagttgctgtcatcttctttgggaaaacgtctgctcataccgctgcgtctgactccgatccggcagataaggccggtgaagtcctccttgactacgttgctggccaaccccaacttgctgttgacaccagttacaagcctgagtagaactttcaagcctttactgtaatctctaactctctctctctctgctgctgtaacttcacctcttttcccttttcttttatttcctatcctgcgaactgtaaagtttgggaggaaaataataataaactaattgctagttgctagttgctgt

SEQ ID NO: 4888 - DNA, 525 bp, Gossypium hirsutum
  unsure (1)..(525): unsure at all n locations
  Clone ID: uC-gsronu33B160g10b1
ttttgcgtccgcccacgcgtccggatatatgcaaatgctctctaaagcttcatctgctatggcctcctttccttgttcaagggtgaggagtgggctttgtgtttggccaggcttgaggcaattttgcataagaaagggtctcgagtatggcttgcgcttattatcgatgcccctcaaaaccttgcgcggggcaagtcgttctctcagggtcgcggagttttgtagtgtcaccaacgtgtcttcctcattgcaaatcgaattggtaccatgtcttagagacaactatgcatatcttttacacgacgtggacacaggcacggttggagtcgttgatccttcaatagctatgcccattatcgatgctttgagtcggaaaaactggaacttgacttatatattgaatacccatcaccatcacgatcatactggtgggaatgcagagctgaaagcaaggtatggagcataggttatcggttcgggaatagacaaggataggattcctggaatngatatngttctaaatga

SEQ ID NO: 4889 - DNA, 213 bp, Gossypium hirsutum
  Clone ID: uC-gsronu33B160g11b1
ttttctactatgcttcactaggagtaaaggcaaatctggtgtgaaactaagtcaattatgatgactagtgagcatggatattgatgaatgttccattagtttttatatataatatctatatgtattctatatatttctctgcttcactgggaataaaggcaaatctggtattgaacaaaatattatgaataaaactagaagcttatattcttc

SEQ ID NO: 4890 - DNA, 321 bp, Gossypium hirsutum
  Clone ID: uC-gsronu33B160g12b1
ctacgcgtccgataatatttgactattaattaagggataattattatataatattgattatataaatgttagactagatccacctaattgtgttactgactgtaattacttgaacagtgtagcatttttttttacttttttcattattgttttttgtagtatatatggctattgtgtggttaagcaataagcagccatttccttagttgttatataacaatgacaatttcttcacgtatagtttttgtatgatattaatgtgttttgactttattgatgaatgtagttttatttatataaaaggtaaattatatttaattt

SEQ ID NO: 4891 - DNA, 422 bp, Gossypium hirsutum
  Clone ID: uC-gsronu33B160h02b1
cttgctaatgtctgctcaaagaaagtaccctctggctgccaatgtcgctaaatcagttctctaaattctttctcttcttagtgctgcgtggttttgatgttcttaaggtctagtttgcagtgatcaatgttttcttggtaactggttgtttaatttacgttgttgtagcgttgtttccttttggattgatactgaataaatgtaacactatatgaaaaagaagtttaatttctttggatttatgtatcttcatggggaatgaaacattagtatcattcagctctttttaaaaaagagaacacgaaaccagggagcacttacaatccgtatctggacaatcattctctggtaaagaaataacttgattgcaaacaaaacccaccaaagttaaatggggggggccgttttaggggatccaagtt

SEQ ID NO: 4892 - DNA, 367 bp, Gossypium hirsutum
  Clone ID: uC-gsronu33B160h03b1
cgcggactcctgttcctggtgcccagtcagcacttagagccggggcttgttaaggcatgtttggtgtacgcatacaggatgttacccccattcccaccgatagtactcgtagaaagggtggcagacgcggaagaaggctgtgattctttgcttcatatctgctactcagccgctgctggtggcggcttgacattaggaattctcttttgcttttgaaacaattttctgattagattcacgtttgcttgggtctgatcttatgttgcacacttggagctcctgaatggattgtgatccttgaatcttaataggcacaaaatgtcgtggaactttactgaacaaacattcatttgaactggagaataac

SEQ ID NO: 4893 - DNA, 486 bp, Gossypium hirsutum
  Clone ID: uC-gsronu33B160h04b1
gagcagatcgggtggcaccaatgaaagatatggcccctccaccttcttccaagccagcaaagtctggtggtggcaagcaaaagaagaagaagtggagcaagggaaagcaaaaggagaaggtgaacaacatggtgttgtttgaccaggctacttatgataagcttttatctgaggctcctaaatataagctcatcactccctcaattttgtctgatcgtatgaggattaatggatcccttgctaggaaggctataagggaattgatggcaagaggatcgattcgtttggtgtctgcccattcaagccagcagatttacactagggcaaccaacacctagatgttttgttatagttttgcttaaattagttctatgtagtatttgcctttcttgactttctgtgaacgatttttccttttgctaaagaccttcatctataatgtgtgagctacagtttcttgttgtctggtttaatggataatttttt

SEQ ID NO: 4894 - DNA, 488 bp, Gossypium hirsutum
  Clone ID: uC-gsronu33B160h05b1
cctttgtttccgcccacgcgtccggttccgtggcaaggtgagcactaaggaagtggatgagcaaatgttgaatgttcagaacaagaactcttcctactttgttgagtggattcctaacaatgtgaagtcaacagtttgtgacattccacccacaggcctcaagatggcatccacatttatcggcaattcaacatccattcaggagatgtttaggcgtgtaagtgagcagtttacagctatgtttaggaggaaggctttcttgcattggtacacaggagaaggcatggatgagatggagtttactgaggcagagagcaacatgaatgatctggtctcggagtatcagcaataccaagatgcaacagctgatgaagatgagtatgaggaagaggaacgcggagtacgaggattaggacggaacaactatatgccagttgggcaaattctaatctcaacttccagctgctgaaagaaatagccattatgct

SEQ ID NO: 4895 - DNA, 382 bp, Gossypium hirsutum
  Clone ID: uC-gsronu33B160h07b1
tttattatcctccaccctcgcctattcctcaacaaaggctagctgtgccacatgtgatagatccgatttgattgagtaagttgccagtagataagatacgtaaacatggggctgaggaattcagggctaccgttgatgatgataatgctgagagagttgagttttggctcaagaatactatccaagtattcgatgaattgtcctgtactcctgaagaatgtatcaaatgtgtagtatctttacttagagataatgcgtaccattggtggaaaacattgacatctgtggtttttagagaacaggttacctgggagttctttcaatccgagttcaaaataagtatataagtcaacaatttcttgattggaaacataaagagttt

SEQ ID NO: 4896 - DNA, 506 bp, Gossypium hirsutum
  Clone ID: uC-gsronu33B160h09b1
tttttccattaaagaccatggctgcaaaacctgggggaaattttaaagtagattattgagtcccatgaaccatccccaacaacaaaagatgatgcaccacaaccaaaacttgatgatgatgatgatcatcatcatcaacaatcatctgcaaacgaaccgcgatcatcttcatcatcggaggaagatactaagcaatggggtacccacgtcatgggaccgccggcgatccctattgtccacccggataaccagaaggccgctttatgggtcgccggcgaccaccagcaaattcacgagctgccttacctcgtttacactcctgctgaaaaaccgacccaaaattcatttgaacttgtgattaacgttttcaatacttggagtaggaaggccgagatcgtcgcacgcagcgtctggcacaacctgagaagtggatcgtcggtatcggatgctgcgtggggtaaagtaaacctaacggcgaaagccataacaaaaggtgggttcgactc

SEQ ID NO: 4897 - DNA, 503 bp, Gossypium hirsutum
  Clone ID: uC-gsronu33B160h10b1
tttttgcgtccgcccacgcgtccggacatgcatggcccttggtggtcgagcagttgaacaggttttgttgggaaagatatcaacaggtgcgcaaaatgacctggaaaaggtgactaagatgacgtatgcccaggtggcagtttatggctttagtgacaaggtaggtctcctctcttttcctctgagagaagatggatttgagatgtcgaagccctatagcaataagacgggtgccatcattgatggtgaagtgcgtgagtgggtagctaaggcgtatgaaaaaacagtacaacttatagaggaacataaagaacaagtagcccagattgctgaattgttgcttgaaaaggaagttcttcaccaggaggatctggttcgagttttgggcgaacgaccatttaaatcaagcgaacttaccaactatgacagatttaaacaaggttttgaagatgaagaaactaagagcatgcaaacaccggagggtgggattgcggacgatgatg

SEQ ID NO: 4898 - DNA, 542 bp, Gossypium hirsutum
  unsure (1)..(542): unsure at all n locations
  Clone ID: uC-gsronu33B160h11b1
ttgatgggaaagtcggtgggtaaaatctgactggggaaaggatgagaacatggctggggagtggaattacacttctggaaaatggaatggagatcctaacgacaaaggtattcaaactagtgaagactacaggttctatgctatttcagctgagttcccagaagtcaacaacaaagataagactctagtcttccaattttctgtcaagcatgagcaaaagcttgattgtggtggtggctacatgaagttgctcagcggtgacattgaccagaagaaatttggtggtgaaaccccatacagcatcatgtttgggcctgatatctgcggctatagcactaagaaagtgcatgctattctcacctacaatgggacaaaccacttgatcaaaaaggaagttccttgtgagactgaccaactcactcatgtttatacgttcattctccgtccggatgctacctacagtatccttgttgacaatgttgagaaacaaactggtagcttgtacacntgatgggatcttctcccacctaagaaaataagga

SEQ ID NO: 4899 - DNA, 445 bp, Gossypium hirsutum
  Clone ID: uC-gsronu33B160h12b1
tgttgtgttgactaatactagtgtttccggtacggggtatattgacggtcattttgctgtttatcaaatagatagagttcttcagcctttacagatattcgatcctagacctccggcaccagcgcctgctccggcgaaatcgaagaagaagaaagatgatgatgtggctgatagtcctgctgatgattctactgataattctaaagctgtgaggttcactatgggaaacaatgttggtttatttggggttactgccatagtacttattgcattaatttctttgtgattatagtaaaataaaaattttaaatatgggattttgaggggaaaaatatggtgagattgagtgcatgtttttttgtttttgtttttttttatattttgtgtttttaaaaaaaatattattatcctttaaaacacaaaagacatcctgcatacttgctaa

SEQ ID NO: 4900 - DNA, 280 bp, Gossypium hirsutum
  Clone ID: uC-gsronu33B162a05b2
cattgatgcaggcgagaaaggtgaggtcaagaatggggagggagagttattgcttagggtggatgggggtgccactgtcaacaacctcctaatgcaaattcaggcggacttgctgggaagttctgtggtcagaccagctgacatagaaacaaccgctctcggagctgcatatgctgctggaatggctgtaggagtgtggaaagaagaggagctttttgctttgggacaaaatatcaaaactgcatccatattctccccaaaatcaagtgtagaatggagg

SEQ ID NO: 4901 - DNA, 367 bp, Gossypium hirsutum
  Clone ID: uC-gsronu33B162a07b2
gtatcttttacgagctcagatggcttgcagacactctcctccaccaacataaaagcttctgcttctgatgtttcaaactggacaaagatggaggttctgttggaagccaaggaaacaaatcgcaattcaaggctgcaactaacaacatcgaaaaatggtgtggtatggtttgatcaagtttcagctatgcctttggacacttacaaggggcatggtttccgaaatgagcttgttgaaatgcttgcagatatcaaacctcgctttattagatttccaggtggctgttttgtggaaggtgaatggttaagaaatgcttttcgcttggaaagcaagtgttggaccttttgaagaatgaccagggtacttt

SEQ ID NO: 4902 - DNA, 441 bp, Gossypium hirsutum
  Clone ID: uC-gsronu33B162a08b2
cgaaaaatttgccactagggttcaagatgaaacctattcagtttgagaaggatgatgatacaaactaccatatggatctgatagctgggcttgcaaatatgagggccaggaactacagcattccagaggtggacaagctgaaagccaagttcattgctggaagaattatccctgcaattgccacttccacagctatggccactggtctcgtctgcctggaactttacaaagctctggatggaggacacaaactggaagactaccgtaacactttcgcaaaccttgcactgcctctattctctatggcagagccggttccacccaaaaccatcaaacacagtgacatgagctggactgtttgggaccgatggatcctgaaaggcaacccaagtttgagagaactcatccagtggctgaaagataaggggttgaatgcctaca

SEQ ID NO: 4903 - DNA, 437 bp, Gossypium hirsutum
  Clone ID: uC-gsronu33B162a10b2
tctacgcgtccgcccacgcgtccggggagtaggtgcaggggtttatcctgttgagcccggccgttatcaacggtggtggaaatcatttttcggcgttcggaaacagcggtggcgttgatcatcagaggttggtggcggtggcaggtggaggcgctagaggaaagcgacgcgccgtggaggcaccgcctttggataaagcgactcagcagaaacagaggcggatgataaaaaacagagaatctgcagctagatccagagaacgcaaacatgtcaggctttcttttttcaaaatctggttggttgccgagaaaatggagagaaatagcacttgggttaatggcaatactttttaatgctttttcttccaacttttaaaatttcttttcttcaaatggacacgtaatttaagttttttaagttggaagattttttctccc

SEQ ID NO: 4904 - DNA, 443 bp, Gossypium hirsutum
  Clone ID: uC-gsronu33B162a11b2
gcaaatccattttggaaggaaatggtggtattgggaaatcgatccatcctaaattcaggacgaatgccggagttgttcggaattcgtttggcagcagttctagtgacagggttcattttagcgacagtattttggcaacttgataattcaccaaaaggggtgcaagaaagactagggtttttcgcattcgcaatgtcgacaacatattacacttgtgccgatgctcttccagtttttctccaagaaaggtacattttcatgagagaaactgcttacaacgcttacaggagattatcatacgtcatatcaaatgctttagtgacgctaccgggcttgattttgctctcgtttgctttctccatgacaacattttgggcagtagggctagaccgcggattatcaggattcttattctatttcctaattatggttgcttcgttttg

SEQ ID NO: 4905 - DNA, 489 bp, Gossypium hirsutum
  Clone ID: uC-gsronu33B162b01b2
cccactcgtccggttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaagcaagagtccttcaagaaaaacattgagggagcaaccaagtttttgctttcaaaattgaaggacccttaatttttcatcggagagagcatgcacgaagatggaaggttggtatttgcttactaccaggatggtgctggtgacccgacaattttgtactttgc

SEQ ID NO: 4906 - DNA, 490 bp, Gossypium hirsutum
  Clone ID: uC-gsronu33B162b02b2
cccactcgtccgcaacaactttgtcaacagtggtgcactatctgagcttgtggttgccttttcacgtgagggacctaccaaggaatatgtgcaacataaaatgatggagaaggccaaggacatatgggacatgatttctcagggaggttacctgtatgtgtgtggtgatgccaagggcatggctagagatgttcatcgagctcttcacactattttccaagagcagggatcactagacagctcaaaggctgagagcatggtgaaaaatctgcaaatgagcggcaggtacctacgcgatgtatggtgatgattacgatgaaagaaactttataaaaatatacggcggtcaaaaagaaacttgcgagaagggttaaatgggtggaattgaatttattttgtatcaaagttaagaagtgttgcgattcttttatatatatattagtgtcgggtaattttggatgatatgaagtaatatttttaaatagaagac

SEQ ID NO: 4907 - DNA, 473 bp, Gossypium hirsutum
  Clone ID: uC-gsronu33B162b03b2
cctatctcgtccggcttattggttgatggtttatgagactgataaaaagatgtgttggatatattctctaatgatgtcataactaatttcttgttcatttattgtcttagttaatttgatgcatgctggttctgaataaatttttttcttttgatttttctgttttgggttagcttacaggatttaaagattgtctttggtcaatcgtttgataattattaccttatacaagtgctgtttgattttcctttttcaatgttgtcatagtgtataaatgttgagggttaaatattttagaattaaaagcaaattgacatgatatatatagcaattataatattatttaattaatattatacaattaatataaaatgaaattaaaagcaagatgtttgggagtatgattcggtacttttcaacgaaacccaagccgaaaatgaagccaatcgagttgaaaacgtcgcctgggcaaa

SEQ ID NO: 4908 - DNA, 453 bp, Gossypium hirsutum
  Clone ID: uC-gsronu33B162b04b2
gaaaatttggatgcctctgaactatttcccacttcagatgaaaagaatgaagatgaatatggtgaagcatcatggatcaaggttaatattggacaaagtggtttctacagggtaaaatatggagatgaactcgatgcacgactcaggaaagctataaagaaaggcttcttgtcagtaactgataaatacggcatcctcgatgacagatatgctctttgtgtggcatgtgaacaatcattatcatctttgcttttgttaatggatgtatacagaaaagagagcgattacatcattttatcgaaagttttcgatgtttgctataatgttctggaggtcttgagagatgctatcccagaattaacaaatgcattgtaagaaaatttcattaacattcttttatggttcggccaaaaattagggttggaatccacacctggtgagagtcatttaact

SEQ ID NO: 4909 - DNA, 451 bp, Gossypium hirsutum
  Clone ID: uC-gsronu33B162b05b2
cctactcgtccgcggacgcgtccgcccacgcgtccgattaccagtatcttgtcgtaaaataaacagtttaatgttgtttgggggggggggaaacatatatacattttatatttttcttattcttttcttttattttttcttatttttaatttttttatataatttttatattattttttctttataattatttttttttcattttatacataactatatatttattttttttcttatttctttcttttatattttaaaatatatacttttctttaacttttttctttctattattattacttttttattatctttattatttatattttttttatctttattttattttattatacaactatttttatttataatttttcttttttattttattttctatctattttattttatatctttattttcttattcttatttcatttcttatttt

SEQ ID NO: 4910 - DNA, 312 bp, Gossypium hirsutum
  Clone ID: uC-gsronu33B162b06b2
cctacgcgtccgcctgatggtaaaacccaggtcactgtggagtactacaatgacaatggtgccatggttccagttcgtgtgcacactgtcctcatctccacccaacatgatgagactgttacaaacgatgaaatcgctgctgacctcaaggagcatgtcatcaagcctgtcatccctgagaagtaccttgatgagaagacaatcttccaccttaacccatctggccgctttgtaattggtggtcctcacggtgatgcaggtctcacccggacgtaagatcattattgacacttatggtggctggggagccca

SEQ ID NO: 4911 - DNA, 333 bp, Gossypium hirsutum
  Clone ID: uC-gsronu33B162b07b2
attttctcaaacattcttcaatcttttcatctctcctcagacccgatcgatctatcttcttgctccgttccctctttcaagaactggctaacacacaggaaccacttgtggaggaaactaacaagaaccaagaggtggttcttgccctctatgaggccttaaacactcgagacgtcgaaactgttcacaaaatccttgcccctgaccttgaatggtggttccacggtcccccgactcaccagttcttgatgcgcctgctcaccggtgcttcatcctacgattctttccgattcgaggttgatcccttttcggttaccaccttttgggcccacc

SEQ ID NO: 4912 - DNA, 416 bp, Gossypium hirsutum
  unsure (1)..(416): unsure at all n locations
  Clone ID: uC-gsronu33B162b09b2
cctacgcgtccgcccacgcgtccggtgctgggtatctaaatagcactcctttgctagatttgaactacattgaagatagtgctggaggtcctgatgtcactgtagggatcttgcctaagttggacaaagtgactcttcttcagatggatgcaaagttatctgtggatatctttgaaaatgtgatgggacttgcaatcgaaggctgcaaggccatagcaaactacattagagaagtattactagagaataccaagcaactggagtatcgccggggtctataactctatgtaagcggaagtatttgattgttgacttatcgtgttaaagattcaacaaaatatactatacagcattctgcttatgtttagatacccatcatttttgntatttggtattttgcttcttttatggttttt

SEQ ID NO: 4913 - DNA, 498 bp, Gossypium hirsutum
  Clone ID: uC-gsronu33B162c01b2
gcttgtatctggtagtgatgattgcaaggtgaaagtttggtgcacaaagcaggaggccagtgttattaatattgacatgaaagcaaatatatgttgtgtcaagtataatcctggatctagcaatttcattgcggttggttcagcagatcatcacatccactattatgatttaagaaacatcagtagtccacttcatgtgttcagtgggcacaagaaagcggtctcatatgtgaaattcttgtctgaaaatgaacttgcttctgcatctacagatagcacactaaggttatgggatgtgaaggagaatctgccgcttcgaacttttaaaggccatacaaatgagaagaatttcgtaggcctcactgtaaacagtgaatatattgcatgcggcagcgaaacaaatgaagtgtacgtgtaccacaaggaaatatcgaaaccggtaacatggcatagatttggttcacaagagatggaggatgcagatgaagatgggggtgg

SEQ ID NO: 4914 - DNA, 500 bp, Gossypium hirsutum
  Clone ID: uC-gsronu33B162c05b2
cttcatggtaagagtcgattgattcttcgaaaaccataaacgaaaccaaatatggcggagaaagcaatcgagtcggctcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctacgctatccgtcaaagcatcgctaaagcccttgtcgctgtttaccagaggtacgttgatgagcagagcacgaaggagattaaggatattttggtcgggtacgataggactttgctggtcgctgatcccaggaggtgcgagcctaaggagtttggtggaagaggtgccagggcaaggctccagaagagttaccgatgaagaactgtcat

SEQ ID NO: 4915 - DNA, 489 bp, Gossypium hirsutum
  Clone ID: uC-gsronu33B162c08b2
cctacgcgtccggtgggtgattccaattttagagaaacttgacaaacttgatgtcaggaaattaagtggtggtggattgggtcatgtagaagagataactgagggaaacacgccagacttgctgaagaaggaagctgtcatcgttacagctccagaagagcaggaaagtaaaattcaggcagcaagggaacgttttcttgctcgcaagggaaagaaatgaggtcgggtattatgtgttaacagatcagtgcagtgagagctgcttgattactcagtggacattccaattttcaaaattgttggtgggactgagaatcatgtgcgttttgattttccagttcccactatctattctatagcactttgctgatggcatgtgagctttatacattccttgatgcttatagaggaccttgttaaatgaggagtgtggccacgatatgcgttggtgcgaggcaagattacgctctttgttccttcagacaaatc

SEQ ID NO: 4916 - DNA, 489 bp, Gossypium hirsutum
  Clone ID: uC-gsronu33B162c09b2
cctacgcgtccgcttctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattgttgcttgcttcttgctcaaggctgtcactggtggcttgacagttcctatccacggtcttggagctggagttggagctattcaaggagtggtgatggagatca

SEQ ID NO: 4917 - DNA, 354 bp, Gossypium hirsutum
  Clone ID: uC-gsronu33B162c11b2
tctttgattgatatggctgaactcaagtcatggtctttttacagagccctcatagctgagttcatagccactctcctcttcctctatgtcactgttgctaccgtaattggtcacaagaaacaacaagatgcatgtgatggtgttggtctcttgggtattgcatgggctttcggtggcatgatctttatccttgtttactgcactgccggtatctcaggtggacacattaaccctgcggtgacttttgggttgtttttggcccgtaaagtatctctcatcagggctgtggcttacatggtgtcacagtgcttgggtgctatatgtggagttggggttgggtaaagcttttatgaa

SEQ ID NO: 4918 - DNA, 495 bp, Gossypium hirsutum
  Clone ID: uC-gsronu33B162d02b2
cttaattaaacgagcaaaacgaaagcttcgtttttcttccaaaacccatattgaaccaagtgctgagtctagaatggagtgggttcgaggggatagggttgggtgtggcagttttggcactgttaatttggtggcatctaaggagttttcaaaatctccttcaatggcggtaaaatcttgtgaagctatgggttccgtttccctcaagaaggagaagcaagtgcttgatcaacttgggatttgcccgcaagttattcgctgttttggcgatgattatacggttgagaagggtgagaagttgtataatttgttcttggagtatgctaataaaggaagcctggctgatcatgttaagaaaagcggcggaaacttgattgaatccgatgttagaagatatgcgagatcgatacttaaagggctaagctttgttcatgctaaagggtttgctcactgtgatattaaactttaaaatattcttttgtttgataatggtga

SEQ ID NO: 4919 - DNA, 447 bp, Gossypium hirsutum
  unsure (1)..(447): unsure at all n locations
  Clone ID: uC-gsronu33B162d03b2
cccacgcgtccgcatatggaatattgcattgatcatccagaggagattagtaagattgccaaagtgaaagctcaagtttcagaagtcaaaggagtaatgatggaaaatattgaaaaggttctggaccgtggcgggaaaattgagattctggtagataaaacggaaaatcttcgctctcaggcacaagatttcaggcagcagggaacccggatgaggagaaagatgtggttgcagaacatgaaggtaaagctgatagttttcggaatcctgatcgcattgattctcattatcgtgctgtccatttgcggtggcttccattgttgaagaagaatacgctcatctgctcggctatggactctatttcctcttatggatcagaggtattgttgcagtcacacaactgtattgaggctcgtctacctatacatttnttgatacacgatcttt

SEQ ID NO: 4920 - DNA, 501 bp, Gossypium hirsutum
  Clone ID: uC-gsronu33B162d05b2
catagctctaaatccgggattggtatatgataccgatagtagcgactacatcgcgttcctttgctcaatcggctatgattcaaagaggattgaagtatttgtgagggaacctaatagttcagatgtatgtgctacaaaattggccacaccaggggatcttaattatccatcattttcagtagtttttaattctaatgatcatgtagttaagtacaggaggaaggtaaagaatgttgggacttcagctggtgcagtttatgaagctaaagtgaatgctccacctggtgtcaaaatcagtgtttcgccgagtaagctcgaattcagtgctgtaaaccaaacgttgagctacgaggtttcattcgcaagtgacagtttgggggtgtcttcagttgagtcacaagggttcgggtcgatcgagtggagcgatggagtccatcttgtgaggagccccattgctgttaggtgtatccagggagtgcaggaagagtccttttgattttc

SEQ ID NO: 4921 - DNA, 217 bp, Gossypium hirsutum
  Clone ID: uC-gsronu33B162d06b2
cccactcgtccgcccacgcgtccgaaaaaaaaaaagatgggaaaatttaaaaataaatttggggtatattttaattaaatatatatatttattataattttttttaaaaataggggtggactttttttggggaaccttctttggtgccgtcttttttggggttctctgtttttgttttcggtgtttcctacctttttggctttttctttggggtttt

SEQ ID NO: 4922 - DNA, 68 bp, Gossypium hirsutum
  Clone ID: uC-gsronu33B162d07b2
ttttggtttttgtatggcccgggctaaaattgggccttacaatgtaaagacttatttattgaatgctt

SEQ ID NO: 4923 - DNA, 419 bp, Gossypium hirsutum
  Clone ID: uC-gsronu33B162d09b2
ttttctctctttgagctttcttcttcggcttatctctgaagtcttatcatttcaatcactgtgctatacacacatatatatacacacatatactttgaaaactcaaaaaaaaaaaaaacctctttaaagctctctttgaaactcaagcatcactgtataatctgatcatctcttcaaatatgccacgcccttttttccataagcttattctctcctctactctccaagataagaaactgaggattcctgataactttgttaagaaattcaaggatgaactttctgttgcagctgctctcactgtccctgatggtcatgtttggcgtgtggggattaggaaaggtgacaacaaggtctggtttcaagagggttggcccgaattccttgaccgatactatatccgaataggatactttttg

SEQ ID NO: 4924 - DNA, 501 bp, Gossypium hirsutum
  Clone ID: uC-gsronu33B162d10b2
cctacgcgtccgaaaagcactttgcatggaggatcagttaagatcactaggaatacttgatacatgtaactctgattctatcgtctttgatggtattaatcttgaagctaatttgccaccaaagaagatgagagcagctatttcttctatggagcctggtgacgctcataagttgcttgaagacttggtgaaattgtggcaatcaaggtcatgtagtggaaattatgttcttccgtggatatatagtttgttgctgactcacggtcatcttatgtctcaagaatctgaaacccagatgcttaattccttattgaagaataccaaatcgagaggattggcccttcagcctttgctacaattatctgggcggttacagctagtaacaacacagattgacaaggcggctcagaacagaagtcaacacttcacaagtgatcacaaaatggatgaaagtgaagaagatgatgatgacgatgtagatgatgttctttatgtggaaga

SEQ ID NO: 4925 - DNA, 482 bp, Gossypium hirsutum
  Clone ID: uC-gsronu33B162e02b2
cccactcgtccgcaattgtggaagctctcaaatctcagctgctatggcacccatcgcacggttacttttgctcgcgcttctctcaactgcactcacgatttcatcagggtctggggatgggtacaccatcaatggtcgagtgaagatcccccaaggtctgggtacaaaagggtttgctttgcctggaaaaacgtcaaatgtcaaagttatactcaatggtggccaaattgttacttatctgagacctgatggatatttttcatttcagaacataccagcagggactcatttgattgaagtggctgctattggctatttcttttctcctgttagagttgatgttagtgctagaaacccaggcaaggtacaggctgcattgacagagaacaggaggggtctcagtgaattggttttagagccgttgagagatgaacaatattacgagattagggaacctttcttcataatgtcggttgtgaaaa

SEQ ID NO: 4926 - DNA, 490 bp, Gossypium hirsutum
  Clone ID: uC-gsronu33B162e05b2
cttactcgtccgcagatagtagcaggggctggggctggagttgctgtttcattcctagcttgccccaccgagttgatcaaatgcagattacaggcccagagtgcattggcacattctggctcagctagtgtggcagtgaagtatggagggccaatggatgtagctaggcatgttctcagatcagagggtggcgtaagggggctcttcaagggattggttcccaccttagctcgcgaggttccaggaaatgctgctatgtttggtgtgtatgaagcactgaagcagtacatggctgaaggaccagacactagtaaattaggaagagggtctttgatcgtggcaggaggcttggccggagcttcattctggatctttgtttacccagttgatgtcatcaagagtgtggtccaggtggatgactacagaaaccccaagtacactggcttcatgaatgcatttaataggatattagcctcagaaggggtgaaag

SEQ ID NO: 4927 - DNA, 501 bp, Gossypium hirsutum
  Clone ID: uC-gsronu33B162e07b2
ttttgaatatggcacttgaagctctgaattcacctaccatgcctacacctttcaccaacaaatacgacgacatcgacaattggaagaaaggcaaacgttcaaagcgactacggaccgactcccctactacccccaccaccgaagaagagtatcttgctctctgcctcatcatgctagctcgtggctccccccaaggcgctgctcatcatcatcctcactcttcctcctcatctgctcatcctcttcatttgaacttgtcatataagtgcagcgtctgcgacaaggctttcccttcttatcaagctctgggtgggcacaaagccagccaccgtaaaccctccaccgcccaaaacccatctataaccactgaaaccaacgccgccggcagtagcgggaggggtaggtcccataagtgtaccattgccacaagtctttccctacgggacaagccttgtgaggccacaaacgctgccactacgaaggtggcaacaacaacagcag

SEQ ID NO: 4928 - DNA, 383 bp, Gossypium hirsutum
  Clone ID: uC-gsronu33B162e09b2
cttttctctctcttttttcaaccctaaccctacctcaccaaccaggattcaacatgaagggaggaaaatctaagtcagatactaagagtgccaagctatccgtgaaatccaaagctggaaagaaatcggggaaggctgccaaggatccaaacaagccaaagaggcctgctagtgccttcttcgttttcatggaggagttccgtgagcaatacaagaaggatcaccctaaaaacaaatccgttgccgctgtcggcaaagctggtggagataaatggaagagcttgtctgaagctgaaaaagcaccttatgtagccaaggcagaaaagcgaaaggtcgagtatgaaaagaacatgaaggcctacaataagagacaggctgagggt

SEQ ID NO: 4929 - DNA, 491 bp, Gossypium hirsutum
  Clone ID: uC-gsronu33B162e11b2
tttttcattttcaatgcatctgtggcacttggagtgcctgttaacaggcttgtacaagctgcagactcggtctcggtatgcttatcaaaaggtttaggtgctccagttggatccgtcattgttgggtccaaaagctttattagcaaggctagaagacttaggaaaactttaggtggtgggatgaggcagcttggtttcatttgtgctgctgcttttgttgctttaaaagaaaatgttgcaaagctcgagggtgatcacaagaaggctaaggtgttagcagaggggctaaatcaaattaaaggtctaagagtcaatgttgctgcagtggaaacaaatatcatattttttgacatagtggagggatctaaaatcacagcagagaagctatacaagaagttagaggaacatggtgtgcttgtgatgctggaaggcccactcaggatgagaattgtcctccaccaccaaatatcatcaagcgatgtgctgtacac

SEQ ID NO: 4930 - DNA, 451 bp, Gossypium hirsutum
  Clone ID: uC-gsronu33B162e12b2
ggttcaatacaattgctcattggctgccaaatttaggaattcatcaattagccaatgcaagttcgaaggaaatgaaaaatgtgcaccccaagtcttgaaagtccgaccaaacaaaacctacaggctcaggattgccagcaccactgctttagcttcactcaacttggccattgagggtcacaaaatggtggtggtggaagctgatgggaaccatgtgcaaccatctgctgttaatgatttggatatatattcaggggaaagctactcagtgttgttaaaaacagaccaaaacccttacaagaactattgggtttcaattggtgtcagagggagagatcccaaaaccaaccaagccttaacccttttgagctattctgccacccctgcatcaaagctccctacaactcaaccccctgtaacacctcgatgggacgattacaatcacagcaag

SEQ ID NO: 4931 - DNA, 435 bp, Gossypium hirsutum
  Clone ID: uC-gsronu33B162f01b2
cctacgcgtccgcaaggtgtcactcatccgagccgtgatgtacatggtggctcagggcttgggtgccatatgtgggtgtggattggtcaaggctttccagaagacctactacaacaactacgggggtggtgcgaacgagctccaaccagggttcaacaagggcactggactgggtgccgagatcattggtacctttgttcttgtctacactgtcttcgccgccactgatcctaagaggaatgcaagagattcccatgttcctgtgttggcaccactccccattggattcgctgtgttcatggttcaccttgccacaattccagtcactggcactggtatcaaccctgctaggagttttggagctgctgtcatttacaacaaagagaaggcctgggatgaccaatggatcttctgggtcggacccttcattggagc

SEQ ID NO: 4932 - DNA, 79 bp, Gossypium hirsutum
  Clone ID: uC-gsronu33B162f02b2
aaacaaaaaaaaaacaaatataaaagggtggaattataaaaaaaagtggctcccgggtcgttcaaacaaaaggagccta

SEQ ID NO: 4933 - DNA, 475 bp, Gossypium hirsutum
  unsure (1)..(475): unsure at all n locations
  Clone ID: uC-gsronu33B162f03b2
cccactcgtccggtcgcagatgaatcagttggcaggagtgtgcctttcgtttttcttgaacgggtgctagatgattttaaacaacgatatggtgcaagtataagaaatgagggtccccatcctttagctgatgatgacgatgatgacgacttatttgaggaccaatttagcattgcatataatcttgacagagaatttggaccaaggcttaaggagcacatgcaatattgtatgaaccatccagaagaaatgagtaagctctcgaagttaaaagctcaaatcactgaggtgaaggggattatgatggataacattgagaaggttttggatcgcggngagaagattgaacttctagtggacaaaactgagaacttacaattccaggctgatagcttccagaggcaagggcggcaactgcggcggaggatgtggctgcagaatctgcaaatgaaactgatggtggggggagctattc

SEQ ID NO: 4934 - DNA, 445 bp, Gossypium hirsutum
  Clone ID: uC-gsronu33B162f05b2
ggctattgcatggatagctatctaccaaccgcacaaaggccaccgccttacccaacccagctcccaacaccaagaaaaggaagaagaagaagagaaaagacaaggaaaaagagaatatagatgaagaagatggattctctcaagaagaagaaacgaaaccgtacctcatccatctgcatgccttcttcactgagttaaagggttctatctgatgttcatcaatgaacaaaggcctttttgattctactaaatctgttcttctttgatctactttcttggggaaatgaagcatcatggaccgatttgtatgctacatatgaactaaaacctaatactataccatatattgactgctgcacatgattggggagctgctcccgttattttactgtatggattatctatttcacagcatgggagatctaatctatgctccagagcagac

SEQ ID NO: 4935 - DNA, 482 bp, Gossypium hirsutum
  Clone ID: uC-gsronu33B162f06b2
gaatgacagaattcagaacttgaatgctcttcaacatgttttgaggaaagcagaggagtatcttggtaccctacctcctgagacaccatgtgccggattcgaacaccggttccaggaaatcggtttggaaagaggttggggtgacaccgcacaacgcgtgctcgagatgatccaactccttttggatcttcttgaggcacctgatccttgcacccttgagaagttccttgggagaatccccatggtgttcaatgttgtgattctcactccccacggatacttcgctcaagacaatgttttggggtatcccgacaccggtggccaggttgtttacatcttggatcaagtccagctttggagaatgagatgctcctccgtataaagcaacaaggactcaacatcacccctcgaatcctcattattactagacttcttcctgatgctgtcggaacaacatgcggtcaacgacttgagaaagtata

SEQ ID NO: 4936 - DNA, 495 bp, Gossypium hirsutum
  Clone ID: uC-gsronu33B162f07b2
cccacgcgtccgccactctcgaggatttcctcaagttcccatctttgtttggctttcgcatcagctccatggatcgggcccagctcctcctcgtaggattacctctcttcctcttcgccaccgatctcttcagcctcttcactcctccgcccccaaagccgccgtcccatcaccatcaccaccatcatccccacctacccaaacctccactcaatcctgaaaccctagatatttctttacagaaacccagcgctattggaggaatcggctatggcagcacggttaatatcaatttctgcgcttcatgctcttacaggggaactgctgtgacaatgaagaagatgttagaagcccagtttcctggaattgatgtaatccttgataactatccaccatcattgccgaaacgtttgctttcgaaagtggttccagttttccaattggagttatagggattatgatggcaggtgaacagatttttctatgattggatta

SEQ ID NO: 4937 - DNA, 452 bp, Gossypium hirsutum
  Clone ID: uC-gsronu33B162f08b2
ttgttgttatagcttaccgacggttaaagatcaagactatctggtaaggggttcgttccctgttgttgaaacagagggagctgctgagtttgaatcttcatttactgtttcaattggtagcacgccactaagcgtggtgaactcatcggcggacttggtggttgaggggattttccgagctgctaatagctatactgacttctgcttagtgcatggaaaaggagatccctacatatcgagtcttgaactaaggccttttaatgattcagggtatttgaatgataaatcatccaatattttgaaagtggttaatagaactgatctaggaggctttggagagaccaggtacccagaagacagatatgacagaatttggaaaccagcatcaagttttttacttacgagcagccaacttcacttgtattattcacaacaatgtgaatacaacagtg

SEQ ID NO: 4938 - DNA, 441 bp, Gossypium hirsutum
  Clone ID: uC-gsronu33B162f09b2
ctgtacgcgtgggcggacgcgtgggctagcacaagaagcaaaatccgtctcctctgtttcttcccctttttttcaatgttatgttaattttcctgttacataaaagttagcaatcatggctgagaataatggaaatcatggagtagttttgaatgtgaacgcggaagccaatcagaatccgcctccatcaacctccaaaaccaaagattccgacgtcggtttcactgttcccttcatgcagaagctgatggctgaggtgttgggcacatatttcttgatatttgctggttgtgcatcagtggtggtgaatgtaaacaatgagaaagttgtatcactgactgggatttccatagtttggggattggccgtcatggtgttggtttattcagtgggtcatatctccggtgctcatttcaatcctgcagtcaccattgcttttgc

SEQ ID NO: 4939 - DNA, 496 bp, Gossypium hirsutum
  unsure (1)..(496): unsure at all n locations
  Clone ID: uC-gsronu33B162f10b2
caatacatggacccctggctacagccaacaggctgcatatggtgcgtatagtagttatggtagcaactatgctactccacaagtacccacatcagttccacaaagtgctgggtatggtgcttatccgactacgtatcctgttcagacctttcctcaacaaagttttgctgtaccaactgcgggcacgatgttaaccccagcccagcaacctgctgcagcagttcctcaaactacttattatgggacctactgatgagactgcagttaaaaagaccatccaattactttgctgtctctgttctacgcgtatcctcataacttagatggcttagcagttagccaaggtggacatttttgaggtttaagaagaaaaaaggaaantgggggggggttgttnannaatgnttggagaatattggtatgttttaggcgacagtgggtgagttggtcttaggtattggagtggtttttttttacgagatatttatggaacttg

SEQ ID NO: 4940 - DNA, 500 bp, Gossypium hirsutum
  Clone ID: uC-gsronu33B162f11b2
cgttcgcgtgggggctactccacctcccgcaactgccccaccggcttctccacctccggctaccccaccacctgcttctccccctcctgctactcctcctccagctaccccaccaccagctcctttggcttctcctcctgccacggttccagctccggcccctagcaagaccaaagctaagtctccagcactatcaccttcggcctccagcccaccgtctccatcaaatgaggcccctactcccagcctcggcgcttcttcaccaggccctgctggaaccgatacgagtggagtagagaaaacatggtccataagaaagatggtgtggagcttggtgattggatggggtatcctcagtttaatgctttaaaccaagaagtcttttcttcaccatttgtgtcttagctatggtttttgttttcagtgttttaatttccattatatattgttactggcttaagtctctttgatggggctttttactatgcatatttgagctt

SEQ ID NO: 4941 - DNA, 490 bp, Gossypium hirsutum
  Clone ID: uC-gsronu33B162f12b2
tgatgggaaagatcttcacatatctgtgactatgccttccattgaggtcggaaccatagggggcggaactcaacttgcatcacagtctgcatgcctggatttgcttggagtaaagggcgctagtaaagaactagcaggcgcaaactcaaggctcttggcaaagatcgtggccggctccgtcctggcgggggaactttccttaatggctgcaatagccagtggtcagcttgtccagagtcacatgaaatacaaccggtccaccaaagatgtatccaaagttggatcataacaaggtataaagattatgttggagttgtaagtagcattaatcggcatggttggagggtacgaatcttttagccatatggcagaatcaccctccaagatatttggtccttttattgtgtccacactgtgaattcttaattgcccctttcttttagtttctgcatgtgtgtgtagttttgctttatgaacttgccaatcaact

SEQ ID NO: 4942 - DNA, 455 bp, Gossypium hirsutum
  Clone ID: uC-gsronu33B162g02b2
acagccgtccgcccacgcgtccgctgctttaacagaatgtgctaatggaaaactttctccacgtgagctggttacaggcctaaaggattcacctgattttcttcctgcatctttggcaaccatggtaggcatcctttttgttaaagtaagtcgatgtgtatggaaacctgttgttatgaacggtatggactggccaagccctgctgaaaatttgtccaatgttgaagagcatatcaaaaaatttctagcagccaccggtgttgatgtccctagactctctgcaggtggtagctctacagctactcttccactaccggtggctgcttttgaaagtctcaccattacttataaaatcgacaaaacctcggaaagatttctcaatttggctggtccagctttggagtcccttgcagcacactgtccatggccttgcatgccaattgtggcttccctat

SEQ ID NO: 4943 - DNA, 376 bp, Gossypium hirsutum
  Clone ID: uC-gsronu33B162g04b2
ggcatgttgttggatgaaggagatagtggctttcctagggaagaagacaccaataatgcagattttgaggaagatcaagcttccttgcacttaagggactctgatgaagaaactgaaaatgattcagtgatgatggaaggggacaatatgacaagggaacagatagaggatgagattaaaaaaataaaagaggcacatgccgaagatgaggaatttccagatgaagtggatactccactagatgttcctgctagaaagcgatttgcaaaatatagaggcctcaagtcttttaggacatccttgtgggaccccaaagaatctctacctcgagaatatgccagaatttttgcttttgataattttgcaagaacacaaa

SEQ ID NO: 4944 - DNA, 390 bp, Gossypium hirsutum
  Clone ID: uC-gsronu33B162g05b2
tgtttgtctattgaattctttccttcactttctcgagaaaaaaaaatgtcttcaggttgcaattgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctct

SEQ ID NO: 4945 - DNA, 379 bp, Gossypium hirsutum
  Clone ID: uC-gsronu33B162g06b2
gtttatatggaaattgtttcagaagaggctgccattggctttacaatcagtgctggttctcacaaacaatagaaagatagctcatcaattccttatttctttctttgtacatgctcaataaatttaattgtaattttgtgattcagccagttgctttaaattatagcatcaatcagaatttttttttcatggtaaaaaaaaaaaataaaaataaaaaaaaataaaaaattaaaaaaaaaaaaaaaaaaaataaaaaaaaataaaaaaaaaataaaaattaaaaaaaaaaaaaaaaaaaaggggggggcctttttaggggacccaagtttccttccccgggcttgcaacgtaaaagtttttttttagggtcccctaaatt

SEQ ID NO: 4946 - DNA, 444 bp, Gossypium hirsutum
  Clone ID: uC-gsronu33B162g07b2
cccacgcgtccgctgctttaacagcatgtgctcatggaaaactttctccacgtgagctggctacagggctaaaggatttagctgattttcttcctgcatctttggcaaccattgttagctacttctctgctgaagtaagtcgatgtgtatggaaacctgttgttatgaacggtatggactggccaagccctgctgcaaatttgttcaatgttgaagagcatatcaaaaaaattctagcagccaccggtgttgatgtccctagactctctgcaggtggtagctctacagctactcttgcactaccggtggctgcttttgtacgtctcaccattacttataaaatcgacaaaacctcggaaagatttctcaatttggctggtccagctttggagtcccttgcagcagactgtccatggccttgcatgccaattgtggcttccctat

SEQ ID NO: 4947 - DNA, 443 bp, Gossypium hirsutum
  Clone ID: uC-gsronu33B162g09b2
ttctatcgcgtccggctgacttgaagaacaacagattgactaattatacacttaattttgaccagatgcttaacgataagaaagcaatttgcaaggagcctcaagagtcaaagattcccccatctcttctttttagtgataaattttgattttcttgatgcagccatgccatttatacatttctgcgaaattttgaagttgtaatgaagttgtaaaatggcttgtgttattcaagttgttgttattaaattttggactctgagtaatatttgaatccgctttatttttgttgataggaaaaaaaaaaaaaaaaaaaaaaaaaaaaaaaaaaaaaaaaaaattaaaaataaaaaaactaaaaaaaataaaaaactcaaaagcgtttaaaaaattataataaaaccccttcctttaaaaaattaaagtgttaaaaaaggggcccg

SEQ ID NO: 4948 - DNA, 491 bp, Gossypium hirsutum
  Clone ID: uC-gsronu33B162g10b2
ggaagagcttccttttttttttctctccttttccaccgccgtcgatctcgatccttatcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatccaactgagatgggtctcgatgtgttcaaag

SEQ ID NO: 4949 - DNA, 124 bp, Gossypium hirsutum
  Clone ID: uC-gsronu33B162h01b2
cccacgcgtccgctattctccaggtatatgtataatttgatgatgcaaatgactacaataattttgtacttcaactgttccaaattttgtttttatgattttgtatataaggggatcttcttca

SEQ ID NO: 4950 - DNA, 447 bp, Gossypium hirsutum
  unsure (1)..(447): unsure at all n locations
  Clone ID: uC-gsronu33B162h02b2
cccacgtgtgcgctattccacttctgtcccgtcgggggaatttacaacaccatttcatttgcaccaatcggccttcttgacatgttcaacagcagcggtgccgtggagaagttcgaagtacaaatgacatccaatgagaaactgcagttctttgatggcgaggtttcctcggagttgacaacttcactcagcaacaaccggaatccaacagcagcgatcagtctcaaagtccggggttgtgggaggtttggtgcatactcatctcagcatccgttgaagtgttgtgtggacaatgccgacactcacttcaactatgactcagccaccggattggtgacacttacattgncagtgccatcggaagagatgtacagatggcacgtagaaattcaagtctaagtttagcttcaggttattttattaggccatcatattaaaagtcattat

SEQ ID NO: 4951 - DNA, 504 bp, Gossypium hirsutum
  Clone ID: uC-gsronu33B162h04b2
ggaaaacctacgcatcccaggaggagcacgattaccggctgggagtcttcaaggctaacctgcgtcgggccaagcgtcatcagctcctggaccccagtgccgtccatggcgtcacaaagttttccgatttaactccatcggagttccgccgccagtatctaggcttgaaaccgctcaagctcccagccgatgctcaaaaggctcctatccttccgactgacaacttaccggatgactttgactggcgtgaccacggcgccgtcactggcgttaaagaccagggttcctgtggatcgtgttggtcgttcagtgcgacgggggctttggagggagcccattatttggcgacaggagagcttgtaagcttgagtgagcagcaacttgttgattgtgatcacgagtgtgatccacaacaatatggtgcgtgtgactcagggtgtaatggtggtctaatgacctctgctttcgagtacacccttgaggttggtggacttgagagagaga

SEQ ID NO: 4952 - DNA, 488 bp, Gossypium hirsutum
  unsure (1)..(488): unsure at all n locations
  Clone ID: uC-gsronu33B162h05b2
cacagtttaaaacacaatatgactaaggatattgagaccacggcggagcaaggcggcggagcggagttctcagcgaaggactaccaggacccaccaccggcaccgttgattgacttggaagaactcaccaaatggtcgctttatagggcggcgatcgctgagttcattgccacccttcttttcttgtatgtcacggtgttgactgtgatcgggtataaagtccaaaccgacccggtaaagaatactgnttgacccggattgtggtggtgttggtatacttggaattgcttgggcttttggtggcatgatcttaatccttgttaactgaactgctggtatctctggaggacacatcaacccggcggtgacgtttggactgttcgtggggcggaaggtgtcactgatccgagccctgttgtacatggtggctcaatgcttgggtgcaatctgtgggtgtgggttggtgaaggctttccaaaagacttact

SEQ ID NO: 4953 - DNA, 494 bp, Gossypium hirsutum
  Clone ID: uC-gsronu33B162h06b2
ggaagagcttcctttttttttttctctccttttccagcggccgtcgatctcgatccttgtcctcgttttcaaacaagctcgaaaaagatggccaacgctgcatcgggaatggctgtgcatgatgattgcaagttgaagttcttggagctcaaggcaaaaagaacccaccgcttcattgttttcaaaattgaggagaagcaaaagcaagttattgtggagaagcttggtgaaccaaccgaaagctatgaggattttactaaatgtctccccgctgatgaatgtcgatatgctgtgtacgattttgattttctaacggccgagaacgtaccgaagagcagaatctttttcatagcatggtctcccgacacgtcaaggatcaggagcaagatgatttacgccagctccaaagatagattcaagcgagaactggatggaattcaggtggaattgcaagcaacagatcccactgagatgggtctcgatgtgttcaaaag

SEQ ID NO: 4954 - DNA, 376 bp, Gossypium hirsutum
  Clone ID: uC-gsronu33B162h07b2
cccacgcgtccgaacaaaaggaaaaatcgatggatccagacgctgtagccaaggcttttgtcgatcactactactcgacattcgatgcgaaccgggccggtttagccaatctctaccaggaaggttccatgttgacctttgaaggtcaaaagatccaaggatctcagagcattgcagctaagctaaccagccttccttttcagcagtgcaagcacaatatttccaccgttgattgccagccatctggcgccggcggcgtcctcgtcttcgtctatggaacactacaactcgccggcgaacaacatgctcttaagtttagccagagtgtttatttgatgcccacaccacaaggaaacttttatgtgttgaatgacat

SEQ ID NO: 4955 - DNA, 485 bp, Gossypium hirsutum
  Clone ID: uC-gsronu33B162h08b2
cccacgcgtccggtttgcattttcattgtttgtagtgtagttttcttgtggtgcaagaaacaaaatgcaagagaagggaacccaatccagaatagagaaatagcaacaccagtaacatcacaaggggtgtcgccatggttttctggtgcagaactcgaaagccttcctcatcagtccctcgtccaagctaccaaggttcattttggttcaagacctgatttcaagaaaacactactagacttaaaagaatcagatgttggagttcttggcgtgtggaccgaggaagatgcggcacgatgttgcgaaaatttgtgcgtctggattggcacagaacctgcactttgagtccattagcttcactttataatgaacatgtatatgttatttgccgaatgcaagacatgattatttactatagtaatgtgtaattccatcattgtataaacacaagcactgcgatctccatgaaagttagtaaataagac

SEQ ID NO: 4956 - DNA, 419 bp, Gossypium hirsutum
  Clone ID: uC-gsronu33B162h09b2
gaaggctagaagtcagtacaaggagcgtagtgctgctacaaatgttgagattgcggagcctgtgcctactgatgcttgcagtccaaatattcggacatgaatgggatctgcaggttatgcacctgaaaatgatgcattaatgtggaaaataagatctttttctggtggaaaggagtatatgttgagggccgagtttactctttctagcataacagatgaagaggcaactccagagagaaaagcttctattcgtgtaaagtttgagattccgtattttaccgtttctgggatacaggttcgatatctgaagatcattgagaaaagtggctaccaagctcttcatgggtacgatatatcacaatggcgggcgagtatgaactaagacttatgtaatgccaatgcctttaatattgagagat

SEQ ID NO: 4957 - DNA, 469 bp, Gossypium hirsutum
  Clone ID: uC-gsronu33B162h10b2
gtcatttttgggcctgatgatactccttgggatgggggtacgttcaagctgactttgcagttcatggaggattatccaaataagcctccaaccgttcggtttgtctcacggatgtttcatccaaatatctatgcagatgggagtatttgtctcgatattttacaaaatcagtggagtcctatatatgatgttgccgctatactcacttcgattcagtctcttctttgtgatccgaacccgaactctccagcaaactcggaagcagctcgtatgtttagtgagaataagcgggaatacaaccgaagagtgcgcgaaatagtggagcagagctggactgctgactgaactgcagtattagcaatggtaacctgccatcactctgaaaaataagaaatgccatactggcagtgctgctgctgtcaccgccactgctgccagtgccggtggtggcgaactcaaaaaccgtttc

SEQ ID NO: 4958 - DNA, 458 bp, Gossypium hirsutum
  Clone ID: uC-gsronu33B162h12b2
cctacgcgtccgaaaagtttgattatagtcatgagctaagttttatttttggtacaaatcaacaaaggttaatgccttgaaaagtcaatttattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatcaaatttaacttcccctggcttgcaacgaaaaacttttttaatgggggccctaaaattaaattaatgggccgcggtttaaaaacttttgaactggaaaaaccttggggtaaccaaattaaatggctttgaaaaaaaaccccttttcgcaagttggggaaaaagaaaaaaggcccgaaccaatcgcctttccaaaaaattgcccaccctaaatggcaaatggaaccccc

SEQ ID NO: 4959 - DNA, 363 bp, Gossypium hirsutum
  Clone ID: uC-gsronu33B163a02b2
cccatgcgtccgctttccttcactttctcgagaaaaggaaatgtcttcaggttgcaggggcggatctagctgcagctgcggcgacagctgatcatgcagaatgaacctaaacacgatatcctatgtgcggacacactggacccaccaccaacaggaaccgtgttgcgccagtgaagatacacttacacaaacaccttcagatagttacttaccacccctccaaacaggagtatatcctccacctacagggaacttaccatattactatccaccaccaccttatgggggaggtaattcttttatgggcaagcccccttccgaccctaattttgcctaattcccatacaccattggaaaccctcc

SEQ ID NO: 4960 - DNA, 152 bp, Gossypium hirsutum
  unsure (1)..(152): unsure at all n locations
  Clone ID: uC-gsronu33B163a04b2
gcngtagtgcttggaaggatgtgaatcaagagtttagttacttttaagaaatgcttgcagtagtaaaaaatcgtatcttaaaccttgcaagggagatggatgtactctacagataaggatatcacttcccatctcttgcataatcttttaat

SEQ ID NO: 4961 - DNA, 440 bp, Gossypium hirsutum
  Clone ID: uC-gsronu33B163a06b2
gcttcttcaggccgaacttcaaaacgttatacatggggtctccatagtagggaaggcttcatgcttgacagcatgtattatatggaatccacaaaatggtgaaggccaagaatcaagctttattttgtgtttcaattatgacactccacaactcaattcccccatggtgggggaattggatccagctcatcagagatggctgccagtagcagagatggctttgcctggtgacaagggagatcaaatatactctggtgcatgggcaccaaacattggacggccatatgaggttatagctactgcatctcaaaaaggaatttctgtatggcgtgttggatcaaccactgacatggatggaaggctctgcatggagaatggtgcattgctctctcgacataacagtgaggtgtggcagatggaatgggatatgaatgggatga

SEQ ID NO: 4962 - DNA, 489 bp, Gossypium hirsutum
  Clone ID: uC-gsronu33B163a07b2
ctaaaacatgggcaacacactacttcacaaacctctcattaccttcttcttctttttcttcttcagcttatttattcaaaccaagcaagataacccatgtccgtatccatgttacccaccaccaacaggaaccggcggcggcggcggcggcacagtgacacaaacacctccagctagttactcaccaccctcccaaacaggagtatatcctccacctacagggaacttaccatattactatccaccaccaccttatggtggaggtaattctttatatggtcagccccctcctgaccctatcttgccttatttcccatactactatagaaaaccttcacaccaaacagatgatcagtcagcagcagcaacagttggtcctggaaggtcaatactcatcaccactgctaccacaaatcttggtgatttattattccaggtatttctaggttagggaatttcttagctagtgaaggagaaaaaaggaagttt

SEQ ID NO: 4963 - DNA, 405 bp, Gossypium hirsutum
  Clone ID: uC-gsronu33B163a08b2
tttatatcgaaaccggagtcatcaacagcagtccaggacgatgaagaagtggatgacacaggggtggagcccaaggacattgaattagttatgacacaagcaggagtgtccaggtcaaaggctgtcaaggcactcaaggctgctgatggtgacattgttagtgctataatggagcttactacctaataacggtgttgatttagcaattgttttggttgctgaaagtcgtgtgcttcatttcagatattcctactgtttttttgagaatgttattgtgtcgtttttcttcttgtcggttgttgtattagtaaaaaaaaccatttgtgaggacgtttctgttataaaaatggtctcggttaagaattcttggttgagggagagaatcccgttaccaagaaatttcac

SEQ ID NO: 4964 - DNA, 480 bp, Gossypium hirsutum
  Clone ID: uC-gsronu33B163a09b2
cctacgcgtccgaccgactcatctgtttttgtcaggtataatcgaatgctgcatgggaggaagactgaaagaggtcggaagcttgataatcttactataaagttcctcaaaaagtatattcattacgcaaagcataggattcaacctgagctaactgatgaggcttcagaacaaattgcaacagcttatgcagatctcagaaatgccagttcaaatgcaaagactggtggaacccttccaatcacagctagaaccttggaaaccattattcgtctgtcaactgctcatgcaaagttgaagttaagcagaaagattacgaaagttgatgtcgaagctgctctgaaagttctaaattttgctatttatcataaagaattgactgagaatgaggatcgcgaacaagaacgggaaagagaacaacagagaaaacaaagagctgatcgtcgaggccaaactgcagatgctatggaagtagatgat

SEQ ID NO: 4965 - DNA, 429 bp, Gossypium hirsutum
  Clone ID: uC-gsronu33B163a11b2
tccttcgcgtccgcccacgcgtccgacggtcaagggaagcatcatgagcttaaggtgaaggactcaaagacccttctctttggtgaaaagcctgtcacagttttcggtatcagaaaccctgaggaaatcccatgggctgaggctggagctgagtatgttgttgagtctactggtgtttttactgacaaggacaatgctgctgctcacttgaagggtggcgcgaagaaggttatcatttctgctcccagtaaggatgctcccatgtttgttgggggtgtcaatgagaaggaatataagcctgaccttaacattggctccaatgctagctgcaccaccaactgtcttgctccattggctaagggtgaacaacgataaatttggcattgtttgagggtcttatgaccactgttcattctattactgctacac

SEQ ID NO: 4966 - DNA, 320 bp, Gossypium hirsutum
  Clone ID: uC-gsronu33B163a12b2
actgatatcatacttgggttgcaaggagaggctcctacgaaacgcatgggggttccatacattggtgggaaattcacactcctcgtcatactcttcaaagtccagtgatctagataagtactagattcaatcttgcattgctttcccttttcatttgcctctgatgctccctgaatatcatggtttatatagtcttcttgttagtcacggattgtacaatctgcagcttatatttggtatagcatcactaatgatgcctcgatatcatatactggataaataatatagggtgtgccatcatgtttatagtgctctgtttc

SEQ ID NO: 4967 - DNA, 518 bp, Gossypium hirsutum
  Clone ID: uC-gsronu33B163b01b2
ccttttcgtccggcagcctctctttctcatcttgtgatttgagcttcgtgtttgtgttgggttaagcaattcgccaagatgcagaacgaagagggtcaaaacatggatctttacatccccagaaaatgttcggccactaataggctgatcacctcgaaggatcatgcttctgttcagattaatgttgggcatttggatgagcttggcagatacactggaactttctccacttttgctctttgtggttttgtccgtgcccagggtgatgctgacagtgcacttgacaggctttggcagaagaagaaagctgaagtccgacagcagtagtgggagtttggattgctttttactacttgcttggtctctgaattttggagggaaaatgtgttttttttttaatcagggacctttaggtctattttggttttttaaaatggattatggttgaatttgattctgtgatgttctgcacctaaatcgcttgcattgaacctaattttttattctattgtcgctct

SEQ ID NO: 4968 - DNA, 390 bp, Gossypium hirsutum
  unsure (1)..(390): unsure at all n locations
  Clone ID: uC-gsronu33B163b02b2
ggttcttcctcctcccaaccctccgccgcccacgtgaacttgctgctccgccctctcccacgctgacatgcgttgcctttgctcatataagaactccaagctgttgccttcccttggtattgacccaaaccttgccatgaaattgcctagcttgtgcaagcttcctcatcctgcanattgttagttcctggctctccatatttgatctcaaatgtgagggaaaatcatgcttattataagcctctacttcacattattgtactgagcttcgggttttctttttcctttatttctttntatgtgttgtgtttcgattggtatcttatagtcgtgtaatatcacatacgtgtgatttctcaccaataatcatatattagtattgtttccacc

SEQ ID NO: 4969 - DNA, 304 bp, Gossypium hirsutum
  Clone ID: uC-gsronu33B163b03b2
ctcctcgcgtccgctcaaccccaattttaaacgcccaaatttagaaccctagatttttctctgcataacttttgttaatccacaaggtttagctgctctatgagattccatcacagatctgaaggactcgaggctccgcgaattaggataagaaaaggatatttaaattcaaattgactactttttgagaaaaggatgaagaggaggaagaggtagataatgatgaaggtggtttttctgggctagagagtaccggtcattcggtgagcacggaagaggagattgctgggcctgaacatggaga

SEQ ID NO: 4970 - DNA, 346 bp, Gossypium hirsutum
  Clone ID: uC-gsronu33B163b05b2
ccctcgcgtccgcaaaaactggtagtcatgatacagcaggagcagtagcaatgtgtgggccatcaaggattagatcagaagaaaatgatgccattagccttgatcttggtgttgggatcagttccgaccccgaacatgctttaaatgagcatcaacaattgcattctgaactggtccaaagccggccacggactggtggttcaagtttcaaatttgctcaaccatctatgatggcttattacggtgctctaaaaggcggcttgaatcaatttgtttttagagtaatttactgtgaaggccgtctgttttcctttttcacacttttaaccttttttttttcttttct

SEQ ID NO: 4971 - DNA, 407 bp, Gossypium hirsutum
  Clone ID: uC-gsronu33B163b06b2
ctcgtcactcggcggctgtgtttagagcctcaacatctacactttatcctcgagccatgactttcaagcgtgggaatggtggccgcaacaaacatggccgtggccacgtgaagttcatccgctgctctaactgtggcaaatgctgccctaaggataagtcgatcaaaaggtttcttgtgaggaacattgtggagcaagctgctgttagggatgtccaggaagcttgcgtctatgacacctacactctgcctaagctttatgtgaagatgcaatactgtgtttcatgtgctatccactcccacgttgtgagggtccggtctcgcaccgacaggaggaaccgtgacccacctcaacgcttcatcaggcgcagggatgatatgccaaagcctgttcagcctggtcaagct

SEQ ID NO: 4972 - DNA, 58 bp, Gossypium hirsutum
  Clone ID: uC-gsronu33B163b07b2
ataaataaaaaaaaaaaaaaaaaaaaaaaaaggggaaaattaaaaaaaatagggggat

SEQ ID NO: 4973 - DNA, 469 bp, Gossypium hirsutum
  unsure (1)..(469): unsure at all n locations
  Clone ID: uC-gsronu33B163b10b2
tcttttacgcgtccgcatttctccacttgttctcactgtatcatcttccattaatggacacccatctcttcttcttcgtcttacttgttctccccgtagcttattccgatgaccacgacctgttcttggaatgcaatcagacattcaattgtggtaccatacaaggcatcggataccctttctggagccctaccctgcgccctagttactgcggtcatcacgggttcgagctcatttgccaacaaaatcagtcccctgttatcaccattaatacccagagatttcatgtactgaacatgactcctcctcccctgatgaccattgcacctgttgatacctgngaagatccttgtcctcaacaattccataacatctcattaaaccacctctttgattttgctgcaaccattcgaaatctcactatattctacggctgccctcttgaagatgatataccttttccacatag

SEQ ID NO: 4974 - DNA, 337 bp, Gossypium hirsutum
  unsure (1)..(337): unsure at all n locations
  Clone ID: uC-gsronu33B163b11b2
atcntgggttgtaccgtcattgagatgtttaatggtagacctccttggggtgaacttgaagggcctcaagctttgttcaaagttctgaacaaaaccccgcctgtaccagaagcattatctccagaaggaaaggattttctacgttgttgctttcaaagaaatcccgccgggcggccatccgcaactacgctacttgagcatccttttgtacgaaattcggctgatcaaaatggacaagccctcatgcaggccttttctagaatggatctaacggataaatcacattagtatgagaatagaaatgatgccgacttccccggtaacaaggatgacaaac

SEQ ID NO: 4975 - DNA, 410 bp, Gossypium hirsutum
  Clone ID: uC-gsronu33B163c01b2
cttgttgatactataagtgcagtagcgtaagaggatgtcctgctagaaaacatgtggaaagagctttagatgatgcttcaatgctaatagttacatatgaaggtgatcataaccattctctatctgttgcagaaaccaccatacttgaatcttcatagatgaacaatatttttttctattattaatgttgattttactgtttatgttcgggatttgaggatattatcaaatctgctcgtttatttccttgtaaattatatgctttgtgctttctttaattgaaagaccatttgagatcaaaagggaagaaaaagatgttagatttggtattagattttgcaattattgagggattgaaaattcaattccaaattaaagtttccaatgccaccttttgttgttgttttttt

SEQ ID NO: 4976 - DNA, 275 bp, Gossypium hirsutum
  Clone ID: uC-gsronu33B163c02b2
ccctcgcgtccgctcaaggccatcatcaagccacagtatgttgatcatattccaaaggcagtccaaggcaatgtgggacaggtgcttgaccaaaaagatgagagagagatgaaggctgaactctgtgctgatcttgaactaaaccaggtcatagatcgtaatgttggggatttatcaggtggggagctccagagatttgctattgctgttgtcgccatacagaatgctgagatatatatgtttgatgagcctacaagcatccctgatgtttatta

SEQ ID NO: 4977 - DNA, 278 bp, Gossypium hirsutum
  unsure (1)..(278): unsure at all n locations
  Clone ID: uC-gsronu33B163c04b2
ccnttttctctgcaatctcttctttttggagtttcagcacaccttatattacaatgagtttaatcagcgaaactcaaattacacccacccaagtctcagatgattaagccaacttattcgacaagtagagggatgattcttcaaggacaacattggtcctctaatcagccattgaactagtttcgctagacatcatggctaaagctggtccaggtgctttcttgtccctaacagaagtggatttcaagctccccaccaccaaccctgttagctcccgt

SEQ ID NO: 4978 - DNA, 474 bp, Gossypium hirsutum
  unsure (1)..(474): unsure at all n locations
  Clone ID: uC-gsronu33B163c07b2
tgtttacgcgtccggaggtgcagacacatcggaggaaacatttcatgcgacaaaggcattggcggagaggtttcataagacgataatatgctcccaggactattcgggctttatcgtgaatcgaatccttatgccaatgataaatgaagcatttttcacactatatactggggtggccaccaaggaagatattgatacagcgatgaagttaggaacaaatcatccaatcggtcccttggagcttgctgatttcattggactcgatgtgtgtttatcgataatgaaagttctacatgctggtctaggagacagcaaatatgccccttgccctcttcttgtgcggtatgtcgatgcangtcgtgttgngagataatgtggcgtcagtgtatatgactaccgtaaggggtcttgacctataaggcatcttcccgactctgaatatatcttggttcatggataatgataccaaaagca

SEQ ID NO: 4979 - DNA, 480 bp, Gossypium hirsutum
  Clone ID: uC-gsronu33B163c08b2
tctacgcgtccgcatggatggcgatggacatggaagtcatacagcagctattgccgctgggaataatggtattcctgttagattgcatgggcatgaatttggaaaagcaagtggaatggctccttgtgccaggattgctgtctacaaggcaatatacaggctttttggagggtttgtcgcagatgtggtagctgcaattgaccaggctgttcatgatggtgtggatattctcagtctctctgtgggaccaaatagtcctccaacaaacacgaagaccacatttttaaatccttttgatgctacacttcttgcagctgtcaaagctggtgtttttgtagcacaggcagctggaaatggaggtcctttccctaaaactttggtttcttatagcccgtggatagcatctgttgcagctgcaattgatgatcgtagatacaaaaaccatctgaacttgggaaatggaaaagctttagctggact

SEQ ID NO: 4980 - DNA, 517 bp, Gossypium hirsutum
  unsure (1)..(517): unsure at all n locations
  Clone ID: uC-gsronu33B163c11b2
ttatgactaccacattttgcttcgtatctttgatggtggaagccaaatggctggttgttttttcagtggcggcaatgctggtggcactggccaactgccaggaatcgttgaagccattggtgaagatggtaaagggcaagaagctgtgtgacaaagggtgggaatgtaaagggtggtcaaagtattgttgcaaccataccatttctgattacttccaaacttaccagtttgaggacctttttgcgaagcgtaacacgccggtagcacatgctnggttgggttctgggattaccattccttcattactgctgctgctcagtatcagcctcatggatttggtaccaccggggaaaagctccagaatatgacggaagtcgctgcttttcttggacatgtcggcagcaaaacttcatgtggctatggagtcgctaccgggggaccattggcttgtggtctttgctaccacaagaaatgagccctagcaaaatatattgcgatgattactataaatacccct

SEQ ID NO: 4981 - DNA, 230 bp, Gossypium hirsutum
  Clone ID: uC-gsronu33B163c12b2
tgtttcatttttttcgactgatcaaagctcttctgtttgcttctaatcaaactaggggcctgccttcagcttttatgtttcttcatcgtcattgctaatcacagagaataaaagtagtgctggtgttcctatcttggttcattttaataattttatgtgtgaaaaaagaattaagtatttaaaaggaagtgttgtttaatttgtactctagaaagaaaatcttgagcttg

SEQ ID NO: 4982 - DNA, 381 bp, Gossypium hirsutum
  Clone ID: uC-gsronu33B163d01b2
gatttattcaaaactcatccaatgaatctactaagtgagaggacccttaagggtgctttttatggcaactataaaccacgcactgatattcccatggttgtcgacaaatatttgaacaaggagctggggctggatatggacaagttcatcacacactctgtgccttttgccgatattaacaaggcattcgactacatgctccagggtataggtctgagatgcatgattcatttggatgcttaaggaaatgttgctgctgtatatttgcccatccaaggatcaaaactctaatgttttgtcctactatgtgttatattatgtgcctacttaagctacctttcccggttatcaagagtgcctatatagaactctctctctctc

SEQ ID NO: 4983 - DNA, 292 bp, Gossypium hirsutum
  Clone ID: uC-gsronu33B163d02b2
cactagggacacgtgttagcttcgaccttgctaataatagggttggcttatcttctcataaatgttaacgacactaattaatttaataattaccctttttcttattgctgctgtaatatgagtaacgcttttttctgtttgaaaaggatgggtcccactggaataaattataaaaaaagaagaagaaagtattagggttctgttagaaattaaaaaaaaaaaataaaaaaaaaaaaaaaataataaaaaaaaaaaaaaaaataaaataaaataaaaatgtaaaaagaaaacg

SEQ ID NO: 4984 - DNA, 338 bp, Gossypium hirsutum
  Clone ID: uC-gsronu33B163d03b2
ctttctcgtccgtggatgggagccatgatagtggcttgcactcttccagtgacattggtgcatttccctcaatggggcagcatgttcttcccaccatccaaagatgtcgtcaaatccaccgaagaacattactactcttcggagtggaatgaggacgaaaagaaaaagggtatgcactcggctagtctcaagttcgccgagaacagccggtcggaacgtggaaagcgcgtggcctcagcaccaaccccgcctaatacaaccccttcccatgtttaagtaaatcatattaagtgttttcctttttcttgttgaataataagaaggttttcacttttttt

SEQ ID NO: 4985 - DNA, 507 bp, Gossypium hirsutum
  unsure (1)..(507): unsure at all n locations
  Clone ID: uC-gsronu33B163d04b2
cttttttcttcttctcctctcttcctttacaaagattggaagctgggcttttataggcgaaaaaggaaataaatcgaaaaaatacaatatacttgtttccattcgctgctgtttttgtttccttcttgcaggtacagagtctgttggcatgcgtacgggtgcaggcgtggcatacgagggctgtggaggtatgggactgcttcttggttgtggcacaaaacgaaaagagggggggacctaaggtttctggagctgttaagggaatgggcctattgggcttgtttcgatttgggctcatgatgggtatcgggctagggttaatgtatttgggctgctttgtaccaaagacctggactgtggtatacatatttttttttgtgattttgttttttgtattttcgttttgtttcttgtctttatacgggccgggcaaatttggtccattacaattattanttatttacttataaatttaaatatatacatatatattacatttttattttt

SEQ ID NO: 4986 - DNA, 493 bp, Gossypium hirsutum
  Clone ID: uC-gsronu33B163d06b2
caataatgatggttactttccatcagaaagcagggggagggaatcttacaggcgtgcaacgcaagtattgcacatctaagtacggttatgctgcaaaaactgaaccagcaacttttctccttgaggcaaaatcctagcacaacttgaaagcatttgcttttttattgaccaaataaagccgccaagaaacctaactatgaactgagaggggataggggagcaaaagagcaacgcaagttgccccagggcttatgaatatgacgctgtctaactcagtgtttgcctttttttagttttatatcttatttgaacttaaccagattatgtttgtttttcattttctctttcccagagagaataaattgtagaactgttccaacaaaaccatttttatttgtttatatatcacaagcaacttagacttaagccccccgcccccgcgattggataaatgatttgtgttgaatgttaaaaaaataaaaaatacatacat

SEQ ID NO: 4987 - DNA, 326 bp, Gossypium hirsutum
  Clone ID: uC-gsronu33B163d07b2
tttagagaagacctaaagaaccttgctacaatattcaagaacacagcatatacagaagggttttacgcaggtactcgctatcaacctaagcgtctttgaagtcatttgtgatgcttagcttaaactctgttgtaccattttgcttactggaaacaaaatccaaacaaaaaacgtaaattaaagggagaaatgtagttctcattgtctcataactcttgttttttcctgacatttgatggtaactatgtaagccctgtttttgaatcagataaaaatgttaattggatacgttgttatcaggataatgaaggagctttttagaatgt

SEQ ID NO: 4988 - DNA, 524 bp, Gossypium hirsutum
  unsure (1)..(524): unsure at all n locations
  Clone ID: uC-gsronu33B163d08b2
tttacgcgtccgcaaaattcacacgctgccttgaaaccatttcatactctcgaatgacatctcaaaccacgcgagctccctcataaggagcgtctccaaaaagaatacaatcatctacaaaaacaaataatttattgaaaaacgttccctaccaattgtcacacccctcatcaacccattctgatttgcttctttgataagagtagaaaatccctcagcacagatgagaaaaagataaggactgagagggtctctctgtctgccttttgaaggcaaaaaccactctctatttgacccattaagattcaccgaatatgatatggaacaaacacatctcataatcagtactatccaatcagcatgaaaacccagtttagttatcattcccgctaaaaaatctcattcaacccgatcatacgctntacttttatcgagtttaagcgcanaattccctttcttgccacttttcttcatcttaagagaatgaaggacctcataagcaaaaagcacatgaacgatatatg

SEQ ID NO: 4989 - DNA, 412 bp, Gossypium hirsutum
  Clone ID: uC-gsronu33B163d10b2
gtgagctcctattcacaactcctggagctctgcggcacctttgaggtgttattgggtttgaggaaaccctttatcaaaaaaccgcttcgggcaagcccttcgttgatgttttgaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaatttttgttgacggatcacatga

SEQ ID NO: 4990 - DNA, 276 bp, Gossypium hirsutum
  Clone ID: uC-gsronu33B163d12b2
tgattgacacattgggagggcagaagtttagcacggattcttgtcaatgttttcaatctatgttgctttagactttctccttaaatacgttcagtgtttctattcgacatattcaaaaacaagtagaggtatgatttttcaaggacaacattgcacatatatatttgtaatatttgagttgcggcagccgaagttgtccatttagtatgtcaagttgattttgggttaacgtggatcatgtcaaattgggcttaaaagctattttgagtttgggtt

SEQ ID NO: 4991 - DNA, 430 bp, Gossypium hirsutum
  Clone ID: uC-gsronu33B163e01b2
cctacgcgtccgcccacgcgtccgtctctcctttgttttcccttttgtctctctctctctttttccaaccctaaccctacctcaccaaccaggattcaacatgaagggaggaaaatccaagtcagatactaagagtgccaagctatccgtgaaatccaaagctggaaagaaatcggggaaggctgccaaggatccaaacaagccaaagaggcctgctagtgccttctttgttttcatggaggagttccgtgagcaatacaagaaggatcaccctaaaaacaaatccgttgcggctgtcggcaaagctggtggagataaatggaagagcttgtctgaagctgaaaaggcaccttatgtagctaaggcagaaaaagcgaaggttgagtatgaaaagaacatgaaggcctacaataagagacaggctgagggt

SEQ ID NO: 4992 - DNA, 499 bp, Gossypium hirsutum
  Clone ID: uC-gsronu33B163e02b2
atattctttgctttcccttttttttttttttttgccaatggcttcttcaccaaaattcatctcttacttcttccttttagccctcttctccgttgaaatacatggtagggatttttttagcaaaatcccaagtgttaacacaaatgagaaagaggtgaccaacaaagaagaacaaaccactttggggaagaaggagcaagagccaaggtttgtccccgagacccaaaatggctatgggctttacggtcacgagtctggtcagctccctcctagcaccgccagtaccaaagaaacctatgaaccctatgtcacacctgttaaataccaccctgatgaaccctacaatagcatcccagcgtccaaaaccaacaacaaagactcttacttttatagcaagacaaatgcgtacgggaacactgagcagcaaagtgaagccaggttcaatgagaaaggatggaccaccaaggaaacccaacactacaatggccactattacaat

SEQ ID NO: 4993 - DNA, 514 bp, Gossypium hirsutum
  Clone ID: uC-gsronu33B163e05b2
gttttctgctatcaaaatggaggtcatgaccccttcattggaaacaccggatgagggttgtatagctattgatttccacatgcctccaatttgttctccaattgttaggcctggcagaccggctgaggcagcaccagtcgttgcaaagcaattgtcagacactattttaagctctggcatgatcaatttgaaggaactgtccttggttagtggaaaagctgcttggatggcatatttggacatatactgtttggatgctgatggtgctctttttgacactgcattactctcagcggttgctgccttttctcatttggaaatccctgtggtatctctcaacgatgatggaaagaatcgttttatcagaggaacaaggactatctgacagggaaccagtcaataaggagaagagaaaaattaatctgagcagcgttccgttttcattgacatgtgtactttacaagaactacattttggcagatcctactgccgaggaagaatctattatggacac

SEQ ID NO: 4994 - DNA, 445 bp, Gossypium hirsutum
  Clone ID: uC-gsronu33B163e06b2
gtttctccacgctgagttagttgaacagtttagtagcgtctggcatcacagcagagttagaagataccttacatccgaggactggcccggtcctgaatccaaggggaaaccatggtacggtctgcttatgttgttgagaaaatatcctgaacactttgtcattaacacaagatccaagggtcggataacattggagttcgtctctcttgtatctttgctttcgtagaagaatgctaatgaagcaccaaatgacacttccccttgcatggtcatcttacatatgccatgtttgggaagacaaagaagttgcaaagtgtagaatatcatgatactaatgttgttcttatcttttagatccacccactttgagctctgaactggctttgctggctaaatgcacctggattttatggattttaagatatattgacatcaattttcattt

SEQ ID NO: 4995 - DNA, 453 bp, Gossypium hirsutum
  Clone ID: uC-gsronu33B163e08b2
tttttaaggctgctgaggaagcggagaaagcaacggaggaggtaaaggatgacaccccggaggtgcagacagaaacagttacagaggaggccaaagtagagaccgaggaacccgcggtggaggagaaaccagctgaggaggaaaagggagatgaaaaagctgatgagattcctgttgagaaagttgaaaaatagagcgaccaataccatacgtaaggtggcaaatgcttaaaggagcttcttttttctatagttggcggagtcatactactattatttatgattactatgtaggatgtgggatggtgagggctttctttttctttaatggttgtttctctgctttggggtttgatatttagtattgaacttgcttttgggtccaggggtcaacatgccgatggaagaaactatgggttttccattttgaagtggtatggatgtatgtatgtat

SEQ ID NO: 4996 - DNA, 517 bp, Gossypium hirsutum
  unsure (1)..(517): unsure at all n locations
  Clone ID: uC-gsronu33B163e09b2
tgtttttagagcttttgctgaaggagctgaaagaaaccgaaaccctggcgcaaaagatagggaaagccattaggcaccctggctttccttctaagtctagggtttacgccgatgtcaatgttattcgtcctaaagagtactgggattacgagtcccttattgtccaatggggggaacaagatgattacgaggtggttaggaaagttggaagagggaaatacagtgaggtgttcgaaggcgttcattgtactgataatgagaaatgtattatcaagattctcaaacctgtaaagaagaagaagattaagagggagattaaaattctgcaaaatctttgtggagggccgaatattgtgaagttgctcgatatagttagggatcagcaatcgaagacaccaagtcttatatttgaatacgtgaataatacggattntaaagtgctttatccgacactctcagattatgatattagatattatatctatgaacttttgaggcattggatatttgcactcac

SEQ ID NO: 4997 - DNA, 457 bp, Gossypium hirsutum
  Clone ID: uC-gsronu33B163e10b2
tcgtcgttctctcaaaattgaaggcgagctatatggtggaatccctcctggtgtggaagctcgacttgctaatctgacactagatacagatgatctgaagaagttctcagaaatgcggaatcgagctgagatgccgtcgactttccaactaaacaacattagtgaatttgcagaatacttgcctgctttctttaatatgcttaacgtacgtcgtgctatcgtacctgctgctaatggacattgctcagctcgtgcacttgcacgctactatgcagccttagctgattgcggtgtggtgccgacaccacattcctctgcttcaaatccaccgcttggcagccattcgcatattcccaaatttccttcgaaaaagactgatgaaaagcaaaagggtaaagtggatggtggtttgaagaatgaaagaagtgatggtaggcaaaacgttacattatgatcg

SEQ ID NO: 4998 - DNA, 487 bp, Gossypium hirsutum
  unsure (1)..(487): unsure at all n locations
  Clone ID: uC-gsronu33B163e11b2
tttttattcagggtcatacaatgaagttagttgaggttgaaggatctcatgtggttcagaacttatatgattctcttgatgttcatgtcggccaatctttagctgtcttagtaacgttgaatcagccaccaaaggattactacattgctgcatcaacaagattttcgaggaccgttctcactgcaactgcaatgttgcactacgcaaactcacaaaccccggtttctggacccctgcctgcagctcctgcattccaatttcattggtcaatgcagcaggcaaggacatataggtggaatttgacatctaatgcagccaggcctaatccccagggttcattccattatgggaagataacaacaaccaagaccattgttttggccaactcggcatcttttataaatggaaagctgcgttacaccgtgaatggtgtctcctatgtgaattcngataccccttcggaacttgcagattattttaacatttc

SEQ ID NO: 4999 - DNA, 435 bp, Gossypium hirsutum
  Clone ID: uC-gsronu33B163e12b2
tgtttgctctgtatattgaaattttctttctcgagtttctctttagccaaaaaaggggcagatcttcgtcaagactctaaccggcaagacgatcactctcgaggtcgagagctccgacacgatcgacaacgtgaagaccaaaatccaagataaggaaggcatccctccagaccagcagcgtctgatcttcgccggaaaacagcttgaggacggccggaccttggccgattacaacatccaaaaggagtcaactctccacctcgtcctccgtttgcgcggtgggatgcaaatcttcgtgaaaaccttgaccggcaagacaatcactctcgaggtcgagagctccgacacgatcgacaacgttaaggcgaagatccaagacaaggaaggcatccccccagaccagcaacgtctcatcttcgccggaaaacaacttga

SEQ ID NO: 5000 - DNA, 452 bp, Gossypium hirsutum
  Clone ID: uC-gsronu33B163f01b2
cctactcgtccgtttatgatgtcatctggaaagagaaaacgtgaggattttgcacaataccaaaatggtggatatataccccaacaagatggagctggagatgctacatctgaagttgcaaaggcagagggaagtaggggtggtaatttcctggatagacgtcactcaacaaccactgcaaaaagcaagatcttggcagagttatctaagtcatcatcaaagattcctcaactggatggtccaattcctgatccgtacgaagacatgctttctactcccaatatatacaattatcaaggagttgttaatgaggactacaatgtggtgaacacaccagctccaaatgaccttcaggcttcaacacctgcccctgctccccaaaatgatataatagatgatgacgatgatgaaccattgaatgaagatgatgatgaagatgatttggatgatgt

SEQ ID NO: 5001 - DNA, 415 bp, Gossypium hirsutum
  unsure (1)..(415): unsure at all n locations
  Clone ID: uC-gsronu33B163f02b2
ctgtctcgtgggggaaactttgtttacgagattgggcttctctttcttccttctttatttcttggtctcttgcgatctctctttatctttctctccggtggacaattatctcgtcaattgtggcgccttgctggatgccaccgtagataatcgtcgcttcgtctccgactcgtccgattcttctcactcgcatctctcttcacctcaattgttctcactctgtgctggaactttgctgccgggtctgcctccgatctatcataccgccagggttttcaaggcaccgtctaaatatgttttcgatgtcaaggatccagggacacacatgttacgtctccattttcaccgattcagttcaccacaattgaatcttgctgactctaaatttcacgttttggtntaatgggttggtagc

SEQ ID NO: 5002 - DNA, 84 bp, Gossypium hirsutum
  Clone ID: uC-gsronu33B163f03b2
ctttttcgtccgatcgcctactaaaaaaagtattgaagcttttatcacaaaatgcaaataaagagagaaggaggaaatgtaagg

SEQ ID NO: 5003 - DNA, 423 bp, Gossypium hirsutum
  Clone ID: uC-gsronu33B163f07b2
tgtttgatgaaccgacccttgtcttggatcttgactctcacaaattgcaagcattcactgctgcttatgatgatttggaatccactctctctggcttgaatgtattgatcgagacctactttgctgatcttactgctgaggcatacaagacactcattgggttgaagggtgtcactgcttatggtttggatttggttcgtggagcccagactcttgatttggtcaagagcaatttccctaagggcaagtacctctttgctggagttgtggatggaaggaacatttgggccaatgatcttgctgcttctctcagcactttgaaggagcttgaggcttgtgttggcaaaaaaaacctggtggtgtccacatcctgctcgcttctccacaccgctgttgatctagtgaatgagactaagctagacg

SEQ ID NO: 5004 - DNA, 447 bp, Gossypium hirsutum
  unsure (1)..(447): unsure at all n locations
  Clone ID: uC-gsronu33B163f08b2
attcaatatggtaagcttttgaaggacttcaacaaagggttggacaacaacaaggagatccaagagctgaaggttgatgttgagaagttcgcatcctcattcgatgcctggcttcaagatgtccgaaatgaagtacaaggattagatctaaataaccatacgatctaattgatgttattatcagcatctgccactttttgggttgcccccatttgatgtcttatgagtgaaaggaaaaagaaagggaaaagagaaggatgcaaatgccttccacgtacggttttaagtgtcttcatttactggtcaatttgatatgatatttttcaagtttttgctgttctgtctttataagagtttgcataaaacgtatgtactaattttatgtattcttttttggtgctagaaaagttttttttttggnggggggagataaaggagagaaatgaa

SEQ ID NO: 5005 - DNA, 492 bp, Gossypium hirsutum
  Clone ID: uC-gsronu33B163f09b2
ttttggagcttcctttcaacctcgccatggttatagaggatatgaaagaggaagaggaagaggaagaggaagaggaactgggagttcacgtccagtgacaaaatttactgaagactttgatttcgtggcaatgaatgagaaattcaagaaagatgaagtatggggtcatcttggtaacagtagcaaatctcatactaaggataaagaagcagatgccgttaatgaatatggttctcaagatgaagatgatgctgaaatacctaagattcaaacgaagcctgtttacaataaggatgacttttttgatactctctcctgcaatgcacttgataatgactcgcaaaacggaaggccgagattctctgagcaaatgaagttagacacagagacttttggtgatttttcaagacatcgaggtggacgtgggcgtggaactggacgtggacgtggtggtcgttatcgtggtgggtattatggaagagggtatggata

SEQ ID NO: 5006 - DNA, 219 bp, Gossypium hirsutum
  Clone ID: uC-gsronu33B163f10b2
gtttaaagagatgtcggaggccatacatgtgcatgatatcagtttatgtctcgaggaatttatatgttttgtaacacagattgggacctaagaccaacaaccctagtatctttgtgttcacttctattcgtctacgtggtattgctgatgaagtttgatgttgatgttgtgtaattttacaaagtatattttttcattattatgtagtgatatttattc

SEQ ID NO: 5007 - DNA, 509 bp, Gossypium hirsutum
  Clone ID: uC-gsronu33B163f12b2
tcctacgcgtccgtgatgagtgtatggttcttgagggtgaggtcttgtatgacatctgtttccgcacacttaagctaaccactcccagcttcggcgatttgaaccatttgatatctgcaacaatgtctggagttacatgctgcttgcggttccctggtcagctcaactccgatctcaggaaacttgccgtgaatctcatcccctttcctcgtcttcactttttcatggtgggttttgctccactcacttctaggggatctcaacagtaccgagctctaacagtacctgagctcacccagcaaatgtgggacgcaaagaacatgatgtgtgctgctgatcctcgtcacggtcgatacttgactgcatctgctatgttccgtggtaaaatgagcaccaatgaagtggatgagcagatgttgaatgtccagaacaagaacttctcatactttggtgagtggatcccgaacaatgtgaaatcgaccgtttgtgacattccacccactgggctg

SEQ ID NO: 5008 - DNA, 303 bp, Gossypium hirsutum
  unsure (1)..(303): unsure at all n locations
  Clone ID: uC-gsronu33B163g01b2
ccatgcgtccggatttaatagctttgtttgcataaagtgttgtatgtcttgagttgaagtattgctagggaacttatttggcattatcaatatagtggttgtaagaacaaagacgaggacttcaggttatgtctgtaatagcccaaattttaactttttctattgttagtgttacagaatttactatttattaaaataagagatgataaattctcaaannataaaactcaaatatttaatacttttttgtttgattatatttattgaatgttacttttgggtaacgcatttctatgttttatt

SEQ ID NO: 5009 - DNA, 502 bp, Gossypium hirsutum
  Clone ID: uC-gsronu33B163g02b2
ccttctcgtccgcaaggacgaagtggaggatcttgagaaggccggtatcaatgttatccaaattgacgaggctgctttgagagaggggttgcctcttagaaagtcggagcacgccttctacttgaaatgggctgtccactccttcagaatcaccaactgcggtgtccaggacactacccagatccacactcatatgtgctactccaacttcaatgacatcatccactcaattatcgacatggatgctgatgtgataaccatcgagaactcacgttcagatgaaaagctcctttcagtattccgtgaaggagtgaagtatggtgctggaatcggccctggtgtgtatgacatccactctcccagaataccatcaaccgaagagattgctgaccgaattaacaagatgcttgctgtgcttgagaccaacatcttgtgggttaacccagactgtggtctcaagactcgcaagtatgccgaggtgaagccagccctgaacaacatg

SEQ ID NO: 5010 - DNA, 255 bp, Gossypium hirsutum
  Clone ID: uC-gsronu33B163g05b2
gttcattgaaaaccagatcgaaaaatgtcgggaatcatgcacaagatcgaagaaacccttcacatgggagggcacacgaaggaagaagagaagcacaagggagaagctcatcacgaaggcggccatggccatggttatggcgccgctgagcacaagggagaagttcatcacgaaggcggccatggctatggatatggcgccgctgagcacaagggagaagctcatcacgaaggcggccatggctatggcgccgct

SEQ ID NO: 5011 - DNA, 471 bp, Gossypium hirsutum
  Clone ID: uC-gsronu33B163g07b2
ttcacgcgtccgctcagtttttattgaaaaccctagacctcccaacgaagtagcagagccgcagtttctctgtcaaatatccgaaacaagaatggctgtcacattcaacgatctgggttctgctgctggcttgaagaagctggatgagtatctccttacacgcagttacatctctggataccaagcttcaaaggatgatattaccgtctacgcagctctatctggtgccccatcatctagctacgtcaatgtttctcgatggtacaaacacattgatgcccttttgagaatctcaggtgtttctgaagaaggctgtggtgtgactgtagagggatttgctcccgccgaggctgttgccactcctccagctgcagattccaaggctgcagctgctgaggaagacgacgacgatgtagatctgttcggtgaagagactgaggaggaaaagaaggcagctgaagaacgtgcagc

SEQ ID NO: 5012 - DNA, 476 bp, Gossypium hirsutum
  Clone ID: uC-gsronu33B163g08b2
tttacgcgtccgcccacgcgtccggaaagggattgcaaagttaaagtattgggaggcgacatatgaagatgctcttagtttgatagctcgtgtgccattggtagcttcgtatgtttatagaaggatgtacaaggatggaaaatttattcccatggatgactcattggactatggggggaatttttcgcacatgttgggattcagcagtcaccaaatgcacgagcttatgaggctttatgtcaccatacatagtgatcatgaaggtggaaatgttagtgcccataccggtcacttggtgggtagtgcactttcagatccttatctttcctttgcggctgcattgaatgggttagctgggccgcttcatggtctggctaatcaggaagtgctactttggataaaatctgtggtagaagaatgtggagagaacataaccaaagaacagctgaaagactatgtctggaaaacactgaacg

SEQ ID NO: 5013 - DNA, 292 bp, Gossypium hirsutum
  Clone ID: uC-gsronu33B163g12b2
tttttactagataccaagctttgaaagaagttctgtccatcttgggattgatgcatgggtggttttacttgcatttcatataaaaagctgaataatttgtaagtgtcgaggtggttgaaaatttacttttgccgagagatagggaccttcaaagttttgtcatggtggtcttgtttctcagtagtggcattcttcagtcccttgtttcttttgtcaataatgtttatttttattttttgcatttctcctctttgcaaccgtatcgatggtatacaaaacatgtttccctctc

SEQ ID NO: 5014 - DNA, 410 bp, Gossypium hirsutum
  Clone ID: uC-gsronu33B163h01b2
tcttttttaaaaaactttcagaaaattgatccatccaaggttttactttttcattcactcttcttctttaaattttttcttataatattagggtattgatttagtcccttcttccttttcattaaccaatagcttcttttaagcttgcgatgctattttctttaaatttttttaataaatactgatttgattgttcgacttactttatttatgattggtgaggtctggtgtagaggagttgtatctctcctaaatcaaactaacccttcaattatttcgctataagtttctttatttttgttgctttgatatgataagctgagaactacgaaaaataattctcttttctagctgtagttagatgccttcaaatttctgtcttttaagagtgaagatcaatatgaaattga

SEQ ID NO: 5015 - DNA, 513 bp, Gossypium hirsutum
  Clone ID: uC-gsronu33B163h02b2
cctttaaaaaaaaagctcaagagagaagaccatgggcgatcaacttacggacgatcagatctctgagttcaaggaggctttcagcctctttgacaaggatggcgatggttgcattactaccaaggagctggggactgtgatgcggtcacttggtcagaaccctactgaggcagaactccaagatatgatcaatgaagttgatgctgatggaaatgggaccattgattttcctgaattccttaacctaatggcaaggaagatgaaggatactgattccgaggaagaacttaaagaggctttcagggtgtttgacaaggaccagaatggtttcatatctgctgctgagcttcgccatgtcatgacaaatctcggtgagaagcttacagatgaggaagttgatgagatgatccgtgaagctgatgttgatggtgatgggcagatcaactatgaggagttcgtcaaagtcatgatggccaagtaaggataaaaaatgggtaaaaaggggaacagggc

SEQ ID NO: 5016 - DNA, 524 bp, Gossypium hirsutum
  Clone ID: uC-gsronu33B163h03b2
gtttttctcacactatttgcattcaagtgcatgtgtgcatcagctatttaccttgctagagggaatcatgagagtaagagcatgaacaaaatctacggttttgagggcgaggtcaggtccaagctgagtgagacatttgtggaactctttgcggaagtattctgttatttgcctttggctcatgtaataaatcaaaaggtctttgtcgttcatggaggccttttcagtgttgatggggtgaaactctctgacattagagcaatagatcgattttgtgagcctcctgaggaagggttgatgtgtgaattgctttggagtgatccacaaccttacccaggacgagggcctagcaagaggggagtaggtctttcttttggtgcagatgtgacaaggagatttttgcaggataacaatctagatttagtagtgcgatctcatgaagtaaaagatgaaggttatgagattgagcatgatggtaaaactattactgttttctctgcaccaaattactgtgatcagatggg

SEQ ID NO: 5017 - DNA, 389 bp, Gossypium hirsutum
  unsure (1)..(389): unsure at all n locations
  Clone ID: uC-gsronu33B163h04b2
atttcttactcatttagcccctttcattagcatcgaggtcactccagatttctttatcggtgaaaaatttcttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctcccttgaagcagagacgcctttgtctntaagaaataatatgttttggtggttatggtgttttaga

SEQ ID NO: 5018 - DNA, 204 bp, Gossypium hirsutum
  Clone ID: uC-gsronu33B163h07b2
ttttaattattaggttatatataatataaggtggaggatttagctgatacaaatgttgccaaaaaatgtatatgtgaatttactttactgctttttttttaaagatttactgcttttatttaaactgcactcttttcttttactgtaaattaaagaaattttaaaaaaaaaaaatttgatgaaataaaaaaaaaaaaataatat

SEQ ID NO: 5019 - DNA, 493 bp, Gossypium hirsutum
  Clone ID: uC-gsronu33B163h08b2
ttatcttcccgatttgttttacctcgagcggggcagcctcgaggagcaaaagttaaagagatcgcgtttcagggagctgaaggaggatgtgcagaaagcatttaataaagacaaagccgagtttaaccgcaacggcttaacttcgtcgtcgtcgtcttctttaaaagatggcggtcggtataagctccaaaaattatgaagaagtctgggtttttttttatatattttgtgaaattaatgtttttaattgtttaacaaaccattaaaatgtctatagagatggtttttttaaatgtattcttgtaggctttgcttgatagggtgaaaggaaaattataaggatgaaaacttgaaaggtagaaaactaaaaggatggaaaacataatttttcctatgcttggtaggaaagacaaaaggttggaaagatggaaaaatatataattttgaaataaaatatatttttctcattctctttatttcaaccaagcatagt

SEQ ID NO: 5020 - DNA, 236 bp, Gossypium hirsutum
  Clone ID: uC-gsronu33B164a02b2
aataaataaataacaaaaaaaaaaaaaaataaaaaaaaagggggggttttttttaaaaaatttggggggtataacaaacaaacgtagatcgtgtgggtggttccttgccttcttttctgtccctttccttggtgtgccttttttcctcgtgtttcatttttttctgggggggcgcccttttggggtcctttggtttctggcctgtcctgggccgtttttttttttttcttggggcc

SEQ ID NO: 5021 - DNA, 124 bp, Gossypium hirsutum
  Clone ID: uC-gsronu33B164a03b2
atttatttttctgggttcttttttccattgaaatcatgagattcatttccatggaatcttgagttttgcatgtcaatttagggtttgagatagacgaatgaccggctgagcaaaacctacaggt

SEQ ID NO: 5022 - DNA, 403 bp, Gossypium hirsutum
  Clone ID: uC-gsronu33B164a04b2
gttttatttggcgcgtgcagatctcgctacactggaaaaagattatgattaagttgtcgctagggctgatgacggagacgaaatgattactgatgagtcttgaggtttgtgccggtatgccgttgcatactgttatgaatttgacagtcgattttggatatgagttttctggctatgaacacctcggatgatgtcctatttgtggttgttttatatgaataaagggcacggcacatgcatttgatcggcatgtccaatttgcaagcagcttatgctgctgctgtttaccaagaccgaccgatcctttcaaaggatatattccctgatctagctttcatcatacaatcatgtttgcttcaggaccctatcatgacgtcaagttaagtcagatagtacttgtgct

SEQ ID NO: 5023 - DNA, 479 bp, Gossypium hirsutum
  Clone ID: uC-gsronu33B164a05b2
ccctttcttccgaaaaaaagtgtctcatttttagcaggggtacagtcgtcctcatcgaacaactatggcagccatcaaagtccacggaagccctatgtccactgctacacagagggttcttgcatgccttcacgagaaaggtactgattttcagtttgttcccataaacatggctgccggtgaacataaatccgaaaactacctttccctcaatccattcggtcaagttccagcttttgaagacggggacttaaagctcttcgagtcaagagcaatcacccattacattgctcatgaatacagcgacaaagggacccaactcttaatccctggctctaacaaggatatggctgtcttagaattatggaaggaagtggaagcccaccagttcgattctccatcttcaaaaatagcctgggaggcgttttacaagccatttttctgcatgggtaccgactccgcggctgtggaggaaaatg

SEQ ID NO: 5024 - DNA, 348 bp, Gossypium hirsutum
  Clone ID: uC-gsronu33B164a08b2
tttattttgagtggtaaagtccccatattccctgcccaagtattcaacattgaaggaaacccttacctttataccaaaggaacagacaaggtggataaaggatcattgcccaactccagcaaggccaaactcaacaaatctggaattttttatgttataaccatactaatggttccttattattattctcacttgtgggattcttcatttttcatatgaatacgtatatttaatagaacaactttgacaaaaaaaaaaaaaaaaaaaaaaaaatataaaaataaaaaaaataaaaatttataaaatattaaataattataaaattaattataaaaataaaattaaatg

SEQ ID NO: 5025 - DNA, 498 bp, Gossypium hirsutum
  unsure (1)..(498): unsure at all n locations
  Clone ID: uC-gsronu33B164a09b2
gcttttccccagccgagtttgccaccaccggttcagcatgcgaaccagttccctcagagccatgttccttctgttcctcagcaagacccttactatccaccgcctggtcaaactcaagagactcctagtcagcaatttccaatgccacctactcagcaaccacagctccctcctgcaacaccacctcatcaaccatatcaaccagcacctccaccgcaatattctcaacctccgcagccccttcaactacaaccttctgtaggccaccatccggaagaggcaccttaccccctttctcagatctatccaccgaatctgcgccagccaccttctcaaccacccagtggtggtcctccctctcaacaatattatggggctccgccccagntgcgtgagccatcaccatccagcaggcctggtccaggcttttctaccggatatatcccacaatctggtccaagtgaaccctatgcttatggtggatcaccttcacaatat

SEQ ID NO: 5026 - DNA, 424 bp, Gossypium hirsutum
  unsure (1)..(424): unsure at all n locations
  Clone ID: uC-gsronu33B164b01b2
cccactcgttcggcaaggaaggccttagaggagcctcataagaattttgaaggtcatgttttgcattgccagaaggccattgatgggccaaaacagacgaaaggcgggtttggtggaggtgcttctaccgggcatcatcagcaataccagcagcatcatcagcaaggacaacatcaaaatcagtctcgttaccatcactctaagaaggggaaatactcgtctagtggatcagaaactggccatttgatggctccatctgggcctgctgcagtgggagntggggttcaaccctggagttgctgctgctgggtttaaccctggggtggctgctgctgcaccagctttaaaccctgtgcttggacaggctttgactgcattgctagcctctcagggagctggtttggggcttggtaatctgcttgga

SEQ ID NO: 5027 - DNA, 411 bp, Gossypium hirsutum
  Clone ID: uC-gsronu33B164b02b2
cccattctttcgtggcgatccattagagaaagttcaaaaaacttaattaatggcgaacagagttcaaatccccacgagcaactcagctcttattgcaatgattgccgacgaggacacggtggttggttttctaatggctggtgtgggtaatgttgacttgcgaagaaagacaaattatcttattgtagattcaaaaaccacagttaaacaaattgaagatacatttaaggagttcactacaagggaggatattgctgtcgttctgattagccaatatgttgcaaatatgataaggtttctggtggatagctacaacaagcctgttccagcgatcttggagattccatctaaggatcatccatatgatccggcacatgattcagttctttcacgggataaatacctcttttc

SEQ ID NO: 5028 - DNA, 291 bp, Gossypium hirsutum
  Clone ID: uC-gsronu33B164b03b2
gcctttctgtccaccatggctgccaacgaagctgaaggggaggaagtttgaggcaaagtggtggatgggatgctatagctaacattattgttcatgttggtggtgccagcgagcttgcacgcccaggtactcttgcctaaaccgctgtttaccgaggtgctgggtcatgtgctgtcacggttttctaccacgtaccaagactcttagctggaggatgagccttatgttgacacggctcttatgatgtcgccgctggacattagtgcttcctctagttttccttatcactta

SEQ ID NO: 5029 - DNA, 439 bp, Gossypium hirsutum
  unsure (1)..(439): unsure at all n locations
  Clone ID: uC-gsronu33B164b05b2
cccacgcgtccggtttatatgtcagttctccaagatgccctccttattcggctctaacccttcatcctccgatcctgcaaacgacaccgtgccttccccttcctcttcttgttcctcctcctcgtctccggacatgtggaattacttttttatccctatcctcctctgcctcaccaaagaactttcccttgctaaagctcaaacctcaactggactcctcctcccgaatcaacgcggcgacggctcggccgatgattcactaatttccttttcgagttgcgcgaatgctgacccgaagctatattatcggcctgtgattgggatactgagtcatccaggagacggcgcgtcggggaggctgaacaatgatactaacgcttcctacatagctgcgtcgtacgtgaagtttgtggaagcggccggngctcgagtcattcct

SEQ ID NO: 5030 - DNA, 470 bp, Gossypium hirsutum
  Clone ID: uC-gsronu33B164b06b2
ccctctcttccgaaagggttcagttttcaatctgcgttttttttagtgttgttgtgagaaaaaaaaaactagttatggctgaagtttttgggaagggaaatctgtttacgacttgtaactatagtcagacgaagaatctagaaggtggaacttgtttagttcctaagaaaatttctgggttttctttagaaaggaactgtttttcttctttaaaggttaaatctcaggctttgagaagtggttttaatgggcaaagaatggtttttttggagaagaaaagtatgaacaggagaaggttttgtcaagttcccatcaaagcacagatgcaaagtgggcttattggtcgagttcagaaatggtgggagaaagggcttcaaccaaatatgaaagaagttgcatctgcacaagacctagtagactctcttttgaatgctggtgataagcttgttgtggtagatttcttctcccct

SEQ ID NO: 5031 - DNA, 421 bp, Gossypium hirsutum
  Clone ID: uC-gsronu33B164b07b2
ataaataagtgtctcatttttagcaaagttacagtcgtcctcatcgaacaactatggcagccatcaaagtccacggaagccctatgtccactgctacacagagggttcttgcatgccttcacgagaaaggtactgattttcagtttgttcccataaacatggctgccggtgaacataaatccgaaaactacctttccctcaatccattcggtcaagttccagcttttgaagacggggacttaaagctcttcgagtcaagagcaatcacccattacattgctcatgaatacagcgacaaagggacccaactcttaatccctggctctaacatggatatggcttgtcttagaattatggaatggagttgaagcccaccagttcgtctttccatcttcaaaattaggctgcgtggctttttttc

SEQ ID NO: 5032 - DNA, 124 bp, Gossypium hirsutum
  Clone ID: uC-gsronu33B164b11b2
tgataattgaaattctcccaaaaataaataattaaaaataaaaataaaaagtatttttttttgaattattttcgttttctggatttcttttcctttctctggcggagatgaatggagaaggaaa

SEQ ID NO: 5033 - DNA, 339 bp, Gossypium hirsutum
  Clone ID: uC-gsronu33B164c01b2
atcctaatctgcaagcacgcgataccaacctaacgggttgttgtataggcaacaacaaacccgtcaggaatcctcattgctttctcttggattgagcttgtacggtaggcgaaccatggcaatcccaacatcatcatcaacaacaacaactagggctaatgacacttcaagaccatcaaaaacgtttgagatttatgatcatgttgatacttcacttcatctctagtagggtaaagaaaagaggttgtcaatactgggtttcatttttcgaacccaaattcgatgttatttcctacatcaactaattaagttccattttctcttttttttttttggggg

SEQ ID NO: 5034 - DNA, 355 bp, Gossypium hirsutum
  Clone ID: uC-gsronu33B164c03b2
cccacgcgtccggtcatgctcctcttttcctttggtatactctcaatagaaaaggttataaaggatttcaaaaagatgttcagaaatgcctcagaaatgctcactacttgaaagaccgactgcacgaggctgggatcagtgctatgctaaatgaactcagcagtacggttgtgtttgagcggccccgggatgaggagtttgttcgtaggtggcaacttgcttgtgaagggaatatagcacatgtggtggtgatgcctaatgtgacaatcgaaaaactggatttcttcttgaatgaattagttgaaaaacggtcgacttggtttcaagggaatgttcaacctccttgtattgcagc

SEQ ID NO: 5035 - DNA, 416 bp, Gossypium hirsutum
  Clone ID: uC-gsronu33B164c05b2
gcataagggagggcctcttttcttcacaaccaccatgagctgcgactcttcaataaccaagaggctggatggcaaggtggcactgataactggtggtgccagtggcttaggaaagtgcacagccacactttttgtcaaacatggagccaaggttctcattgctgatattcaagacgaactgggcgactctgtttgccaagagcttggaactgaaaacatcagctatgtccactgcgatataacatgcgaatccgatgttgaaaatgccgtaaacttggctgtctccaagtacggaaagctcgatatcatgttcaacaatgccggcactcatggtgacaacgaaacaagagtgacacacgccagcactgaagacttcaagaaagtgtttgatatcaatgtgttgggtggtttcttgg

SEQ ID NO: 5036 - DNA, 483 bp, Gossypium hirsutum
  Clone ID: uC-gsronu33B164c06b2
ctgtattttctatattaataataatggagttgtagaagggaagagagaataaaaaaactaaaagaaagaaactaagccaaaaagaagaagaaggaaggactgagttgaataatattgaaaggttagtgagttgaaaaataacataaaaatggcaacatttgcagggactcaacaaaaatgcatggcctgtgacaagactgtttacttggttgataagctcactgctgataatagggtctttcacaaagcctgtttcagatgccaccattgtaagggtactctcaagcttagcaattacaattcttttgaaggggtgctttattgcaggcctcactatgatcagctcttcaaaagaactggcagtctagacaagagttttgaaggaacaccaaagattgccaaacctgaaaaacacatagaaaatgagaatgcacagaaagtggtgaatttatttcgtggaaccaaagaaaaatgtgtgggatg

SEQ ID NO: 5037 - DNA, 455 bp, Gossypium hirsutum
  unsure (1)..(455): unsure at all n locations
  Clone ID: uC-gsronu33B164c10b2
ttatttgtgaagaatcccggggttttagtagggaagtttaagagattagccattttgaaggagtttggtgatgaatcgcctgatcttggaatcggagaccgtgaatctgatcatgatttcatgtcaatttgcaaggaggggtacatggtgcaccctagcaaatcagcatcaccagtaccgcttgatcgcctaaagagccgcattatcttccacgatggtcgctttgtccaacgtccggatccactcaatgcctggctaacctacctttggctgccatttggcttcatcctatccattattcgtgtctacttcaatctacctttacccgagcgtatcgtacgctacacttacgagatgctcggcattcacctcgtgatccgcggaaagcgacctcccccaccatctccggngaccccaggcaacctctacgtctgcaatcaccgcacagctcttga

SEQ ID NO: 5038 - DNA, 365 bp, Gossypium hirsutum
  Clone ID: uC-gsronu33B164c12b2
tccattcgtccggtgattatctcatagaccagggtcggtgatcactttggtgtaaccttaattgttgcaattcttcctggcttcttctatacaaaagtgcatctaccaccacctcttgtaatggttggctgcaattaaataatagtattactagtattaaagtcgtgtggaaccttttccagaaacaataggcttggtgtttgtaatagtgataatgcttgtgatccaaaaaaaaaaaaaaaaaaaaaaaaaaaaaaaaaaaaaaaaaaaaaaaaaaaaaaaaaaaaaattaataaaaaaaaaaaataaaaaaatataataattattttataggtttggaaaaaaaaaaaataaaaaataggggg

SEQ ID NO: 5039 - DNA, 530 bp, Gossypium hirsutum
  Clone ID: uC-gsronu33B164d01b2
ccctcgcgtccgattgaaccaaagaaaagacatgggagtttcaggcactttggagtatttgtctgatttaatgagcagtagtggtcataagcacaagaagagaaaacaattgcagacagtagagctgaaggtgaggatggactgtgatggttgtgaactcaaggtcaagaaagccctctcttcattgaatggagtgaaatcggtgaacataaacaggaaacagcagaaggtgactgtaacgggatatgttgaagctaacaaagtgttgaagaaagctaagtcaacagggaaaaaggctgagatttggccttatgttccttacaatctggtggctcaaccttacgctgttactgcttatgacaagaaggcacctcctggttatgttaggaaagtagacaacaatgtaagcagcactgctaccgtcactagatatgaagatccttacatcaccatgttcagtgatgaaaacccaaatgcatgttctgtcatgtgaagctgcaatttatattactatttcttttgggtttctc

SEQ ID NO: 5040 - DNA, 528 bp, Gossypium hirsutum
  Clone ID: uC-gsronu33B164d02b2
gtcttcctaagttgatcaatctgtaagtttgaatgagtcagtccatgctttcctagtttgtaaagtttgaacataaatgcatgatgaattatttctttttatacttttttttaatttactgatgaaatggttgaattgtttttgcagttttcttgattcgaatgatcttagtggtgaagttccagatcttttgtttaacattccaatttataagtatgattattttttattagtttgtttagtttcctatttgtattgaaataacactttctatatgattaaattatttttggtatctgtgtttttactacatcctttacacaccagacacatattcatcagctgggaacttaatcgcttaactttgtttattcagttttgcaggaaacaggttaaattgtggtgaaaattttcctcacccatgtgtgtcaaatggaaatgattcaggtgatttcagtaactattttgactaaataacattttttttaagaagttcaaagcagcgttgcccaggaatgtgcctagatc

SEQ ID NO: 5041 - DNA, 483 bp, Gossypium hirsutum
  Clone ID: uC-gsronu33B164d05b2
actcattcattctttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagataagacttgaattcttagggaatctgagtggtgacccttacattttacacaccaatgtcttcacacaaggcaaaagcaacagagaacaacaagtttatcttttggtttgaccctacatgaaactttcacaccta

SEQ ID NO: 5042 - DNA, 99 bp, Gossypium hirsutum
  Clone ID: uC-gsronu33B164d08b2
tcctctcgtccgaaaaaaaaaaaaaaaaaaaaaaaaaaaaaaaataaaaaaaaaaaaaaaaaataaaacaaaaaaaaaaaaaaataaaaaaaatatagg

SEQ ID NO: 5043 - DNA, 412 bp, Gossypium hirsutum
  Clone ID: uC-gsronu33B164d10b2
ttcttcttaattcagctgaaaatggcaccttcatctccgccacaaacaccgccgtccgccgtggttattgtcctcctcttactcttctccacggcattgctttgtgaatcaaggttaagcttagattactactccaaaacctgtcccagtttcaccaaaatcatgcaagacaccataaccaacaagcaaatcaccagccccacaaccgccgccggtacactccgtctatttttccacgactgtcttcccaacggttgcgatggttccatcctcatatcttccaccgcattcaacaaagctgaacgtgatgccgacatcaacttatctctccctggagatccatttgacctcattgttcgagccaaaacagcccttgaactcgcctgtcccaacaccgtctcttgctccgaca

SEQ ID NO: 5044 - DNA, 437 bp, Gossypium hirsutum
  Clone ID: uC-gsronu33B164d11b2
ggatctggttcacaaggctatgagtgaaactccagagttaaagcaatatcctgcactcagagtagaggtgggaaatgctgcgattgagtctcttgaaagaatgagggatcagagcaaaaaagcaacacttcaactggttgatatggaatgttgttaccttacagttgagttcttccgaaagcttcctcaagacgtggataagggtggcagtgctacgcaatctatatttgaccgatacaatgactcctacctgaggagaattggtaggttcatatacacaaaaagtttgagtatggatctcaattgtttgaaacttaatcgaaggatactattattcaatgtattttatttctgataatgggtttctaacaatgtatgagcaggaagtacagttttgtcttacgtaaatatggtctgcgctactttgcgccactcga

SEQ ID NO: 5045 - DNA, 537 bp, Gossypium hirsutum
  unsure (1)..(537): unsure at all n locations
  Clone ID: uC-gsronu33B164e02b2
aaatggacctggaagcaaggagtttgcaaccaggggttaaggcttctcttcttgctaaattaagggaatacaaagctgatctgaacaaattgaagaaggaattcaagagaatttcttcacctaatgctcatgatgagttgttagaatcagggattgctgatatacactcggtttctgctgagcaaagggatcgattgtcaatgtcagtggagagactaaatcagtcaagtgagagaattaaggagagtagaagaactgttctggaaacagaagagctcggtatctcgatacttgaagatttgcatcaacagcgacaaactctnttacatgcccacaacaagctttatgatgtggatagcgccattgacaagagcaagaaagttttaacaaccatgtcaagaaggattaccaagaacaaatggatcgttatctcgataatcgtagcacttgtccttgcaatcatcttaatcctgtattacaagatttcacatggctgatgaaatcttttgaccattaatggtctgcaatttggatatg

SEQ ID NO: 5046 - DNA, 505 bp, Gossypium hirsutum
  Clone ID: uC-gsronu33B164e03b2
cccacgcttccgcccacgcgtccgcccacgcgtccggggcaagtggaaagaatccgaatattcaggtggtcagtttattcccgttggtggtctagcttactatgttactgcccctgcaagcttggcagatatggcagcaaatcccttccatgctctgttttatctagtgttcatgctttctgcctgtgccttgttttcgaaaacttggattgaagtttccggttcttcagccagggatgttgctaagcagctcaaggaacaacaaatggtgatgccaggacatagagattcaaatctacaaaaagaactaaaccgttacataccgaccgcagctgcatttggcggaatgtgcatcggtgcattaactgtcttagccgatttcatgggagcaatcggttcaagtaccggaatattgctagccgtaacaatcatatatcagtatttcgaaactttcgagaaggagagagccaagtgactcggctttttcggtctctaagttttgata

SEQ ID NO: 5047 - DNA, 497 bp, Gossypium hirsutum
  unsure (1)..(497): unsure at all n locations
  Clone ID: uC-gsronu33B164e04b2
gttttattatatgttgatggtttgaaggggattggaccggcggattgggtttacgggatgaaattgtcttacgccgtgccggacaccggttgtgggaggtgtactcggtccggcggtgcttgtggttatgataccgagactggtgtcatgatgtgcctttgctctacttccatgaatgctacgagagaatgtggtagcaatggagatataggaagtggtcaaaagttggcattgcggacaaagtttcatgcatttgccttggtggtgggtgcatttatttactttgtaatattcatatgaacaatgaatatagtggctgnatgttttcttcttcttatagttactggtgctccaaagaaagtgaccaggccattcttgtggagggttgattggtttatatccaaattttgtaccttctttanaaaaataaataatatttnattttttttttttatttaatatttatttttcttatttattttatattttattttggg

SEQ ID NO: 5048 - DNA, 412 bp, Gossypium hirsutum
  Clone ID: uC-gsronu33B164e05b2
cccacgcgtccgcccacgcgtccgggaaatataaaaagaccttgaacgatgcagttcactcagacacatcgggccactacaggacttttcttctctctcttttgggaccaaacaattagacatcgtaagtgtagttgtgtgtgtaaatatgttataatgatgtttcagtgaatccagttcctttcgtatcggattggtgtattcgtggcagattggtagaatcgaaagtgattgcatagctgattaggtgaaccatgttaaagctctttaaactgcagttgtgtgaatgtgagagagaatgcgagagagaatgcatgtagttgggaggcttttcccctctggtcacaagtaatgtgccattaacataaattatgttaaatttgaaataaataataaatttctccttggtttt

SEQ ID NO: 5049 - DNA, 525 bp, Gossypium hirsutum
  Clone ID: uC-gsronu33B164e06b2
cgtttagtttcttcaatgaatggcaaccgtagcagcgccagagcaccaccatcaccaccaccatccggcgtcgctagaggaagtccgtacgctttggataggagacctccagttttgggtcgacgagtcctaccttaactcttgctttgctcatacctgcgagctagtctcgataaaaattatacgcaacaagatcactggacttcccgagggttatggatttgtggagtttgtttctcatgcagcagcggaaaggatattgcagacatacaatgggacaccaatgcctggaactgaacaaatgttcaggttaaattgggcttcatttggtgcaggagaaagacataatgaccctggccccgatcattctatttttgtaggggatttggcgcctgatgttacagattatctattgcaagagacctttcgagctcattatccatctgttagaggtgccaaggttgtgactgatccaaatactggacgctcgaaggatatggatttgttaatttttaaatgagactg

SEQ ID NO: 5050 - DNA, 391 bp, Gossypium hirsutum
  unsure (1)..(391): unsure at all n locations
  Clone ID: uC-gsronu33B164e07b2
atttatatctcaattgtggctaatttttctcaaggtccacaggtcagccctgattcttttttttcccctccttcttgcattagggactgccatacagaaattcattatacaggtcctggtattacaggtataattgtgtagttactgaagcaagttcagtatacaatgttttggcacagttgtgtgttgaggtgcatttaagcaaaaatatagtttctgatttgttgtaatgtcaaagatataaattctttacaacactcaagaggaacatatgtatgatttatgattctataaagttatttctctcttccgtttgcaaaanaaaaaaaaaaaaaaaaaaaaaaaaaaaatattaaaattatttaataaaataaaaaaaaataataaaatg

SEQ ID NO: 5051 - DNA, 341 bp, Gossypium hirsutum
  Clone ID: uC-gsronu33B164e10b2
ttcattcgtccggccacgcgtccgaggaagataaaaagtggttaataagagataaattaccgaacgcgtaacagatacaacaccaagtacaaccagcaccgtgttggcggaacccctggagggaagcttgtttatcaaacgacaaagatatgagttggtggacctaattgtcctgttaccggcaagaggtttaaaggaattccttatttgaagcctggtgagtataaaaggtctaggttgcctagaaaccgtttgactgtgaaccgtgcttatggtggaggtctatctggaagtgctgttcctgaaaggatcataagggtcttgtgggtggtagagctaaa

SEQ ID NO: 5052 - DNA, 478 bp, Gossypium hirsutum
  Clone ID: uC-gsronu33B164e11b2
tcctctcgtccgatctgtacgaagaggttgacatcatcagcaaaggcggaaactacggttggcgtgtttacgagggtccatatcgttttaatccaacatcatcacctggagggaacacatctgcaaattccattaaccccattttcccggttatgggatacaatcactccgaagtaaacaagaaaataggatcagcctcaattataggaggctacttttaccggtccaacattgatccttgtatgtatggaaggtacctgtatgcagacttgtattcaggtgcaatatgggcagcaactgaagacccggaaaacagtggcaacttttcaacgagcacaattcgttttggttgtgcaagagactctcctttacaatgcagcagtgtgccaggaagtgaccttccagcattgggttatattttctcatttggtcaggacaatagcaaagacatctacttgttaaccagcagtggagttta

SEQ ID NO: 5053 - DNA, 450 bp, Gossypium hirsutum
  Clone ID: uC-gsronu33B164e12b2
tcctcgcgtccgattcaggaccagcatggagttgctgggtcttatatgcaagcttggcgtgggaaggaacggagtatggctgcacttcatgggacttttgaggaagggtatcgtcttcttcctgcatactgtgagcaaataaggaaaaccaatccaggaagtgttgcatcagttgttgctactcgacaagaaaattgtttccagtgcctctttatttcttaccgtgcatctatctacgggtttataagtgcttgtagaccacttctggaacttgataaggtggatctgaaaggaaaatacttgggttcattgctttgtgctgcagcagttgatgctgatgatgttttgtttcccttggcaattgctattgttgatgttgaaaatgatgaaaattggatgtggttcgtgtcagagttgagaaagcttctttgggtgaacactgaaaacatg

SEQ ID NO: 5054 - DNA, 414 bp, Gossypium hirsutum
  unsure (1)..(414): unsure at all n locations
  Clone ID: uC-gsronu33B164f01b2
cccacgcttgcgggagtcactgattaagtatgtctttgaacccaacaagagaacctgagccttttgagcagcagtttacaggaatagaattcggtattatcctatgttttttcttcattgagttattgcctggaatatctttgcagtttaattcatttgttataatcttgtcttccacctcattaattttcactagataactcttaaggtattactattagatttaaaccattcattgttactagctgcaccaagctgtatcctagtttgtccgtccattcttgaagaaactatctataggtgctttacaaattgtcatttgcaggctgacaggtgtattatttggcattacattagttgaatgttatgactttcaacagtcacctactggtcaaaaaataaanaaaaaaacaa

SEQ ID NO: 5055 - DNA, 508 bp, Gossypium hirsutum
  Clone ID: uC-gsronu33B164f02b2
cccacgcgtccgcccacgcgtccgatttttcttatttgtttctctccgtttaaacttagaaacaaaacctctagtagtagtattagaatcatgggtgttgtgagttatgagtttgaggtaacctccccaattgctccagccaggcttttcaaggcttttgttcttgaagctgccaaggtttggcccacggctgcccctcatgcagtcaagagtgttgagctcgaaggtgatgctagtcctggaagtattgtaaagatcacctttgttgaaggccttccataccaatatatgaagcaccagattgggggacacgacgaaaacaatttttcatacagttacagtatgattgaaggtgggcctttaggggacaagcttgagaaaatcagctatgagaaccagtttgtggcagctgcagatggaggaagcatttgcaagagctcaataaaatattacaccattggcgactatgtaatcaccgaagatgaaatcaagactctcattaaaggga

SEQ ID NO: 5056 - DNA, 439 bp, Gossypium hirsutum
  Clone ID: uC-gsronu33B164f03b2
gtgtattcagtaaaggaaatatgttggcaatattcagcaaagggttagtgaatccaccccaagagctgcagagtccagcttcactcacttcatcaatgaagcctaagcttccctttgaaatccttaatggttttgtctcttcaaatcccaccaacgctttttcaatgcggtttggatcttcggcttctttggcttatgttccaccccacaatccttcctccacttataaaaggttgtttagtggagtggatgaaatgcattgcatattcatgggtaatttgaacaatctatgtagcctcttaaggcaatatggtctatcaaggggcaccaatgaagcaatgttcatcattgaggcatataggacccttagagaccgtggtccatacccaccacatcaagtcctcaaccacattgaaggtagctatgggttcgtcatcta

SEQ ID NO: 5057 - DNA, 380 bp, Gossypium hirsutum
  Clone ID: uC-gsronu33B164f07b2
tgtgatgccaccttcaccgggaacaccgtgtcctccaccaccacctccggcacaacaaacatgccccatagacactctcaagctaggtgcatgtgtggacgtgttgggtggcttagtacacatcggcataggtagcagcgccaaagacacttgctgccctgtactacaagggctgttggatttagacgctgccatttgtctctgtactacgatcaaagccaaccttttgaatatcaatattataatccccatagctcttcaggtcctcatcgactgtggcaaaactccacctccagggttccaatgtccagcacaatgatgaaaaacataaaaaccccatgtttttttttctttcgaagtaacaaatattttcatgtctt

SEQ ID NO: 5058 - DNA, 500 bp, Gossypium hirsutum
  Clone ID: uC-gsronu33B164f08b2
tctttctagctatatccttatcagctttcaaagatggcaggaatcgcctttggtcgctttgatgattccttcagtttggggactgtcaaggcctaccttgctgagtttatctcaactttggtgtttgttttcgccggcgttggctctgccattgcttacaacaagttgacaactgatgcagccctagatcccgatgggctagtcgccattgctgtttgccatggatttgctctctttgttgcagtggctatcggtgccaacatctcaggtggccatgtcaaccctgcagtcacttttgggttagctcttggtggccaaatcaccatactaactggcatcttttactggattgcccaacttcttggatccattggtgcttgcttcctgctcaaggctgtcactggtggcttgacagttcctatccacggtcttggagcttgagttggagctattcaaggagtggtgatggagatcattatcacatttgcattggtttacac

SEQ ID NO: 5059 - DNA, 465 bp, Gossypium hirsutum
  Clone ID: uC-gsronu33B164f09b2
taattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtggaatagaagctttgtttggtgtgaaaataatgtataagccatttggttgggagcaattggccttttctcaaaggattt

SEQ ID NO: 5060 - DNA, 500 bp, Gossypium hirsutum
  Clone ID: uC-gsronu33B164f10b2
tccacgcgtccgggccagcaccagaggcagctccaaaatggttcagcggctcacttaccgcacgcgtcacagctacgccaccaagtccaaccagcaccgcgtcgtcaaaaccccaggagggaagcttgtttatcaaacgacaaagaaaagagctagtggacctaaatgtcctgttaccggcaagaggattcaaggaattcctcatttgaggcctgctgagtataaaaggtctaggttgcctagaaaccgtaggactgtgaaccgtgcttatggtggagttctatctggaagtgctgttcgagaaaggatcataagggccttcttggtggaagagcaaaagattgtgaagaaggtactgaagattcagaagacaaaggaaaagcaatcatccaagtgagagctaggatttgctaatggattgatagtgaatcttggaataagtagttgaggggatttaagaattggatttatggttttacatttggtatgaatcatggtct

SEQ ID NO: 5061 - DNA, 464 bp, Gossypium hirsutum
  Clone ID: uC-gsronu33B164f11b2
cccacgcgtccgcaaaaattttctttccatttctcctttttggtggctgcttttttccccttattttctctccataagaactctttttctcttcattctcccaatatcttcatttgaagcaactatgtcttttagaggaggaaatgcatcgtcgggcatgggagtggctgaacacagcaaaagcacgtacctggaactgcagaggaagaaggtgttccgatatgttatcttcaagattgatgagaagaaaaaggaggtcatagttgaaaagattggaggtccgacagagagctatgatgatttcgcagcctcattgccggagagtgattgccgctatgcagtttatgacttcgattttgtgacttccgagaattgtcagaagagcaagatcttttttattgcatggtctccttctgtttcgaggatccgttccaagatgctctatgcaacatcaaaggacaggt

SEQ ID NO: 5062 - DNA, 445 bp, Gossypium hirsutum
  Clone ID: uC-gsronu33B164f12b2
ctctcccatggatggcgatggacatggaagtcatacaggagctattgccgctgggaataatggtattcctgttagattgcatgggcatgaatttggaaaagcaagtggaatggctccttgtgccaggattgctgtctacaaggcaatatacaggctttttggagggtttgtcgcagatgtggtagctgcaattgaccaggctgttcatgatggtgtggatattctcagtctctctgtgggaccaaatagtcctccaacaaacacgaagaccacatttttaaatccttttgatgctacacttcttgcagctgtcaaagctggtgtttttgtagcacaggcagctggaaatggaggtcctttccctaaaactttggtttcttatagcccgtggatagcatctgttgcagctgcaattgatgatcgtagatacaaaaaccatctgaac

SEQ ID NO: 5063 - DNA, 194 bp, Gossypium hirsutum
  Clone ID: uC-gsronu33B164g06b2
gttttatctgaaatttcatgatggttaggtttttgttttattgttagagttcttttttgtgtttgggtgatgggaaagtgtctggggatgggaaaatgatgtgggatttggtctcttcttgtttgaagatgaccaaatggtttgaaataaaagtgttttgagggatgtgtggaagaatatatagtatttgcctt

SEQ ID NO: 5064 - DNA, 438 bp, Gossypium hirsutum
  Clone ID: uC-gsronu33B164g07b2
ttaataaataaaaagaagcaaaagcaaagagataattaagagaggaattcgaggaagaagaagggttttttttttcaaaaaaaaaaaaattgctttttttctcttttgtgtgaagaagctggagctatcaaagatgatgcagattgagcagcaacaacagcagccccagcagcaacaaaaccagttaatggttcaaaactctgggagtttaagctttagcagtcacttgtctaaagaagatgaagagatctctaaattagctctttctacttttagagctaaagaagaagagattgaaaggaagaagatggaagttagagaaaaagttcagcttcagttaggtcgtgttgaagaagaaactaaacgtctggctgtgattcgtgaggagcttgaagcacttgcagatcctatgaggaaggaagttgctcaggtgaggaa

SEQ ID NO: 5065 - DNA, 409 bp, Gossypium hirsutum
  Clone ID: uC-gsronu33B164g08b2
tttgtagggcttgtggacttcaatgtgctttaaaatgtatgccaagaaggacagatattgctgcgtggcagaaatctatagatagtatgtgctacaataagcttgctgagccagatgtcttacctgccaagtgtgatgatagtcttgaaccagattcagcatggtacactccactccgcccgtgtgttgtggtcccaaagccagaacttaagaagtcagccttagagtccctgcacaaagtggccagagaggttgcaagtcgcacctgaacgcatctcaaatgttcccggagggagtagcactgctttaaagcatgatgacagcaagtggaaggtccgagccacgcactacaaaaagttacttcctgcacttgggaccaatgagataaggaatgttatggacatgaata

SEQ ID NO: 5066 - DNA, 363 bp, Gossypium hirsutum
  unsure (1)..(363): unsure at all n locations
  Clone ID: uC-gsronu33B164g09b2
tcctcgcgtccgcccacgcgtccgagaagttacacccgatggtggagtagggaaagccaacacattccttccagggaagcttcattgggtggctattgggatgatgtccatggctatagttctatggtagtagcttaaagtggaccctcagtcaccagtctgcagtttcatcactgagagtcgattttacttcgatatttgatgatttatgtttatttgattattgttctgggttcttctttatatatatatatatatacattattcatttctgtataaataagtcagacctggtgagggatgctgttttgtactcaactctatttgtatactgtggttatttttgagtatatacttgtatnt

SEQ ID NO: 5067 - DNA, 486 bp, Gossypium hirsutum
  Clone ID: uC-gsronu33B164g10b2
cccacgcgtccgccttcaccactgaaccttcaactgctcccttcactcctcctccggagtcggtacacttgaccacaccatcctcgcccgaggtgccatttgctcagttccttggccctaacctccattatggagaggctggacagagattcccaatataccagtatgaatttcagtcctatcaacttcatcctgggagccccattgggcaactgatctcaccaagctcaggaatctcaggttctggcacctcatctcctttccctgatggtgattttgcttctggtttacgttttcctgagttccgaatgggtgaccctcccaagctcttgaaccttgataagctttccaaccgtgaatggggatcaagtcatggttctggaactttaaccccagatgctacaacgtccaccccccgcaatggtcttcgtttggatcatccgctctctgaaattgtgtcacatccgagtttggataaacaaaacc

SEQ ID NO: 5068 - DNA, 506 bp, Gossypium hirsutum
  Clone ID: uC-gsronu33B164g11b2
ctccataaacacccaaagtaaaacgaggggagactttgagacaacatcttgtaggtcccccctaaaaaagggtttgtaagagaaatggctactttcccagtgatcaacttagagaagcttaatggtgatgagagatcaagaatcatggagcaaatcaaggatgcctgtgaaaactggggattttttgaggtgatgaaccatgggattccacatgattttatggacactgttgagagattaacgaaagaacattataagaaatgtatggaacaaaggtttaaagaactggtagcaagcaaggctcttgaaggacttgaggctgaagttacggatatggattgggaaagtacatttcacttgtgccatctccctgaatcaaacatggctgaaatcccagatctcagtgatgaatataggaaagtgatgaaggaatttgcagtgaaattggagaaactagcagaggagtttgtggattttgtttgtgagaatattggattagagaaagg

SEQ ID NO: 5069 - DNA, 459 bp, Gossypium hirsutum
  Clone ID: uC-gsronu33B164g12b2
tgattaaaaaaatcacctactctctcactttgctctgggcttgttcctgtcctctttcaccaaactatcgccgacaacctctccaaaagaatggcatatgaagggattctgttggggatgggtaatcctctccttgacatttcgttagtcgtggacgaagagttcttgaaaaaatatgatatcaagttgaacaatgcaattttagctgaggagaaacaccttcccatgtatcaagaaatggcatccaagcccaatgtagagtatattgctggaggtgctactcaaaattcaatcaaagttgcacagtggatgcttcaaattcctggtgcaactggttacattggctgcattgggaaggacaagtttggggaggaaatgaagaagaactcaaaagctgctggtgttaatgttcaatatctcgaggatgaaactgcaccaacaggaacttgtgctgtttgg

SEQ ID NO: 5070 - DNA, 372 bp, Gossypium hirsutum
  Clone ID: uC-gsronu33B164h01b2
ttccaatctccagctcccaaggtaaatatgccgatcagaaacatagcagttggccggcccgaagaggcgactcaccccgatgctctcaaggcagctttggctgagttcatctcaaccttgatcttcgttttcgctggatcgggctcaggaatggcttttaacaagttgaccgacaacggagcaacaaccccggccggtctcgtagccgccgctctagctcatggcttcggtcttttcgtcgctgtctccgttggcgccaacatctcaggtggccacgtcaaccccgccgtcaccttcggtgctttcgttggcgggaacatcactctcttgcgcggcattctttactggatcgcccaactcctaggctcaacc

SEQ ID NO: 5071 - DNA, 416 bp, Gossypium hirsutum
  Clone ID: uC-gsronu33B164h02b2
ctactatgtttgaagtataccagcttttaagagctattggagagcgatacaattttaccaccgaggatgaaattttgatgccttcagatactggtgatgctgattatttagaggaacttattgttgctcgagaagtcaacgagagtcagtgaagagctatgggatatggtgagtattgtatcttagcatagtgcatgtgtaagtatttgctcttgtgcatgtttaaataaaggttgaagttacatgtatgatgctttacttactatttcaactttctacatccagtactcactgtaattgtatcaggtatattttttagcatctacattaggtctttatgtctggtatttcatattagaatccttcaccaatgtcctcgaggaaaaaaaaactttagattgattagtatcatacgt

SEQ ID NO: 5072 - DNA, 478 bp, Gossypium hirsutum
  Clone ID: uC-gsronu33B164h04b2
caaggatttacaagaagatttcatgggtggtgctgagattattaaatcagaccctgttgtgtcattccgtgagactgtccttgagaggtcttgcaggacagtgatgagcaaatctcctaacaagcacaaccgtctgtacatggaggctcgacccttggaggaaggtcttgctgaggctattgacgatggacgcattggtccaagagatgatcctaaggttcgttccaagatcctggctgaggagtttggttgggacaaagatctcgctaagaagatttggtgttttggccctgagaccactggccctaacatggtggtcgatatgtgtaagggagttcaatatctgaatgaaattaaggattcagttgttgctgggttccagtgggcatcaaaggaaggtgccctggctgaagaaaacatgagaggcatctgcttcgaagtctgtgacgtggtccctcatgctgatgccatccacaga

SEQ ID NO: 5073 - DNA, 494 bp, Gossypium hirsutum
  Clone ID: uC-gsronu33B164h05b2
ccagtattcaagcctcccaaggtgaaaccaccaccatatgagcctaagccaccggtttatacacctccaaaaaaagagaagcctgaacccaaaccaccagtgtatgaacctcctaagaaggagaagcctgaacctaaaccaccagtatatgaacctccaaagaaggagaaacttgagccaaaatcaccggtttatgcacctccaaagaaagagaaacctgaacccaaaccacccatatatgaacctccaaagaaggagaagcccgagccaaagccaccggtttatacacctccaaagaaagagaaacctgaacccaaaccaccaatgtatgaacctccaaaaaagcctccaatgtacgaacctaagccaccaaaaccatcggtttatacacctccaaagaaaaagaaacctgaacccaaaccaccaatgtatgaacctccaaaaaagccttcaatgtacgaacctaagccaccaaaaccaccggtttatacacc

SEQ ID NO: 5074 - DNA, 475 bp, Gossypium hirsutum
  Clone ID: uC-gsronu33B164h06b2
gcgatatatttacagagttctaccgccatggggagaagacctgcaaggtgttatcgtcagataaaaaacaaaccttacccaaagtcacgttattgtcgtggtgttcctgatcccaagattaggatttatgatgtgggaatgaaaaagaagggtgtggatgagttccctttctgtgttcacttggtctcttgggagaaggaaaatgtctctagtgaagctctggaagctgctcgtattgcttgcaacaagtatatggccaagtatgctgggaaggatgccttccacctgcgagtccgtgttcacccattccatgtcttgcgtatcaacaaaatgctttcatgtgctggagctgataggctccaaactggtatgcgaggtgcttttggcaagcctcagggaacatgtgctagagtagccattggtcaggtcctcctttcagtttcgtgcaaggacagcaacagtcatcatgctcaag

SEQ ID NO: 5075 - DNA, 380 bp, Gossypium hirsutum
  Clone ID: uC-gsronu33B164h07b2
ttccacgcgtccgggcagatggtgtgctatttgggtttccaactagatttgggatgatggctgcacagtttaaagcattcatggatgcaactggtggtctatggagaacacaagcccttgctggtaaacctgctggcattttctacagcactggctcccaaggtggtggacaagaaactactcccttaactgcaatcactcaactggttcaccatggaatgctatttgtgcccattgggtacacttttggtgctggtatgtttgagatggagaaagtgaaaggtggaagcccttatggtgctggaacatttgctggggatggttcaagacagccctctgagctagagttagggcaagctttccaccaaggcaagtatttt

SEQ ID NO: 5076 - DNA, 86 bp, Gossypium hirsutum
  Clone ID: uC-gsronu33B164h08b2
ttctattgttttcatattccaaacttcatgtcatgatttgttaatggtaaaccttttcctttaggaataatataaggtttgcatgt

SEQ ID NO: 5077 - DNA, 394 bp, Gossypium hirsutum
  unsure (1)..(394): unsure at all n locations
  Clone ID: uC-gsronu33B164h10b2
tcgttttgcagcaaagagtgtagacaagaacagatggagatcgatgaagccagagaaaagaaattgaaatctggccgatctcttagaaaatcggattcaaagagctctacaccaaacaaaactgttcggacgggcattgttacggtgtcgtaattacatctttgcttcttctttttttttctttttatatatgataattgtatcatcatcaattttgaaaaaaaaaacgaaaaaacaagatcgggacaagaagggaaaaagaaaaaggaaaccttcaatggaattttgtattttcgttttattattgggtatgatgtttgagaggagtggatgtttataaggggggggggaatcnggatgtgcanntttnattaatggaaaatgtgcaaagatt

SEQ ID NO: 5078 - DNA, 369 bp, Gossypium hirsutum
  Clone ID: uC-gsronu33B164h12b2
ttgtctcgtgggattcatcatgatcaagcctgatggcgtccagaggggtttggttggtgaaatcattggcagatttgagaagaaaggtttctatttgaagggtttgaaactcatcaccgtggatcaatcttttgctgagaagcactatgcagacctctctgcaaaacccttctttaatgggctcgtagagtacattatctctggtcctgttgttgctatgatttgggagggtaagaatgttgtcaccactggtcgcaagattattggagccacaaaccctgctgagtctgctcctggaacaatccgtggtgactttgcaattgacattggcaggaatgtgattcacggaagtgattccgttgagagtgc

SEQ ID NO: 5079 - DNA, 569 bp, Gossypium hirsutum
  Clone ID: uC-gsronu33B166a01b2
cccacgtttattgtattttgttgaaaagattattaaagccaaacttgtcatgaactttgctataattatgcaaggggcaagcattctgtatgaaggtggtgaagatcttgaagaggatatggtagtgatttatgctgcagaccttgagaaagcattatctgagcttacttctccaggtactagcggtagtgtgcataccgaagaggatctgctacaggagttctcatgcagtatcaatatcaagcatagggaagactttgacgaagagaaggaacctgatggaatgcttctctccggatgggtagaagctcctgttgatacggacaataataagcctattggaaatgacgaaagtacatccaatgctttgccatcaatggaaactctggacggtgccaaggatgatgatattcaggatacttcggaagtggctgaagcttttgcagggaagaaaagataattgtctgaggattctagagtcacagctgcagatccttcaagcccttctagtctgaaacaaaatatacccgaaaagctcgatttgatgatgaggacgatgaactattata

SEQ ID NO: 5080 - DNA, 560 bp, Gossypium hirsutum
  unsure (1)..(560): unsure at all n locations
  Clone ID: uC-gsronu33B166a04b2
gggaaagtatattttgcgtaatgggtgaagaagtgaaggtttttggatactggtcaagcccttacagctacagggcagagcttgctttgaagttgaaaggtgtttcttatgagtacataaatgaggatatctttggcaacaagagcgatttgcttttgaaatacaatccggttcataagaaagtcccggttcttcttcacaacgggaaaccaattgtagagtctcttgttatacttgaatacattgaggaaactnggaaggcataattccctattggccacaggatcctattgacaaagttaccgctcgattctggatcaagttaatcgacaaaaagggttttctaccctttggctagctgcatggagcgccgagaatgagcgagaaaaagtgacgaatgaagcttgcgagtatctgaaaacgctngaaagtgcgcttaatggaaagaaattctttggtggagaaaccattggaatggtagatattgttgctagctcttgtgggtatttcattaaggtcactcaagatattatggggcaaaatctgcttgcagctgacaa

SEQ ID NO: 5081 - DNA, 514 bp, Gossypium hirsutum
  Clone ID: uC-gsronu33B166a05b2
attcctttttgtttggacaaacacctgttgcagccatcctttatatcttgaatctgagcttatttcggagaatcatcttggggtgaggaatgctgcccaaaggaagcttttggatgagctcggtattcctcctgaagatgttcctgttgatcagttcgtcccactgagccgcatgctgtacaaggcaccttctgacggcaagtggggcgagcatgaacttgattacctcctattcattgtccgagatgttaacgttcatccaaaccctgatgaggtagcagaggctaaatacgtgaaccgtgaccaactgaagggttactgcgtaaagctgatgctggtgaagatggttggaacctgtaaccatggttcagactcgccgtggataatttcttgttcaagtggtgggaccatgttgagaaagggacccttgaggaaagtagtgcatggaaaccattataagctgtgatttaagattttagaagccaaaaggacatgaaacaagagttgtcaatgg

SEQ ID NO: 5082 - DNA, 342 bp, Gossypium hirsutum
  Clone ID: uC-gsronu33B166a08b2
agttgcttttgagaaacatttgagaagaatggagaggaacagcaatattgagaaggcagaaaagttggtggaacatcaaatgttatcagctggttgctctacaaaaccatccaaccttgaagagtcttttagtaagtgtattgtgcagggttaaccagtccttgtcctagtccttttgtgaaattgttatcagttaagctgtttgccattattaactgttgaatactggatatatcacatcaatcttctaatttatttgaatggatagaaaggcaccagccaaccaagtatcccgtaaagagaggctggtgctgagtatgtcaaggagtacaccggtgtctg

SEQ ID NO: 5083 - DNA, 460 bp, Gossypium hirsutum
  Clone ID: uC-gsronu33B166a10b2
ttttcatttaaaagcatgcagtttcacgcttggtaggggcaccaccgggctatgttggttatgaagagggcggacaactcactgaagttgttcgtagaaggccctattctgtagttctttttgatgaaattgagaaagctcatcatgacgtattcaatattttgctacagctattggatgatggaaggataactgactctcagggaaggactgttagttttacaaattgtgtagtaataatgacttcaaatatcggctctcactacattttggaaactctccagtcaacatatgacagcaaggatgctgtttacaatgtgatgaaaaaacaggtggttgagttggcaagacagactttccgcccggagttcatgaaccggatcgatgagtatattgttttccagcctcttgactccaaagaaatcagtaaaatagttgagttacagatggtgcggttaaa

SEQ ID NO: 5084 - DNA, 124 bp, Gossypium hirsutum
  Clone ID: uC-gsronu33B166a11b2
cctacgtttccgcccacgcgtccgcccacgcgtccgcccacgcgtccgaagaatagaagactaggttcggccatcttctaagcaaaaaaatcaagatcaagaactaaagaaatcgaatttaacc

SEQ ID NO: 5085 - DNA, 91 bp, Gossypium hirsutum
  Clone ID: uC-gsronu33B166b01b2
atccacttcttgttatgtagccaagcccaagaaaaaaggaacgaggggaagaatcgacaaggaatccataacaaaaaaaaaattgtgaatg

SEQ ID NO: 5086 - DNA, 512 bp, Gossypium hirsutum
  Clone ID: uC-gsronu33B166b03b2
cccacgtttccttccacgcgtccgcccacgcgtccggttggtggaactgaaaaatggggagacatataatggacatttggtcaattgcgacacttggatgaacatccatcttcgtgaagttatctgtacttcaaaggatggagacaggttttggagaatgcctgaatgctatatccgtggaaatacaatcaagtatcttcgagttcctgatgaggtaattgataaagttcaggaagaaacaaagagtcgtgcagataggaagcctcctggtgtaggccgtgggagaggcagggctcgagaagatggtcctggtggaaggcaaccaaaaggagctgggcgtgggctagatgacagtgctaggactacaagtggaggccgagggaggggtggttcaggtggaaaaaacactggaggcagaggtagtggccggtgtcggtgctgatgcaacactctactttgttttgggggggggtaacatgggctatttaagaagcaggtgcatctacagactg

SEQ ID NO: 5087 - DNA, 197 bp, Gossypium hirsutum
  Clone ID: uC-gsronu33B166b05b2
cccacgctacctttcacgcgtccgtgaaaataggtttctctttagatccaattaggtaccgtaccaaaatatcattggtaaaatgaaaatagtaagtattgtcctggtgaggaacgatgtgtgcttttgtatgttgtatgaaagagttagcttgcaaataaataaagacaagtgtgatgttttctagttcattactc

SEQ ID NO: 5088 - DNA, 404 bp, Gossypium hirsutum
  Clone ID: uC-gsronu33B166b06b2
gcgagggtcgccctcccacttgcctatactaatgtatttggtttgttttttttgttttttttttgccgaaaaaagaagcaaacagatccatgtagaaaaagcaaggactgccagcggagcacaaaagcctgataagcccaaactacccacactaacacaaggcgaggccgaccccaagccaacaaccaagaaaagggagaagccacaagggctgaaccaaagcgtagcacaccacagaaccaacacacggaacggaggcccttgggccatgcccaactaagggtgcacacgaatacactgcagcccacccgtggagagcggcagagtctaaagacaaaaagcaaaaccagcttacgaaatgcagagtcagctcaggcagatatcactgatggaacgaacatcac

SEQ ID NO: 5089 - DNA, 465 bp, Gossypium hirsutum
  unsure (1)..(465): unsure at all n locations
  Clone ID: uC-gsronu33B166b08b2
cgttttgttagggttccttccagcgactgccgatccaccatttcattaggtggtcagcgatgcacaggccacgaccagatttccccaacgatagcaccatgcgaggaaccaggtatgccatcttatttctttttttttttaaacatctagatctaatgttgttctaaaaaatgaaaccgaatataaaaaagaaacttaatatcatccgaccctcacccgtatctcaatatttctgagatattcggggtttcattggtgtcgttccaaacgtttctttcctttatgctaaagtcgtaaggaaatgagaagaaaaacaaacggataaacagacttgaagatcacctttctctttggttgctttgtattgcttgcgtatattttcgttcgtaaatgttcgtactcgattacaaagattaaaatctggctttatagccgaaaagaagaggaaaatanatangaataatc

SEQ ID NO: 5090 - DNA, 342 bp, Gossypium hirsutum
  Clone ID: uC-gsronu33B166b11b2
gataaatcacctactctctcactttgctctcttcttgttgctgtactctttcaccaaactatcgcctgcaacctctacaaaagaatggcatatgaagggatgctgatgacgatgggtgtcctgtcttgacatgacgtagtcgtgtccgaagagatcttgacaaaatgtgatgtcaagttgaccattgcaattttagctgaggagagacgcctgccattgtataagaaatggcatccaagcccaatgcagagaatattgctggaggtgctactcaaaattcaatcaaagttgcacagtggatgctacaaattcctgtggcaactgcttacattggctgaattg

SEQ ID NO: 5091 - DNA, 313 bp, Gossypium hirsutum
  Clone ID: uC-gsronu33B166b12b2
cttacgtttccgctttatccttgtttactgcactgctggtatctctggaggacacatcaacccagcagtgacctttgggcttttcttggctaggaaggtgtccttagttcgagccatattttatatggctgctcaatgtttgggagccatatgtggatgtgggctagtgaaggcattccaaaagtcatattacaacaagtatggaggaggagccaacagcctcgctgatggatacagcactggaactggttttgcagctgaaatcattggtacctttggtcttggctacactggtttctctgcaactgatccc

SEQ ID NO: 5092 - DNA, 75 bp, Gossypium hirsutum
  Clone ID: uC-gsronu33B166c01b2
aaaaaattaatttaaaaaaaaaaaaaaaaaaaaaaaaaaaaaaaaaaaaaaaaaaaaacctagttctagtcgcga

SEQ ID NO: 5093 - DNA, 483 bp, Gossypium hirsutum
  Clone ID: uC-gsronu33B166c04b2
atcttgttatatcgctaaccatgactgtctcggtagctaacggccgtgtcctcatagtcggagcaaccggctttattggtcggttcgtggctgacgccagcttggatgctggtcgacccacttatgttctggtcaggccaagttccggaaaccaatattccaaggacaaagtagccaaagcccttcgggacagaggcgccatactgttgaatggattggcaaatgacaaggagttaatggtgaaactgctgaaagagcaccagattgagatagtaatatcagctctgggtggcgccacaatactagatcagctgtctttggttgaggcaattcactctgccggcacagttaagaggttcttgccgtcggagtttggacacgatgtggaccgagctgatccagtagagcctgtgctcaccatgtacaaggaaaagcgtcaggtcaggcgtctgattgaaaagctggagatcccttacacctaca

SEQ ID NO: 5094 - DNA, 396 bp, Gossypium hirsutum
  Clone ID: uC-gsronu33B166c06b2
aaaaattttattttaaaaaaaaaaaaaaaaaaaaaaaaaaaaaaaaattaaataaaaaaaaaaattatataaaaaaaaaaaaaaaaaaaaaaaaaaaaaaaaaaaaaaataggggggggcccttttaaggttcccaggtttcctcccccttctttgccccccattattttttttttggggccccctatttcaatttttttgccccttttttaccaccctggtggttgggaaaccccttgcttttcccaattttattgcctttgggcctttcccctttttccccatttggattattaccaaagggccccccccttttgccttttccaacattttgcccaccttttttgccaattgggcccccccttttatgggccttttaggcccggcggttggggg

SEQ ID NO: 5095 - DNA, 84 bp, Gossypium hirsutum
  Clone ID: uC-gsronu33B166c08b2
caattttttgcttaatatgcttagtgtttgctctaaagtttgtagctgaaattagggcttcaataatatttgtggatttgccat

SEQ ID NO: 5096 - DNA, 531 bp, Gossypium hirsutum
  unsure (1)..(531): unsure at all n locations
  Clone ID: uC-gsronu33B166c10b2
gttcatgtggttttacatagtcgcgtactgtccagggatttacctactgaatttgctaattgggtttttgtctcctttggttgatcctgaactcgaaggttccgatggacctttgttgccaacaaaaggttcagacgagttcaagccgtttattcgtaggctacccgagtttaagttctggtactccatgaccaaggctttctgcatagcatttgtcatgactttcttctctgtattcgatgttcccgtcttttggcctatactactttgttattggatcgttctcttcgttcttacaatgaggcgtcaaataggacatatgatcaaatacaagtatatcccattcagcatcggaaaacagaaatattccggtaagaaaggttccgctagtagcagtggctctcgtggggattgaacctcggccagtttggattacgacatacgtgatcattgattttcatctttggagaagatgaatatatgctgattatggattctttnttcttttattntaaatatgcagtttatcac

SEQ ID NO: 5097 - DNA, 383 bp, Gossypium hirsutum
  Clone ID: uC-gsronu33B166c11b2
caggtaccggtcttgaagggtcgaccctagcgtcgcgtacggatgagtgtctctacgtccacaagcactggcaagagccagagtctgttacaagcgtgtcgatggataaatacaggctctgagtcatggttatttacgattgcatacaaaccccttcggcacacggtctcaagcagtgatgccatatcattatgtatgtttggcgtattataaactgcaaagcatatcaagagacctcctggaaatttgaaatgccagggtgcataaatgagaggatataaagtggctactgtggaaatctgaccgtgtgatgcactgcaaaagaatcaagaatcattgtagctagattggcttaaagcacaaagcaaacatgtacttagacc

SEQ ID NO: 5098 - DNA, 391 bp, Gossypium hirsutum
  Clone ID: uC-gsronu33B166c12b2
ctttcctttgcctgcgtctctctcttcatctctctgaacctaaaagtctttagcttttcgcttcgagagagaccatgttggtttaccaggatctcatctccggtgacgagcttctttctgactcattcccctacaaggaaatcgagaatgggatgctgtgggaagttgagggaaagtgggttgtgcaaggagctattgatgttgacattggtgccaatccttcagccgaagatgctgatgaggatgaaggtgttgatgaccaatctgtgaaggttgttgacattgttgacactttcaggcttcaggagcaaccccctttcgacaagaagcagtttgtcgtgttcatgaagaagttcatcaagaacttgacaccgaaactggatgcggaaaa

SEQ ID NO: 5099 - DNA, 555 bp, Gossypium hirsutum
  Clone ID: uC-gsronu33B166d04b2
gaactgtttactacggacattgagacaaagagattttaggagcaaagttttcgattgccgtgaagcaccggacatgacggttcaatgctacctagagagaattttccggtataccaaggccggaccgtcggtttatgttgtggcatatgtatatatcgatcggttttgtgaggcaaatcctgggtttcggattactgctcggaatgtgcataggcttctcattacgaccatgatggtggcttctaagtatgttgaagacatgaattataggaattcatactttgcacgagtgggtggattgacaacaaaagaattgaacaaattggaggttgaattattgttttggatgggttacaagttgcatgtaaatgtgagtgtgtttgagagttattgtagtcacttggagagggaagtgagcattggaggaggataccacattgaaaggaccataagatgtgctgaggaaatcaaatcaagacaaagagaagcccaaggatatacaataaattgctcgcattttgtataatctacatcttaaacccttgcaatagttgt

SEQ ID NO: 5100 - DNA, 535 bp, Gossypium hirsutum
  Clone ID: uC-gsronu33B166d06b2
gaaaaatgtgttattcgatctgtttaacattggccgctaccgctggtaataacataggcaaagttctacaaaagaagggcaccggtattctccctcctctctccttcaagttcaaggtgataagagcatatgctgttaataaatcatggctgattgggtttctgatcgatatatccggtgccttgttgatgctgagagctttatcgttggctccggtatctatcattcaaccagtttctggatgtggacttgccattctttcaatcttttcacacttctatctacaagaagtcatgaatgttattgactggttggggattacattagctggcattggcaccataggagttggtgctggtggagaggagcaagtggcttcttcagtatctattttacagttaccatggttggcattctttgccgcaatcttgtttgtactcctgaatgggtggctccgcatctgcatgcgtcagcggagagagcaagaactgatggagtatgaggttgttgaagagatcatatatggcttggaatc

SEQ ID NO: 5101 - DNA, 410 bp, Gossypium hirsutum
  Clone ID: uC-gsronu33B166d08b2
tttacgtttccgcccacgcgtccgcaaggatttttggtggcaaagaaacttctgcaaacacaaatagagtagttggaacttatggatatatgtcgcctgagtatgcactagacggccttttctcattcaaatcagatgtatttagcttcggtgttgtcgtaatagagatcatcagcgggaagaggaacaccggattttatcagcctgaacagtcattgagccttctaggttatgcatggcatatgtggaaaacaggcaaggcaatggatttactggaccaggcactgcgtgagagttgcaaagcagacgagctgctaaagtgtctaaacgtaggactgctgtgcgtacaagaagaccccggtgatcgtcccaccatgtcacaggtagttttcatgctcggcagcgagaat

SEQ ID NO: 5102 - DNA, 348 bp, Gossypium hirsutum
  Clone ID: uC-gsronu33B166d09b2
cctcacgtttccgcaccgttgtccagtgtgggacgtccatccttttctgttcagataaacaacgtaattgagttttgataagtttgacacccaaagcatggtgtagaagtgtatatatagagtgtcatgcacgtagacaaatgacatcacatgtgaataccacgatgttacctctcttaactacactaatttctgatctaagtttggatattcaaaaaaaaaaaaaaaaaaaaaaaaaaaaaaaaaaaaaaaaaaaaaaaaaaaaaaaaaaaaaaaaaaaaaaaaaaaaaaaaaaaaaggggggcagcctttaaagagaaaacatctttctacctcctcttttgaggg

SEQ ID NO: 5103 - DNA, 532 bp, Gossypium hirsutum
  unsure (1)..(532): unsure at all n locations
  Clone ID: uC-gsronu33B166d11b2
gtgttgttactcgaagggtgtttcgttaaatatgataacacgactttcctgggggtggaggacaagacggtggtggtgaaaaaatgtgggccgtcgatttcgtcttactcggaagcattgggtcggcgtgatgcggtgttgggttacttgggagcaagtgatggtacctacaagccgtttcgggtaagcggttcaggggatgtacaaggtgtagctcagtgtgtaggggatttgagtccgagcgagtgccaagattgcttatcagacgcgatcggaaggctcaaaaccgactgtggggctgccaaatggggtgacatgtacttagccaagtgctacgcgcggtactcagaaggtggagaccactcccacggccaaaaagatacaaataacaatgatgaagagattgacaagactctggcaattctaattggactcattgctgcagttgctttgatcatactctntttatcattcttatcaaaactgtgtgacaatggcaaaggtgctaaataaaacaatcaattcagggatc

SEQ ID NO: 5104 - DNA, 598 bp, Gossypium hirsutum
  Clone ID: uC-gsronu33B166d12b2
cttacgtttccgccggaatctgaaagacaagacacagagaaaaagagagagagagagagagatgtcgggaggaatagcgcgtggtcgactcgccgaggaacgtaaggcatggaggaagaaccatccccatggttttgttgcgaaaccagagacgttgcctgatggaacggtcaatttgatggtgtggcattgcacgatccctggtaaagcaggaactgattgggagggtggctacttcccgctcacgctccatttcagtgaagattatcccagcaagcctccaaagtgtaaatttccccagggctttttccacccaaatgtttatccatctggtactgtttgcctttcaatcctaaatgaggatagtggttggagaccagccataactgtgaagcagattcttattggaatccaagatcttctggatgctccaaaccctgctgatcctgctcaaactgaagggtatcacctcttcatccaggatgctaatgaatataagagaagggttcgccagcaagccaagcagtacccacctctggtctagtctggtgctattaaaaaatagtaactaagactttccatgaaattgctggtaaat

SEQ ID NO: 5105 - DNA, 540 bp, Gossypium hirsutum
  Clone ID: uC-gsronu33B166e01b2
cccacgtttcctcccacgcgtccgcccacgcgtccgtttagtttcaatatcaaagcaaaaatggcttcttcttgtaatgttgtttcaatggctttactggcttgtttggtgttgaactccttggtttttgttgcccatggtggtgacttttaccaggatttcgacctaacatggggtgacaaaagaggcaagattttcaatggtggcaagctcttgtctttgtctttagacagggtttcagggtctggttttaaatccaagaaagagtatttgtttggaaggattgatatgcaactcaagcttgttgctggcaactcagctggcactgtcactgcttattatctgtcatctcaagggccaacccatgatgagatagactttgaattcttagggaatctgagtggtgacccttacattttacacaccaatgtcttcacacaaggcaaaggcaacagagaacaacagttttatctttggtttgaccctacaagaaacttccacacctattccatcatttgaaacccaacacatcattttctt

SEQ ID NO: 5106 - DNA, 303 bp, Gossypium hirsutum
  Clone ID: uC-gsronu33B166e03b2
cgccacgtctgctttacgggctctgggatgggtgacatacccggactcttgttatggacagaatccggtatgctgtcgaggataaccaaatcaatatcaatggcggtggggaacccgacaggagactttacgtgcctgttatccatggagctgataagaaaggaaagctcacaattgctaaggagatcaagaataggtcacatctagataaagagaacagccaataacgaacaaatatcgagggaggaacattaacaggggctcactctgaaggagccttatgtgaacaggattattaaggca

SEQ ID NO: 5107 - DNA, 567 bp, Gossypium hirsutum
  Clone ID: uC-gsronu33B166e04b2
ctttctttcacttcaaacacactctcagtatgtctgctttaagatccaccatttcttctgggataatcagatcaacttcacccacccattccttgttgcctgcagcttcatctttcaagcccatcaaaaacccttgtttacctcaaacccacaagcttttcacatcaaactccaacactttctcagctcccaagcgaggtttcacttgcaaaagccaggctattccatctgataactcagctccggaaaaagttcaagaactacatgtgtatgagttgaatgagagagatcgtgggagtccagcttaccttcgtttgagtcagaaatctgtgaactcactgggtgatcttgtcccttttagcaacaaaatatataggggagatttggagaaacggatcggaataacatcaggaatatgcatattaatagagcataaacccgaaatgaaaggtgatcgctacgaggccatcttcagcttttacttcggagactacggtcacatagcggtgcagggaccttacttgacttaccaggacacgtatctggctattactggtgggtctggca

SEQ ID NO: 5108 - DNA, 447 bp, Gossypium hirsutum
  Clone ID: uC-gsronu33B166e05b2
cggacgtttgttaacgtcaccattctaaagaggtcatcgtaaattcgagtacaaagcgctaaccgagatgagagccaagtggaagaagaagcgtatgaggaggctgaagaggaagcgccgaaagatgagacagagatccaagtagatgcgccttggactgaattagttttgccctgacaatcccttgtcttcataattatcctgcatatgttgcatgaagttgtgaagattgaagggtattttcaggcaaccttatctgttttgtcttctatatctcggttaaagttttaagactgtttgagatgtttgtctagtactattagatattatgttggggatttgcggtttgatctgtgtaagcagttatcttaacatcctaaatgtttgaaattgaaactttcgttcttcttatatggtctataatatgcgagatagattgtttcctta

SEQ ID NO: 5109 - DNA, 278 bp, Gossypium hirsutum
  Clone ID: uC-gsronu33B166e06b2
cccacgcttcctgtcaaaaaaaaaaaaaaaaaaaaaaaaaaaaaaatttaattaaaagggttgcgggggtggcggcttctaggttccctccgcttgcctgcggggtggtacgtccttttttgtgtcttgtggctccccttcactggcctctggtctccaatttttacactgggaactcggggaagccccccgttttccttgcttttcagctttttgccctttccccttttggcgtcttgggtatttggcccgatgcgcccgccctttccatcttttgc

SEQ ID NO: 5110 - DNA, 535 bp, Gossypium hirsutum
  Clone ID: uC-gsronu33B166e07b2
gtttcttggtcagggatctgcaccaagagagtggttgtggatgcaaggcatcacatgctaggaaggttggcttccattttggccaaggagttgttgaatggccaaaaagtagtggttgttcgatgcgaagagatttgtatgtcgggtggtttagtgaggcagaagatgaagtacatgaggttcttgaggaagcggatgaacactaagccttctcatggccccattcattttcgtgctcctgctaagatcctctggcgtaccattcgtggcatgattccccacaagaccaagcgtggggcagctgctcttgctcgattgaaggcttatgaggggattccagctccttatgataagacaaagaggatggttattcctgatgctctcaaggttttgaggcttcagaaaggacacaagtactgcttgttgggcaagcttttctctgaggttggatggaaccattatgacaccatcaaggagcttgagaggaagaggaggaaagagctcaagtggcatatgagagaagaagcaactcact

SEQ ID NO: 5111 - DNA, 450 bp, Gossypium hirsutum
  unsure (1)..(450): unsure at all n locations
  Clone ID: uC-gsronu33B166e10b2
ggcttcttatgaaaatgcttggaggctcctggctgaggtttctctctctgatgagaggttccgggaagtgaatgcactcatctttgaagtcattgccagtggcgaagatggcattgaacatgatgctaagagtctgcctaaggagcccgatcctaaagctgaatccactgaagaagaaagcaccatcaccaaaacctcccaccgcgctatggtgggtgggacacaagaatgcgttgttctgcagtaggaactggcattccacaaacagaaccatgtttcatccatgttatagtttctactaagcccgtttggcatgtatgattgtgtatggcagtggtagcctaaataaagcatacatagtttgcggtggtgtaagtttatcattaaccttggactngttgatttgatgatgtattatgattggatgatgtaaaataccaaataatgttt

SEQ ID NO: 5112 - DNA, 522 bp, Gossypium hirsutum
  unsure (1)..(522): unsure at all n locations
  Clone ID: uC-gsronu33B166e11b2
cccacgcttccgatttttattccgctattttctctctccccaaacacccttttaagccaaaaagaagacaatggccgatcagctcaccgatgatcagatctctgagttcaaggaggcctttagcctattcgacaaggacggcgatggctgcattactaccaaggagctcgggactgtgatgcgatcacttgggcagaaccctactgaggcagaacttcaagatatgattaatgaagttgatgctgatggaaatgggaccatcgattttcctgaattccttaacctgatggcgaggaagatgaaggatactgattctgaggaggaacttaaagaggctttcagggtttttgacaaggatcagaatggtttcatatcagctgctgagctgcgccatgtcatgacaaatctcggtgagaagcttacagatgaggaggttgatgaaatgatccgtgaagccgatgtngatggtgacgggcagatcaactatgaggagtttgttaagtcatgatggcccaagtactt

SEQ ID NO: 5113 - DNA, 587 bp, Gossypium hirsutum
  Clone ID: uC-gsronu33B166f02b2
gtcgatttacgaatccctaaatccaagccccctcccccttcaccaccggcagcagaaatgaagtacaacccacgtgtctcctcctctcgccgtaagagccgcaaggcccatttcacggcaccttcgtccgtccgccgtgttttgatgagcgctccactctcgaccgatctgaggtccaaatacaacgtccggtccatgcctgttcgcaaggacgacgaggtccaagtcgttcgcggtacctacaaaggccgcgaagggaaagtcgtgcaagtgtaccgacgcaaatgggtgatccacattgagcgtatcacgcgggagaaagtgaacgggtcgaccgtcaacgtcggtatcaacccatcgaaggtcgtcatcaccaagctgagactcgacaaagatcggaagtcgttgctggatcgtaaggctaaaggacgcgctgcggctgataaggataagggtactaagttttcggctgaggatatcatgcagagtgtcgattagggtatctcatgcagagtgtcgattaggttatcccctttttttatattaatcaaatgtttttgtatgtatcaatagggattgctgttttg

SEQ ID NO: 5114 - DNA, 307 bp, Gossypium hirsutum
  Clone ID: uC-gsronu33B166f03b2
cccacttgtactctgactcgtgggcagacgacgagaaggggatgtattacttgacactataattcactgttgctaatcatgggatcattatcaactgttagcaccaatgtcatgcaagctatcataagatgctgctgaagatataaagagggtggaatgctgccgaagaataagcagtgaactagctagcagcatatattgcagacattaaactagcagcagcaggcttaaatatgtgagcagatacctcgcttgactgttgaacacggtcttgttcatgggaaacacggatatggaaacacatatc

SEQ ID NO: 5115 - DNA, 506 bp, Gossypium hirsutum
  unsure (1)..(506): unsure at all n locations
  Clone ID: uC-gsronu33B166f04b2
cccacgtttccggaacaaaaaaggctcctgtgtattctttcggttatgatttagccctgttagccttgagtatcacttctcattatgaacaaccaatatggtgaagatggagatgaagccactgttatggggtttgaagtgccgagatcacctgattcaagttataataatgtgtaccccgtatatgaagacgatgcacgtgacccgcctgttgtccctcctcacctacatcgtaccatgcttagctgccctgcaagcataaatgcttccgggagtcttcctttacccggcaatgtgattttaaaccatctttacattgaaaaccgagaggcaccaagatcggtagtggcacttggattcactcaacgattccgttcgaagtatgttaccgtcatactatacaaaccggttccaagaagagggagtactggtacttaaaacatacgggaacccggtacagtgctccctgtcnggtcacttcggttggccgagtgatgaattagttt

SEQ ID NO: 5116 - DNA, 502 bp, Gossypium hirsutum
  unsure (1)..(502): unsure at all n locations
  Clone ID: uC-gsronu33B166f05b2
gctgagttatccttgagaagcgtgagatttatgatcagtatggtgaggacgcccttaaagaagggatgggcagcggtggcggtggccatgaccctttcgatatcttccagtcattctttggtggcaatccttttggtgctggtggaagcagccgaggcagaagacaaagaaagggggaggatgtaatccatcccctcaaggtatcattggaagatctctacaatggaacatcgaaaaagctttctctttcacgaaacgtaatatgctccaagtgcaagggcaaagggtctaaatcaggtgcatcaatgaaatgtaccggttgtcaaggttcaggaatgaaagtctccattcggcacctcggtccttccatgatccaacaaatgcagcatccttgcaatgagtgcaagggtactggtgaaaccatcaacgataaggatcgttgcccacaatgcanaggtgataaggttgtgcacgagaagaaagtcttggaggttattggtga

SEQ ID NO: 5117 - DNA, 74 bp, Gossypium hirsutum
  Clone ID: uC-gsronu33B166f06b2
gaaaacttacgttgacctctataattttattgagaaatcattaaagaaattctgctaaaaagttcatgcttttc

SEQ ID NO: 5118 - DNA, 165 bp, Gossypium hirsutum
  Clone ID: uC-gsronu33B166f08b2
tttttatatttttctttataaattaaaataaaaaatgatggtttatttttaaaattttttttgttttaaattacataagggtcgggggttgtggggtttctgggctcccggtcctctcgcttcctgcgtgctaccttgtctcttttttttgctgttctcgtttcc

SEQ ID NO: 5119 - DNA, 362 bp, Gossypium hirsutum
  Clone ID: uC-gsronu33B166f09b2
ttcccatataactggcagagcagtgttcacccctggatctatgagtagattttaaattaagctgttgcagatcatggcatccttgtgtttgcttcttgttagtgaactttttttatgaactttttactgaattacctctagttactgtttaagatgtttgtttgatgccattatttttgctcactaaattaatcaagttctgaaaaaaaaaaaaaaaaaaacaaacaaaaaaaaaaaaaaatagataaaaaaaaaaaaaaaaaaaaaaaaaaagaataccaaaaaaaaaaatctatttttaaaatcactatccttgttgaacattaaatatattataaaatctcgggggggcccttctttgg

SEQ ID NO: 5120 - DNA, 265 bp, Gossypium hirsutum
  Clone ID: uC-gsronu33B166f10b2
gagctggttaacaaggtttcacgattagaagaggataatctaaagctcaaaagagagaaggaatttgatacaaaatctcagtgtgaaacatctgaaacaaggtatcagcttagaagaacaagttccgcctctttttaactcgtgttttccgctgttttaagctctctagttggcttgttgacagagcttcgttgtgaattcgttccaagggtttggcattctgtacatttatgattatcatgtgttggtttttaccttcctctgc

SEQ ID NO: 5121 - DNA, 512 bp, Gossypium hirsutum
  Clone ID: uC-gsronu33B166f12b2
gcgattctcagttagtcttttctttaagcttacagcttctctccagagttttataatgggtaaggagaaggttcacatcaaccttgttgtcattggccatgtcgactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaaccactggtggttttgaagctggtatctctaaagatggtcagactcgtgagcatgctttgcttgcttttaccctcggtgttaggcagatgatttgctgctgca

SEQ ID NO: 5122 - DNA, 465 bp, Gossypium hirsutum
  Clone ID: uC-gsronu33B166g03b2
cccacttttcttttcttattctcttgttattctcaattcttacacttgaacagcaaaagaaatcactttcactttcagttcagttctactgaggtttccatctctgaggacatggagagtcagagaggtcctcttcttagctgggtttacttctgtcaaggaaagacaatggaagagcttaggtattctcttttctatacgactatggagctggaacagacaaggatggcagttcaggaagagctaagaaagagagatgatcaattaattcaactcaaggagttgctaagcaaggcaataagagagagggatgaagcacaggagaaatgccaaagactttttcttgagaaactcctgcttcatcaactgcagcagcaacaacaaaaacagcaagtttctcctctctctggagtttctggcgttgaggatgaacgcataaaaggaatagactccaacaatggcttc

SEQ ID NO: 5123 - DNA, 573 bp, Gossypium hirsutum
  Clone ID: uC-gsronu33B166g08b2
cttactgtgtccgcccacgcgtccgctcaactattggcaaaaggactcaatcgttaagattttctcttcgagatacttaaacaaaatggccgtgaaaccaacagtagctttgagggcttttcttgtaggaggggtagctgtttttgcaaaagtagcaggtgcaatgaaggctgctggtggtgctaaactgggtgcagccgcagctgctatgactgtagcggcttctgctgcaatgacgggatcgaagcaggagcaaaaagatggatctaagcaaccttcaaaatgatcttccttttctttcgttctttctttcagcaccttgtaggcatttttaatgtaggtggcgtagtcagttgctcatgggagcttgtctagagaagatggctatgtttggaattctattttggtcatcacagagtttttttttttttaaatgacttgaaataggataaacctacacttttgatctgaattaaacttaaagaagattgcattattgccattcaaattcagatgtgaacgttctgtgtatacaatattagatccaatcgcataagatacagcttttggttc

SEQ ID NO: 5124 - DNA, 516 bp, Gossypium hirsutum
  Clone ID: uC-gsronu33B166g09b2
gttcatattcaatgtagccaactctggtgtatttcatccacgatgaatcccttcaaaaccttgccaaccctttctttcctcttcttaacccttttcagcttagcccatgcagccacatttgatataagaaacaactgcccttacaccgtttgggctgccgcatctccgggtggtggcaagagacttgaccaaggtcaagcatggcaaatcactgcagcctctggaaccacacaagcccgaatttgggctcgaaccaaatgcaatttcgatgcctccgggaaaggctcatgcgagacaggcgactgcggcggagtcctcgaatgcaagggatacggtaaagctcccaacacactagccgaatacgcaatcgaccaatttgagcaccaagacttcattgacatctccaacatcgatggctttaatgttcctatggagtttagctccaactccccagggtgcactagggttatcaagtgtacggccgacattgtcggacaatgcccgaaccaggtgaag

SEQ ID NO: 5125 - DNA, 596 bp, Gossypium hirsutum
  Clone ID: uC-gsronu33B166g10b2
ccttgttcaagggtgaggagtgggctttgtgtttggccaggcttgaggcaactttgcataagaaagggtctcgagtatggcttgcgcttattatcgatgcccctcaaaaccttgcgcggggcaagtcgttctcttagggtcgcggagttttgtagtgtcaccaacgtgtcttcctcattgcaaattgaattggtaccatgtcttagagacaactatgcatatcttttacacgacgtggacacaggcacggttggagtcgttgatccttcaatagctatgcccattatcgatgctttgagtcggaaaaaccggaacttgaattatattgaatacccatcaccatcacgatcatactggtgggaatgcagagctgaaagcaaggtatggagcaaaggttattggttcgggaatagacaaggataggattcctggaattgatattgttctaaatgatggggacaagtggattttgcgggtcatgaggtgcatgtcattgaaactcctggtcatacccgaggccatatcagcttctattttccaagtctgcagcaatatttaccggggacacattgttcagcttatcatgtggcaagctt

SEQ ID NO: 5126 - DNA, 575 bp, Gossypium hirsutum
  Clone ID: uC-gsronu33B166g11b2
cctacgcttccgttgggaaatatgagatggggagattgcttgggaaaggcactttcgccaaagtctactacgcgaaggaattaaaatcgggtgaaagcgtggcgataaaggtcatcaacaaagctgaggtaaagaaagaaggcatgatggagcagatcaagagggaaatctctgtgacgcgtcttgttcgtcatccaaacgtagtggaactcaaagaagtcatggcgaccaaaactaagatcttctttgttatggagtatgtccgtggcggtgaactattcgccaaagttttcaaaggcaaactcaaagaagaggctgctcgtaagtacttccaacaactgataagcgcagtcgatttctgccatagcagaggtgtttcgcaccgggatttgaagcccgagaaccttctattggacgagaatgaagatctgaagatctctgatttcgggttgtcggccttgcccgagcagcttcgcaatgatgggctcctccatactcagtgtgggactcccgcatatgttgcccctgaggttttgaggaacaaaggctacgatggatccaaagctgatatctgg

SEQ ID NO: 5127 - DNA, 76 bp, Gossypium hirsutum
  Clone ID: uC-gsronu33B166g12b2
atttaatttaaaaaaaaaaaaaaaaaaaaaaaaaaaaaaagggcggacgatataaaaggaaaccaaagctaacaaa

SEQ ID NO: 5128 - DNA, 320 bp, Gossypium hirsutum
  Clone ID: uC-gsronu33B166h01b2
cccacgtttcctttctgccatggtgtctctgagcttgaagaatcctcaggatatatggagccttgtagaaaattcaagagttttcctcgaggctttgagattatttttcttgaagagagaaaaaggatataagaaaccttacttttgataaagatgatcagatggctgtggaatttgtgactggtggtgcaaatattcgggcttcttcttttgggaatcctttacatagtctttttgaagctaaaggaattgctggtaatattgtgcatgctggtgctacaacaaatgctatcataactggattgatcgcgattgaagca

SEQ ID NO: 5129 - DNA, 523 bp, Gossypium hirsutum
  Clone ID: uC-gsronu33B166h06b2
cggacgcttgttagaaaagcagtttccgaatcttttacgactcgtaaaatagttgaattgactcatggcttccgccgttgcttccgttgcgaagaagaaaactgctggctctaagaagtctaaatcagctccttcacatcctccatttcttgagatgatttcagatgcaatcgtttcgttgaaagagaggacagggtcgagccaatatgcgatcgcgaaattcatcgaagagaagtataagcaattaccggcgaatttccgcaaagtcttacttgttcagacgaagaagtttgttgcttctggaaagcttgtcaaagtaaaagcctcttttaagctgccttcggcttctgccgcagctaagaaaccgaaaccgaaggctactacaactaaggccaaagctaaaccagcggctaagccaactaaggtagcgaagacggcgaagaagagttcgccagggaagaaagtaaaggatccagcaaagaagacagtcgctgtcaagaagcccaagagtgttaaatctccg

SEQ ID NO: 5130 - DNA, 84 bp, Gossypium hirsutum
  Clone ID: uC-gsronu33B166h07b2
acgttcctttgcccatatgctaaaaaggggggtgatgtactcatctgttaacaaatgaggtcagtgtaaatccgtaacccaatt

SEQ ID NO: 5131 - DNA, 542 bp, Gossypium hirsutum
  unsure (1)..(542): unsure at all n locations
  Clone ID: uC-gsronu33B166h09b2
ttcacgtttccgcaagatttcatttactggaagcacagtcacagcggttaagataatgacagctgctgctcaaagggtcaagcctgttaccttggagcttggtggcaaaggtccaatagttgtgtttgaggatgttgacattgataaggctgttgagtggaccatattcggttgcttttatacaaatggccagatctgcagtgcaacatcacgccttattgtgcatgaaagtattgcggcagaatttttggacaggcttgtgaaatggagtgagaacattaaaatttcagatcccttggaagaaggttgcaagcttggccccattgttagtagagggcagtatgagaaagtaatgaatttcatttcgaatgctaagagtgagggagcaactattttgtatggtgggaatcgtcctaagcatttaaagaaaggattctntgttgaaccaaccatcatcactgacgtaacaacctccatgcaaatatggagagaagaatttttggacctgttctttgtgtcatacatttaccaccaaagaagag

SEQ ID NO: 5132 - DNA, 302 bp, Gossypium hirsutum
  Clone ID: uC-gsronu33B166h10b2
cctacgctaccgtttggcagtgaaggcactgaaggattgcccttataaaacaatatggggtcattcaaccccagggatagaaaggagataaatgaagagccacgaggcagaagaccaatggcggagaaaccttaacaataaccgctggagaactaacaacagaggggtggacacgccgaataccagagaacgcgaaccaaaacccataaaggatagccctggttgatccaaaattagcaaaaccagtacataaaggtacacaaagaagcgaattacgaaaaagatcaatagctccttgaaaa

SEQ ID NO: 5133 - DNA, 500 bp, Gossypium hirsutum
  Clone ID: uC-gsronu33B166h11b2
cccacgcttccggtgtcatagatcaccttttttggctgatgatgataggcacatgggctgctgcactgaaataccaagaaggaaaggaaatggagagtaataaacaaattggtacttcttcctcattcactgctcacctatttggttccaaggaatcatcaccatcgtcaaaagggattttcagttccattttcccacctccatcaatggtgggtgggaggaactcttcaagctctcaggtgttagaatcatggccaaaacagcctttagaaggatcagactggagacatggaatgcaagttgcagagagtgcaacatataccaaagccaacagagacagtaattctgtttttcaggaagaaaggatggaaccattccatttaagttcatctctttactatggaggccgagacatatatggtcattcttcaagtacacaagcttctacatcatatcctattttcaagaaagatggagaagatgaccctaatggaagcaat

SEQ ID NO: 5134 - DNA, 574 bp, Gossypium hirsutum
  unsure (1)..(574): unsure at all n locations
  Clone ID: uC-gsronu33B166h12b2
cccacgcttccggtgtcatagatcaccttttttggctgatgatgataggcacatgggctgctgcactgaaataccaagaaggaaaggaaatggagagtaataaacaaattggtacttcttcctcattcactgctcacctatttggttccaaggaatcatcaccatcgtcaaaagggattttcagttccattttcccacctccatcaatggtgggtgggaggaactcttcaagctctcaggtgttagaatcatggccaaaacagcctttagaaggatcagactggagacatggaatgcaagttgcagagagtgcaacatataccaaagccaacagagacagtaattctgtttttcaggaagaaaggatggaaccattccatttaagttcatctctttactatggaggccgagacatatatggtcattcttcaagtacacaagcttctacatcatatcctattttcaagaaagatggagaagatgaccctaatggaagcaattcacatgatgcttctacaggaaactgggtggangggttcggatattattagagctatatagccttctaatgcat

SEQ ID NO: 5135 - DNA, 467 bp, Gossypium hirsutum
  Clone ID: uC-gsronu33B167a01b1
gcatttgtttggtccttgccatcaatgagatatttgagaagaaccctaccaagattaagaattatggtatatggctccgctaccaaagccgtaccggttatcataacatgtacaaggaataccgtgacactactctaaacggagctgttgaacagatgtacactgagatggcttctcgccacagagtccggttcccatgtatccagattatcaagactgcaactatcccagccaagctatgcaagagagatagcaccaagcaattccacaactccaaaatcaagttcccattggtgttcaagaaggtaaggccgcctaccaggaagctgaagaccacttacaaggcatcaaagcctaacttgtttatgtaagttctctcattgcaatgaaaagagagttgatgtggtttatagttctaaaatttttggtagtgaacatctggcagtttgttgattgggtattgtttt

SEQ ID NO: 5136 - DNA, 470 bp, Gossypium hirsutum
  Clone ID: uC-gsronu33B167a03b1
cggtttcgtttgttaaaaaaaaagggctatgaactcagtgcaatggggatatgtccgtatcatcaccggcaccatttttggcggtatcgttggcttctacgttatgcaccgcgtcgaactcagctacaaggaaaagatgaaggagcgattgaggcaatatgagctcgaattgaaaagaaaagagaagctagatgaacttgaagattccatctagtctttcttttttccttgtttttttttaacagttaagcctccattttcctttttctttaagttgttttttagaatcagcatacaataagcaggatatatgtgaaatcatggtgattttggttgattagtgattggttctttattaagtgttgaattaaattgaaaaatactcaaaacagtacaaacgattgcgcccttccgacttttgaatgggttcttctctttttcaaagaatttatcagagttttttttggatt

SEQ ID NO: 5137 - DNA, 554 bp, Gossypium hirsutum
  unsure (1)..(554): unsure at all n locations
  Clone ID: uC-gsronu33B167a04b1
acaacatgaggccaatcggttgctttccacaaattctaactagttttccatcagctaaaaaggactccgtcggttgtgcaaagccgtataatcgattagctcaacgtttcaacgccgagttgaagaatgcattggctcgacttaggattgagtttcctttagctacaattgtttatgtagacctctactctgctctatactctttatacactcacccgaccaaaaatggatttgaacgtcctcttgttgcttgttgtggttatggaggtaagtacaactatggcagagatgcagcatgtggagaaacaattaatgttaatggaaaaaacattatggtgggatcatgtaaagacccatcagttcgagtgagttgggatggagttcatttcactgaagctgcaaataagtttgctttcgatcttgtgtcgtctaaaaatttctcaaatccacctattcctttgaaactggcatgccaccataggtaaacatcatctggngttntgttgggtgtttttttggtaaaaaagagatgaatatcataaccaaagaggaat

SEQ ID NO: 5138 - DNA, 555 bp, Gossypium hirsutum
  unsure (1)..(555): unsure at all n locations
  Clone ID: uC-gsronu33B167a06b1
ccctttcgttcggttctaggtactatcgagcacctgaattaatatttggtgcaactgaatacaccacagccattgacatttggtctgccggctgtgttttggctgagctattgcttgggcagcctctgtttcctggtgagagtggagtagaccagcttgttgaaattattaaggttctaggtaccccaacaagagaagaaatcaagtgcatgaatcctaactacacagagttcaaattcccccaaattaaagctcacccatggcacaagatatttcataagcgtatgcctctggaagctgtggatcttgtttcacggctattgcagtactctccaaatctgcgtagcacagctattgaggctttggttcatccattctttgatgagctacgtgatcctaacacccgcctacctaatggtcgatttcttcccccactgttcaactgtaagcctcacgaactgaagggagttcctacagatatgttaccgaagctgatccccgaacatgcacaanagcaatgttcctttcttgggatattatggatatataatcctt

SEQ ID NO: 5139 - DNA, 95 bp, Gossypium hirsutum
  Clone ID: uC-gsronu33B167a12b1
tataattaaaagtggaaggacaaagtcaagcagctaatacaggtaacgaaataatacttgtaataacataattggaaagctaaataattagaagg

SEQ ID NO: 5140 - DNA, 390 bp, Gossypium hirsutum
  Clone ID: uC-gsronu33B167b01b1
cttgcaaggcaccataccttgtatctcaaaggatggtagatatgtcatggagactccattcaaggtatggtttcttttgtgaatgtgcaagtcaataaaaaatcaagttctaattaaaaggtgatcaagtccttgaacagttctacttactgtataactgattcggattggatgttaacaaatactattataacattgcaacagcactatagggttgagaattcttgtaaagtaatgttgattgctgaaaggatagaggtacctgtctctaagttttaggatggaaaagttctgattctgttgcgtaaagcaacagtattgcttctacactattctctttgaagcagtaatacgtgaaggtttttatttggctgacaataatattctttt

SEQ ID NO: 5141 - DNA, 164 bp, Gossypium hirsutum
  Clone ID: uC-gsronu33B167b04b1
cccatgctttcgcccacgcgtccgctcggctctcgcatcgatgaagaacgtagcgaaatgcgatacttggtgtgaattgcagaatcccgtgaaccatcgagtctttgaacgcaagttgcgccccaagccattaggccgagggcacgtctgcctgggtgtcacgc

SEQ ID NO: 5142 - DNA, 496 bp, Gossypium hirsutum
  unsure (1)..(496): unsure at all n locations
  Clone ID: uC-gsronu33B167b05b1
cttcgtatttttggcccacggctgcacctaatgcagtaaagagccttgaggttgaagctaatcctagctctggaagtatcgtaaaaatcaactttgttgaaggccttccattccaatatatgaagcaccagatcggaggacatgatgaaagtaatttttcatacagttacgatttaatcgaaggtgggcctttgggggataagcttgaaaaaattagctatgagaacaggtttgaggcagctgcaggtggagggagtatttgcaagagctcaatgaaattctacactataggcgataatgttatcactgaagacgaaatcaaggctctcattaaagggagtgagggagtttacaagcctgttgaagcttacctcttggctaatcccgaagcctgcaactaggatataagttgcttaatttgaattcttatgcttgcttttaaagaggggtttgattntaatgttgtgcttttgatattttctttttcatcttaaaa

SEQ ID NO: 5143 - DNA, 419 bp, Gossypium hirsutum
  Clone ID: uC-gsronu33B167b06b1
gcttttgttctctcattcacctcagttctcaccgctcagattccttgtagtctccccgttcattctcatttcggtctcaccggtctgccttcctctttcagattcactaagtttttgcagatagtgattttgacctgttataagcagtcaaagggagttcagcggagaaacaagatgaaatcggttgtgggcattgttgtatcaaataagatgcacaaatcagtggtagtacgcggtggacaggctcttccacaacaagatttacaaccgctatgtcaagcgcacctccaagttcatggcccatgacgaaaaagatgaatgcaacatccgtgacagggttaaattagatgcttctacgcccgtgagcaagcgtaagcattgcgttgtggctgaaatctcaagaagctagaatcatacac

SEQ ID NO: 5144 - DNA, 537 bp, Gossypium hirsutum
  Clone ID: uC-gsronu33B167b07b1
tcccactcgtccggtttccccaaactcccttcaaatcctcgtctcaacaatttttttttaaagcctagtaaaatggcgtccacatttagcggtgatgaaactgctcctttcttcggcttcctcggagccgctgctgccctcgttttctcctgtatgggtgctgcgtacgggacggcgaagagcggtgtcggggtggcatcgatgggagtgatgaggccggagctggtgatgaaatcgatcgtgcccgttgttatggctggagttttaggtatttatgggttgattattgcggttattatcagcactgggattaacccaaaggccaaatcttactacctgttcgatggctatgctcatctttcctctggtctcgcttgtggcctcgccggtctctctgccggtatggccattggaatcgtcggcgatgctggagttagagccaatgcccaacaaccaaagctttttgttggaatgattcttattctcatttttgctgaggctttggctctctatggactcattgtcggtatcattctc

SEQ ID NO: 5145 - DNA, 263 bp, Gossypium hirsutum
  Clone ID: uC-gsronu33B167b10b1
ttgcgtttgtggcggagattatattgccggtggaactgctgctaatgttgctactgccaccaccgctgctgctactgctaccacaactaacgtatagttttttttttatttacgttttactgattttattcttttccttttcttcttttaatagctcttttatatatatgattatgaggtatatatctggtggttctctctgaatattggattgatatcccatgaaccaaatttagttgaaaatcgagttttcaatctcttgc

SEQ ID NO: 5146 - DNA, 104 bp, Gossypium hirsutum
  Clone ID: uC-gsronu33B167b11b1
tatcatgatgtttgagagggattgaaagagggttagaagagcttacatttatgttgcctcctattactgctcgaaactttataattaaattcatgttatttctg

SEQ ID NO: 5147 - DNA, 593 bp, Gossypium hirsutum
  Clone ID: uC-gsronu33B167b12b1
ttactttttccacaccccccccccccaatatggcgatttcggcgctccaaaaactcacctcccaaatccaccgtctcccatatctctcctcccaaatcctcacccgatcctccgccaccttaacctcctccccctcctcttccaaaaaaagttgctgatcggctcgtcaagctcttcgccatcgaccctgaaggccagaagcgtgaggttgtcggcctcgctggccagaccttacttcgtgccttgactaacagcggcctgatcgaccccgactctcaccgcctcgaggagatcgacgcttgctccgccgaatgcgaagtcaacattgcccaagagtggctcgagaagcttccgccgcgtacctatgatgaggagtatgtgttggtgaggaattcgaggggtcgcatcttgaacaagcattccaagcttggatgtcaggtcgtgcttacgcctcagctccaaggtatggtcgtcgccgtccccgaggctaagccgtgggatattccataaatatttgtaggggaaaaagagatgatgtgggaaccattagtgctttctgtgggttcctggaagaataataatttgtacctttg

SEQ ID NO: 5148 - DNA, 548 bp, Gossypium hirsutum
  Clone ID: uC-gsronu33B167c01b1
ctcatttttttgctttaagcacgacacttgcatctgcagacaacaatctctctgctgctgtagtgggatcccaaacgttaccacttcagaaagataaccaaccgaatcttccacacatatcagttggtcgggagaattggggagattccaatatggcagatggcagccctaggactgatacgtcaacagacgacactgaagagaagaatcaaaggtttggaagaggtcaaacaaatgctatcgtggcttccgattctagtgacagatcaaaagataaaacagaccagaagacattgcgtaggctagctcaaaatcgggaggctgcaagaaaaagccggttaaggaagaaggcgtatgtgcaacagctagagagtagccgactgaaactgactcaactcgagcaggaactgcagcgagctcgtcagcagggtatattcatttcaagcacgggagatcaatctcattcgatgagtggaaatggtgccttggcatttgacgttgaatattcacggtggttagaggagcacaataagcatatatatgagttg

SEQ ID NO: 5149 - DNA, 386 bp, Gossypium hirsutum
  Clone ID: uC-gsronu33B167c04b1
gatttttgtgttaagatggcccgtaccaagcagacagcccgtaagtcgactggtgggaaggctccaaggaagcaacttgctaccaaggctgcccgtaaatctgccccaaccaccggtggtgtgaagaagcctcatcgctaccgtcctggaactgttgctcttcgtgaaattcgaaagtaccaaaagagtactgagcttcttatcaggaaattgcctttccagaggcttgttcgtgaaattgcccaggacttcaagactgatttgcgttttcagagccatgctgttctagctctccaggaagctgcagaggcataccttgtgggtctttttgaagacaccaacctttgtgcgatccacgccaagcgtgtcacaattatgcccaaaga

SEQ ID NO: 5150 - DNA, 274 bp, Gossypium hirsutum
  Clone ID: uC-gsronu33B167c05b1
tttggtttttggagaaacaagcaaattgatgttggaggctgtgaatcagggtgatccttctcgtacatgcatgtaggctttaatgccttagcaaatgccatgcatgcggtactagattccttggtttgcttcactaattataattatatatgtgaagtgaagcaatttccgttgcttcacaaataattaagtatgaaaacccccttccccaatttgtaatgcaaatgatgaagtatatagctagtctctagctagcaactgagagcattcattc

SEQ ID NO: 5151 - DNA, 557 bp, Gossypium hirsutum
  unsure (1)..(557): unsure at all n locations
  Clone ID: uC-gsronu33B167c09b1
ttcttttctccctaatccccaatttcttaatttttacagaatatcaggtgttttaattcgcggagaggtagctatgtttaaagggatttttggaaaaaccaagccggaaacaaatgctctaaccactttagacaagttaaatgagacccttgaaatgctagagaaaaaggaaagtgtgcttctgaaaaagactgctgcagaggttgaaaaggccaaggagtatgccaaagggagaaataagaaagcggctatacagtgcttgaagaggaagaaactgtatgaacagcaaatcgaacagcttgggaactttcagcttcgtgttcacgatcaaatgataatgttagaaggtgccaaagccacaactgaaacggtggatgcattgagaactggagcaactgcgatgaatgcaatgcagaaagcaactagcatagatgatgtggacaaaacaatggatgagatcaacgaacataccgaaaacatgaaacagattcaggaagcactatcaactcctatncgagctgcngctgattttgatgaggatgaattggaagctgaac

SEQ ID NO: 5152 - DNA, 91 bp, Gossypium hirsutum
  Clone ID: uC-gsronu33B167c10b1
tcttccattcgtccgcccacgcgtccgggcagagtggccttgctgccacgatccactgagattcagccctttgtcgcttcgattcgtccct

SEQ ID NO: 5153 - DNA, 477 bp, Gossypium hirsutum
  Clone ID: uC-gsronu33B167d04b1
gtcttttctgtctctgccttttcatttcctttctctcaatcttacctccgttgattgctttttgccaatcggcgtgagatcttgctgatctgtcgccggaactttcatttagattccggcgatcgcatcgatcttttttttttcttttaatctttatgctacaatgaatcccgaatatgactacctgttcaagcttctgcttattggagattctggtgttggaaaatcttgtcttcttttgagatttgctgatgattcatatgtagaaagctacataagcaccattggggttgatttttgggatactgctggacaagaacggtttaagacaatcactagtagctactaccgtggtgcccatggcataataatcgtttatgatgtgacagaccaagaaaagcttaacaatgtcaagcagtggctgagtgaaattgatcgctatgctagtgataacgttaacaaactactggttgaaac

SEQ ID NO: 5154 - DNA, 368 bp, Gossypium hirsutum
  Clone ID: uC-gsronu33B167d06b1
cccatgcgttcgcccacgcgtccggcttaattgggttcatcttcttgtatgttttaaagtattacatgttggctctaagagctgggggatactggaagcagttgtaattatctatctatattatcccccaagaattcatactactccatgaatattttgaaagcaaaatatattatggttttgccaaaaaaaaaataataaaaaaaaaaaaataaataaattaaaaataaaataataaatatataaaaaataaataaaaaataaaaaaaaataaaaaaataaataaataaatataaaaaatattgggggggccctttttaaggagtccagcttttctccccggtgttggcaaagtttatttttttttt

SEQ ID NO: 5155 - DNA, 579 bp, Gossypium hirsutum
  Clone ID: uC-gsronu33B167d07b1
tttagtttcgtgtttgtctattgaattctttccttcactttctctagaaaaagaaaatgtcttcaggttgcaattgcggatctaactgcagctgcggtgacaactgctcatgcagcaggaaccttaaccttggatactcggagaagacaaccagcactcagaccatcatctccggagttgcgccagtaaagatgacctttgagggaccagagatgagcactactgaatcaggacatggatgcggctgtggatcaaactgcaaatgtaatccatgcaactgctgaaaagcttgatgaaagccatagattatgaaaaaagaaagcagcaaaataacaggcctctgtaatgatttattttcaaggatggatgcgtgcaaggtctataattatgtctctgtctgtcttgtgtaatagaagctttgtttgtggtaaaaataatgtataagcccattggttgggagcaaattttcccttttgccaaaggatttttgctgctcattcatggtgacttggttatggttttatctggtgttggtaaaatctataaaaatatatatcggtggctgcttttggtttgatt

SEQ ID NO: 5156 - DNA, 537 bp, Gossypium hirsutum
  Clone ID: uC-gsronu33B167d09b1
tgtttttcgtacgagaaagctcaaaaattccgcgttgctcccttaaatggcgctatttgtcacgctacggtcttggtgttccatttacaaaaatctccacatatgccgacagctgtgcaaaatatctatgtactcgtcttgattcaaacaggacgccccattattccggatctacgccagttcgacaccgctcaccgacgtgggttgtttcaaacgatgagacttatcggccttgctcatctcctcactagccaaaccgcgatcaaattgtgacgccttcattttcatgtagcgtctttttattttacttaggtaaacactggtccgaaggttcccgccagcttaatttcttcgtccgccaatcacctttcgagacggtttggaataaacataccgtccgtttttcatcccaagaagaacaaagctatttggcgggtgtttaatatacaccaccaatttttgtagaccgtaaaggagaagaagagggagatgtccttcaacaaatgaatgatgccttcaaggggaagcttttcaaat

SEQ ID NO: 5157 - DNA, 510 bp, Gossypium hirsutum
  Clone ID: uC-gsronu33B167d11b1
ttatttctcacgctctgtgcaacgcttgcttcaagagttgcctgctctgattacctattatcccttgctctgcttgtccaaacagctctcggcgctgaccctgctttccatttctggtccaactctgggactatctatggctatgatccttatgaagccaacttataggagctcactgtctacctgtacattcaagcccctcccaaagggttcggtctaggatccataggtcacaagcctaaccaagctgatggcctcgcactttgcagaggcaatgtgtctaccactgatcgtaaaacctgtgctgtgtaagcaggcaatgaaatacgataacgctgcccgtacaacataagtgctatcgtctgcgacgataactgtcttttcaagtattcaaacatggagtagcttggacagatggataatcctaacatgttctacaagtggaacttgcacaacgagagtgtacgccaggcgctcaatgccgagaccatagaacttgtgagcgagttg

SEQ ID NO: 5158 - DNA, 422 bp, Gossypium hirsutum
  Clone ID: uC-gsronu33B167e01b1
ggggtgaacagaaatggcgaagtcaaagaaccacactgcccacaaccaatcttacaaggctcacaagaatggcatcaagaaacccaagaggcaccgccacacttccaccaaagggatggatcccaagttcttgaggaaccagaggtatgcaaggaagcacaacaagaagagcggtgagtctgccactgaagaagagtaaatttttaatggcaaaagatctagctttgattagtgttttctaattgttgtttttcccccgatggaattgagtgttcgtttactataatcaccttagttgaaatgttattttgggattgttgaatctcattttcaaaagagatttgaagctgtgagcttattaatattaaaaacatgtttgagcttaaaaattaaaattaattttttttacaaatttaatatta

SEQ ID NO: 5159 - DNA, 264 bp, Gossypium hirsutum
  Clone ID: uC-gsronu33B167e03b1
ctttttggtgtgaatggtaatgatccaatttttgatgcttttggtggacaagggatgcatgttgcagctccattttcttcagatgttgcacctccgccagtattgatgccagttcctggtgctggtccattggggccctttgttccagcttcacctgaacttgcaatgcaagtgttcagagagcgaggtgctcctccttttgaaggcaatggttgaagtggacgttctggacactaatttaagtggacccaccccctttttttt

SEQ ID NO: 5160 - DNA, 602 bp, Gossypium hirsutum
  Clone ID: uC-gsronu33B167e06b1
cccatgcgttcgtgtgtagccaaacgcttccttactttgattctatcgtcgattcaaagcagctttcttatccatggcgtctatatttttggcactacccaaaaccttcacttcaaacaagcctaccttctcttctctttcaacccacaaacttcccgggactcgaagaaattcacttagaatcaatgctgtggccactaaatgggagcccaccaaggttgttcctcaagctgacagagttcttatccgtctccaagaattacccgagaaatcagctggtggagttttgttgcccatatcagctgtcaagtttgagaggtacctcatgggggagatagtttcggtcggtgcggaagtaggaaacgtggaaactggaaagaaggttcttttctcggatataaatgcttatgaggtggatttgggaacagatactaagcatgttgtttggaaagagagtgacttgttagctgaagttgattgaagttttcttctggtgtttgttctaagatgaagaatccaattgtattcagaaattagcggtttttaatgcaatataatgttctcagctgctgctcattatgttagaactaatgagatgatat

SEQ ID NO: 5161 - DNA, 466 bp, Gossypium hirsutum
  Clone ID: uC-gsronu33B167e08b1
ttttcatttccattattgtttcagatcgtaaaatcaaaaccaaattttcgtttaatttatacatataaacacccaaaaacaaaaagggcataaaaaaaggagattcaatggggatcttctccttcaatgccatagctttggccttcttattagccattatctctggcgccgtcaatgcttgcccttcttccgaccgagaagcattgctagctttaagttcatcgttaaaggagccttatttaggcatcttcgattcatggaaaggcaccgattgttgttccaactggtacggtattagctgtgaccccaccactcaccgagtcaccgacgtttccctacgcggtgagtccgaagaccccattcttcaaaaaaccggccacttatctttcggttacatgaccggtaccattaacccttctatttgtcagctcgaccgggtcactactttaatcattgctgattggaa

SEQ ID NO: 5162 - DNA, 509 bp, Gossypium hirsutum
  Clone ID: uC-gsronu33B167e09b1
ttttattctatacatataaacacccaaaaaaacaaaaagggcataaaaaaggagattcaatggggatcttctccttcaatgccatagctttggccttcttattagccattatctccggcgccgtcaatgcttgccctccttccgaccgagaagcattgctagctttaagttcatcgttaaaggagccttatctaggcatcttcgattcatggaaaggcaccgattgttgttccaactggtacggtattagctgtgaccccaccactcaccgagtcaccgacgtttccctccgcggcgagtccgaagaccccattcttcaaaaaaccggccactcatcttccggttacatgaccggtaccattaacccttctatttgtcagcttgaccggctcactactttaatcattgctgattggaaaggtatcgccggtgagatcccatcatgcttggcgtcgttgcccaacttgagagtcttggatctcatcggaaatccttatcgggaaaatccc

SEQ ID NO: 5163 - DNA, 416 bp, Gossypium hirsutum
  Clone ID: uC-gsronu33B167f02b1
ataaaacaaaaaaaaaaaaaaaaaaacggaaaaaattaataaaaaaaaaaaaaaaaaaaacatacaaaaaagaaaaagatgatgttggggttccttactgtctctttatctggttaatttgggggggggcggttttgggggtccctttttttgttcccctggttggcccgcttttgcttttttttgggggtccccaaattgtttttccggggcggggtttttccacctctgggtggggaaaaccctggggttcccccactttgttccctttgggaacatcccctttttccccgttggggtttatccgaaaggggccccccccgtcgccctttccaacatttgggcctctctattggggtgtgggacgccccctttttgggccctttaatgccggggggtgggggtgtgtccccccg

SEQ ID NO: 5164 - DNA, 420 bp, Gossypium hirsutum
  unsure (1)..(420): unsure at all n locations
  Clone ID: uC-gsronu33B167f03b1
gatttcgtcttggatgaagtaagggagcttctcaaagatgttgagttggggaatcaagagagcctgaaacaagggccgagcaaggtcatgtggttgtttgctagcggaactattttcttctcacttaccattgttattttggccttcacatggacaagcgatggctaacttctccagcataatattaccacggtgttgaggttctttactccgttacgacacaagaaaggcttcgtcttggacagtgttcgcatgggacgaggagagttttacagttacatgtgaaacttggttgtagcttttggttaaggaagtcaatgtttagctagacttgagcttacattatctngttctaagagctgttgccttcactttccatagatttatgaattttgctttcgtacctttttgttatgaatc

SEQ ID NO: 5165 - DNA, 623 bp, Gossypium hirsutum
  unsure (1)..(623): unsure at all n locations
  Clone ID: uC-gsronu33B167f04b1
cttttcttaattggtaattcattttttggctggaattgccttgcaccatggttttcgtaccctactcgtactgccattcggcgaaagtttaatcttgagggaagctgcgaggcactccataggtcatgtggatgttgtggaagctgcgtagaagatgagttgcaacgtgaacaatgtgaattaacctgtgacttagcaacccatgttttgtgccatccttgtgccgtttgtcaggaaggtcgcgagattcgtcgaaggttgcaccatccagggttcaatgctcaacctgtcttcaccatggtccctcctggcgagcataccatggctcgtggagcctaatttcatgctctgcccattccctaccttataactaaaggtaatctagtagctagctcaacaacatntttgtgtgtgattgatgtctatgttgtgaaaatatattgtgtgttgtggttatgttgtgaaaataaagtaaaaagcagctntattgtacaattctagaatgaaaagtgattgtctggtatggcagatcatatacattntgtgataaatatattatgtttaaaattttattgggccatttgaaggatggttctgtttggcgaaccagttgtataattgct

SEQ ID NO: 5166 - DNA, 585 bp, Gossypium hirsutum
  unsure (1)..(585): unsure at all n locations
  Clone ID: uC-gsronu33B167f05b1
ccctctcgtccgcaaccccactttgtcatcaaccacttttggatttccatggcgttactctattctttatgttgtgtctcattttcggcactggtgatagtcgcattgtacgtctccccggtcgtttcgacgtcgaggcgagtgttaggagattacggtaagctcgaaaacgggttcagggtcacgctcaagcatgttgattcaagcaagaatttaaccaaatgggagcggatccaacgtgggataaagcgtgggaatcacaggctgcagaggttgaacgccatggttttagcagccagcggtgattcggctgaggttcaagcgcctatcgttgctgggaacggcgagtttctaatggacttatcgatagggactccaccgaatagttactctgcgatcttggacaccggaagtgatttaatatggactcaatgcaagccttgtacccaatgtttcgatcaatctacccccatcttcgacccgcaaaatctttgacgttcaccaagntgtcatgctcgagcgacctatgtgaagcacttccgcaatcaacatgcagcgatgggtcatgtgagtatctctacacat

SEQ ID NO: 5167 - DNA, 51 bp, Gossypium hirsutum
  Clone ID: uC-gsronu33B167f06b1
aaattaagttgaatacaaaactgatgccactgcaatacgtatggagttttg

SEQ ID NO: 5168 - DNA, 451 bp, Gossypium hirsutum
  Clone ID: uC-gsronu33B167f07b1
ttttctttcctcagctgcaatttcaaagggactgaacaattctaaacaatcagaagagtctttgaggacagtcatgtacttgagttgttggggtcccaactgagccttaaatctgtcaaaatcgcttacaatttagaagaaacatcctttatttgggtgaatcattgactcgtgagtgcaagctttggtcattcagaagaaggtttaacgacgactgagcaatcaaacacattgaggcttttgcaggcagaatcatgtaataaggtccaacatgtcaacaacaagctcagatcatattctcaggccaacatatttcctcctcctgcaattgttccaaacatacatgtatatgtataaagttgtagtatgttagatgacagtccttaagaatggcgagggaatataaaaattgtagatatatcatttggaatctatattgaatggctatgaa

SEQ ID NO: 5169 - DNA, 512 bp, Gossypium hirsutum
  Clone ID: uC-gsronu33B167f10b1
tcccttgcgtccgcccacgcgtccggttaaactctcccatttctttcttcaacaatactttcgaaactcggctaactcactgaactcaactcaccatggcttcgattctcaaccccccgccggcgccttactttcaccttacctctttgcctacctccgtttcttcctcaccggtgatcttatcttatcctttcctcaaaacgacgtcacttcaagttcggtttaaagcgttgaggacctggtccgacggcgggaaaatcgggagccaggaagcttacggcgccgatttcttgaggaagccgagtacagtgccgaagaaggacagtgatggaattttggaagaagaggaaggtagtgagggaaaaagaaacagaggtgaatggactgattgggaagataggattttagaggacaccgtgcctcttgtcggctttgttagaatggatattcactctggaaaatatggagctggagatagattgagtccagagcatgaaaggacgattttggaa

SEQ ID NO: 5170 - DNA, 471 bp, Gossypium hirsutum
  Clone ID: uC-gsronu33B167f11b1
tccctttcgtccgcccacgcgtccgcccacgcgtccgcccacgcgtccgcggacgcgtgggagattccgttgtccagaagtcctcttccagccatctcttattgggatggaagctgctggaatccatgaaactacatacaactctatcatgaagtgtgatgttgatatcaggaaggatctctatggtaacattgtgctcagtggtggttcaactatgttccctggtattgctgaccgaatgagcaaggagatcactgcccttgctcctagcagcatgaagattaaggtagttgcaccaccagagagaaagtacagtgtctggattggaggatctatcttggcatcactcagcaccttccagcagatgtggatttccaagggcgagtatgatgagtccggtccatccattgtccacaggaagtgcttctaagttttataagttctttgatggtgagttacatttgcatttac

SEQ ID NO: 5171 - DNA, 545 bp, Gossypium hirsutum
  Clone ID: uC-gsronu33B167f12b1
tcacatagtgattttgaaaattcccattctcctccgtaatggctgaagaatccggaacggcgtcgtcatcatctagctcacaaccaagatcctctcctaacacttcaaaaatatcccaggttcctcctggatactctggcctcccaacttttcaaaatggcgattttcagatgtttccggttatgtatcctgcatttgttccaggtttaacttcgttacaaaatcaggaacagatgaaccgtggagcaggcatttatgctgttcctgttctaccatttatgggacatgtttctgggattccatctaacaatctcattcctctcacctataacatacctactcggtcggtgacagaggcaggggcagcagctgaggatcaagggcaaggagcacagcaacctcaacatcaacagcagcaggtaggacctcagagacaagttgtcgtaagaagattccaaattgcatttcagctggatttgttgcttatacttaagctagcagctgtaatatttttggtcaaccaagatggatcaagacagaggttg

SEQ ID NO: 5172 - DNA, 523 bp, Gossypium hirsutum
  unsure (1)..(523): unsure at all n locations
  Clone ID: uC-gsronu33B167g01b1
ccctttcgttcgacctcaagcttggtatccatgaggactctcagaacaggactaaaattgccgaattgctccgctaccactccaccaagagtggtgatgagctgaccagcttgaaggactatgtgaccagaatgaaggagggtcagaatgatatctactacatcactggtgagagtaaaaaggcagttgagaactctcccttccttgagaagctgaagaagaagggttatgaggtcctttacatggttgatgctattgatgagtatgctgtcggacagctcaaagaatttgagggcaaaaagcttgtgtcagctaccaaggaaggtcttaaacttgatgagagtgaggatgagaagaagaagaaggaagctttgaaggaaaagtttgagggtctttgcaaggtcatcaaggatgtgctgggtgacaaggttgaaaaggttgtggtttctgatcgtgtggttgactcaccttgctgtttagtgactggcgagtatggttggactgcanacatggagagaatcat

SEQ ID NO: 5173 - DNA, 457 bp, Gossypium hirsutum
  Clone ID: uC-gsronu33B167g02b1
ccctttcgttctcacaatttggttctacagtcagtgaaaaagttaacccagattcttatccttaattatttggatctcatttcccgatgtgttttcctttttacctttttcttggtcctaaaaacgcctccgatgttgaaaagcctattctggtatgtgatgctatcaatttcttaaagacaagaatgaccaaaagagtgcatagttgtagtttcccttttccaaaaacgaagaatgtgagtttgctgagtagcatagatttaataaaagttgagatacttggttaatcactatgtaaaacatctgcaactcttgggacttaactagttagtggcatcataggttattctttttacaggaaggggggcttttttgcgttggctgaaactaggaatgaataataaggggaagcacccttcagttatttcatgtgatttttatttggagaaaatattta

SEQ ID NO: 5174 - DNA, 522 bp, Gossypium hirsutum
  Clone ID: uC-gsronu33B167g04b1
ccctctcgttcgataaatctctcactcaacgcagagcgaataggcggagacttccaagaatctatcgcatcagctaatcacgctctaaagaatggatcaggttcaacacccatctatcatgcagaaggtagcaggccagctccttcgttctagccattctcaagattttcaaggttataatgggtctttcaggagtcctgctctatgccaaaggcgtgctgcatatggcaattactccaatgctgcactgcagcatcctgtccgggcttgtggagacctgtctatggttccatcaacagcttctgctatttgcgttcaggctcctgctgagaaaggatttagcagctttgctattgatttcctcatgggtggagtttctgctgctgtatcaaaaacagctgctgcaccaattgagcgtgttaagcttttgattcagaaccaggatgaaatgatcaaaagtggaaggctctctgaaccttacaagggtattggtgattgtttcaagcgaacaatcaaggatga

SEQ ID NO: 5175 - DNA, 469 bp, Gossypium hirsutum
  Clone ID: uC-gsronu33B167g05b1
ccattatgtgtttttgagttgctcataattttattcccccaatcgtttcaggtagatgctatgctatatatgttcgtatgttatctcggtgtttttccttctttgcttgagaaaaaaaaaaaaaaaaaaaaaaaaaaaaaaaaaaaaaaataaaaaggaaaaaaaaaaaaaaaaaaaaaaaaaaaaaaaaaaaaaaaaaaaaaaaaaaaaaaaaaaaaaaaaagggggggccgttttaaagaacccaattttcctacccctgtctggcaaggaaaaaatttttttatggggcaaccaaaattaaattcctgggccgcggttaaaaacgctgaaacaggaaaaccctggttgtacccaaattaaatggcttggaaaaaattcccctttttcccagttggtaaaaacgaaaaaggcccccccctttccccttaccaaaatttgacaacctaaaatgcaaaagggaaccccc

SEQ ID NO: 5176 - DNA, 591 bp, Gossypium hirsutum
  Clone ID: uC-gsronu33B167g09b1
ttcctttcgtccggctcctagaggtgtcccacagatcactgtctgctttgatatcgatgctaatggtatcttaaacgtatctgccgaagacaaaaccactggacaaaagaacaaaatcaccatcacaaacgacaagggccgactctccaaagaagaaattgaaaagatggttcaagaagcagagagatacaaatccgaagatgaagaacataaaaagaaggtcgaggcaaagaatgcattggaaaactatgcatacaatatgaggaacacagtgaaggacgagaagattggtgctaaactcccagcagctgataaaaagaagattgaagatgctattgaacaagccattcaatggctagacagcaaccaactcgccgaagccgatgaatttgaagacaagatgaaggagttggagagtatttgcaaccccatcattgctaagatgtaccaaggtgccggcggtgacatgggtggtggcatggatgaggattgttccgctggtggaagtggtgctgtcctaagattgaggaagtgactaaatcattgatttcttcacctggttctctatggtctctatgtttttgggattaa

SEQ ID NO: 5177 - DNA, 585 bp, Gossypium hirsutum
  unsure (1)..(585): unsure at all n locations
  Clone ID: uC-gsronu33B167g12b1
tttgctatctcaggtggtgctcctcaattctatcgagtctttttgcagcaaggctagccctgaggcggcgaaggaggtggcattggttcttaaagtgctgtatgacgatgatattttggaagaagagtttatcatggagtggtaccagaagggtatagctggtagcaataagggttctcagatatggaagaacctcaagcccttcatcgagtggctccagactgccgagtctgaatcggaagacgagtgaatccctaagctctccgtatggtgtctttaccatgttaagcctctacttctagtgcaataaatattagcgtcgtcttctattatatgttggtgtttggctttcctgtgtcgtgtttcctagaataaaagacagtgagctacatcccgtacgtgctctctgctgttctgtggtttattatggtgtgaactggtcattgtttattcccctaatgtgttaactgagtttactgttttatttctcaatagttttcttttcttttttatgttatcttaaaccgtcataagcnctggttaaatttcatgttttaattaatatttctataaaaaacaatgttt

SEQ ID NO: 5178 - DNA, 442 bp, Gossypium hirsutum
  Clone ID: uC-gsronu33B167h01b1
ccctctcgtccgggaattcggagactcctctccgatgttcactgcactggcgacgattgccttgataaatctagtttgcttgattggattgatgaagaaagcaatcgtgaatgagggtatacctataatctatgagacaatgcttctacaatttgttctttgtgccattctggttctaatcaactggcccttgtaccaaggacttttctttaggaaggacaatggcaagatgccaaactatatagctatcaagtcaattgtattagctgtgtcatcttgtacatgttttacattattctcgacttaaaaaaaaaataatgttcattttggtttaattctctgtaactatcactccatgatttgaagaaataaaaggatacccttgttagccttcgggattaaaaaaaaaaacaaaaaatctatattaactatacttcttttt

SEQ ID NO: 5179 - DNA, 395 bp, Gossypium hirsutum
  Clone ID: uC-gsronu33B167h02b1
gcatatcaacccggctgagacatggtttttgtacgtggcacgcatggtgtcactcatccgagccctgatgtacatggaggctcagagctagggtgccatatgtgggagaggattggtcaaggctttccagaagacctactacaacaactacgggggtggtgagaacgagcttcaaccagggttcaacaaaggcactggactgggtgctgagaccattgcgacctttgatcttgactacactgtcttcgccgtcactgatcctaagaggaatgcaagagattcccatgttccttgtgtggcaccactccccattggattcgctgtggtcatggttcaaccttgccacacttcaggtactggcactggtataaaccctgcttggagttttggagctg

SEQ ID NO: 5180 - DNA, 551 bp, Gossypium hirsutum
  Clone ID: uC-gsronu33B167h05b1
caaacacctcattttcctgagaaagaaaaacataaaagaagcgtaagtgaagaaggagaagaagaaaaagaaaatggcggaccagcttaccgatgaccagatctctgagttcaaggaggcctttagcctctttgacaaggatggcgatggttgcattactaccaaggaactgggaactgtgatgcggtcactcggacagaaccctactgaggcagaactccaagatatgattaatgaagttgacgccgatggaaatgggaccatcgatttccctgaatttctcaacctgatggcaaggaaaatgaaagatactgattctgaggaggaacttaaagaagctttcagggtgttcgataaggatcagaacggtttcatatctgctgccgagcttcgtcacgttatgacaaatcttggcgagaagcttaccgacgaggaagtcgatgagatgatccgtgaagccgatgttgatggtgaccgtcagatcaactacgatgaattcgtcaaagtatgatggccaagtaagatctctccaccaaaaataaaaaacagag

SEQ ID NO: 5181 - DNA, 406 bp, Gossypium hirsutum
  Clone ID: uC-gsronu33B167h08b1
tcttcctttcgtgcgtgaattctttccttcactttcttgagaaaaaaaaaatggcttcaggttgcaattgcggatctagctgcagctgcggatctggctgcaattgcggtgagaactgctcaatgaaccttaaccttggatactcggagaagacaaccagcactcagaccatcatctccggagttgcgccagtgaagatgacctttgagggaccagagatgggcactactgaatcaggacatggatgcacctgtggatcaagctgcaaatgtaatccatgcacctgttgaaaagcttgatgaaagccatatattatgaaaaaagaaagcagcgaaataacaggcctctgtaatgatttattttcaaggatggatgcctgccaggggtataaatatgtctctctctg

SEQ ID NO: 5182 - DNA, 509 bp, Gossypium hirsutum
  Clone ID: uC-gsronu33B167h12b1
tgctttccctgctttttctttgttgaagaatccccaagttgaaactcgggttcctctgttttcaagaaacggttctggggttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtttgcctattttgatagggacaacgttgctctcaagggtcttgccaagttcttcaaggaatcaagcttagaagagagagagcatgctgagaaattgatggaataccagaacaaaagaggtggacatgtgaagctgcaatccataataatgcccctctctgagtttgatcatgcagagaaaggtgatgctttatatgcaatggagc

SEQ ID NO: 5183 - DNA, 382 bp, Gossypium hirsutum
  Clone ID: uC-gsronu33B168a01b1
cccattctttcgcccacgcgtccgcccacgcgtccgcccacgcgttttgcttgatgaaagccatagattatgaaaaaaagaaagcagcaaaaataacaggcctttgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttggtgttaaaatcttataaaaatatatatcggttgctgctcttggtttgtatcaaatcattggctgaaaatatatggcatcatttatt

SEQ ID NO: 5184 - DNA, 158 bp, Gossypium hirsutum
  Clone ID: uC-gsronu33B168a03b1
atttttttttagttaattgggattgtggttttttatgttgatttaaaatgaatctggggtggaactgtgtgtaatgtggaaaaaggaactgttttgttattgtgaaaactctttgtttctaaagtttgtgtaaataatgtctttcttttttgtgcttt

SEQ ID NO: 5185 - DNA, 382 bp, Gossypium hirsutum
  Clone ID: uC-gsronu33B168a04b1
cccatctttccgaggaatctggcttaaaggttgggcggggttttttttaattaagggtgaatttttatggcttggggcctaatggggaaaaccggaccatggtaccccatagaaaaccttgaccggattgggggctatggtggtccatttaacccaaggcatgggaattggtggttttgggggtcaaaattaagggttggggtatccgaatattaaatcccaggattatggaaggggttaatattaaattggggttttaaaaaaaaaaaaagaaaaaaaaaaaaaaaaaaactaaaaaaaaaaaaaaaaaaaaaggggggggcggttttaaaggaccaaggtttccttcccctgccttgcaaggtattagtttttttttggg

SEQ ID NO: 5186 - DNA, 519 bp, Gossypium hirsutum
  Clone ID: uC-gsronu33B168a08b1
tttgttttgtatattgaagtttcctttctcgatggtctatttagccaaacaagatgcagatcttcgttaagactctaaccggcaagacgatcactctcgaggtcgagagctccgatacgatcgacaacgtgaaggccaaaatccaagataaggaaggcatccctccagaccagcagcgtctgatcttcgccggaaaacagctcgaagacggccggaccttggccgattacaacatccaaaaggagtcaactctccacctcgtcctccgtctgcgcggtgggatgcaaatcttcgtgaaaaccttgactggcaagacaatcactctcgaggtcgagagctccgacacgatcgacaacgttaaagcgaagatccaagacaaggaaggcatccccccagaccagcaacgtctcatctttgccggaaaacaactcgaagacggccgtaccttggccgactacaacatccagaaggagtcaactctccaccttgtccttcgtttgcgcggcgggatgcaaatct

SEQ ID NO: 5187 - DNA, 520 bp, Gossypium hirsutum
  Clone ID: uC-gsronu33B168a11b1
gtatttcccagcaacaatggcaatggttttatggctggttttttctccttttctgttcttatctgtttctgtcaacactcaaaccaaagtaaccgataaccctgcggatgaattggtggctgcgcttaatgccaataggacagctcacaagtcatcggctctcaccgacaacccaggcctggcctgcattgctttgcagtatataaaagcataccaaggtgactgtaaagctgtaggagaggccaagaagcccgctgactctgaattttctgaaacttttgcccccaactgtggtgtggaagcctcaaccctctctccaatcactggtcgtttacttggatgccaatcgaaatatgtagagccttctgaagctttctcgatgttgatgaaaaacgagaagagtttggaaattctttacaataagaaccacactgaagttggggctggtgtgaccggctccgatggtgggggtccctatttctgttgtgtacttttcagcaacggcaagcataacagtagc

SEQ ID NO: 5188 - DNA, 466 bp, Gossypium hirsutum
  Clone ID: uC-gsronu33B168a12b1
gggttttccaagctgagtttcccaaaccattggaaaggaaagaatggtttgtactgcgtcggtctgtcgagaagggggctatatggggcggctagcgatgcactcaacatagccgatgatatcaactcaacttagtaactaaatggttcctttgatccaccaatattacatattctataccaagcagaacacacatattagttcacttgtgactatgtacttatgcatgcatgcatctatgcacggatgtatgtgttgaaagatggatgcatgatatagccaaaccgaggtggtttagggtttaagctatctgtatgaataatcatttccttagtaaatccaagagagttatagtactgtagtgctattgtatggaatatatcacatacaggagaactgtagaaagctccagacccatggggtggcatcgactttcaaatgaatacaaaatcatcagatgagaggt

SEQ ID NO: 5189 - DNA, 544 bp, Gossypium hirsutum
  unsure (1)..(544): unsure at all n locations
  Clone ID: uC-gsronu33B168b05b1
ggagttggtatttcaattcatgctgggacatctaatggagtatttttgcgtccatgggatggtcctttcctttgctccacttgccaggagaagaaagaagccatggaagggaaaagaccatcaggaagtagacatggtagtgacagcgattagctagaccccccaaattactgcagcattttatgggcactaacaattgtttcagaggtggtcgtaaatgggaaagatatcacaatcatatactatagtaatttccttcaatttcttattgggggggtcatggagcattctggtccactttcaactgagggttcatttccatctatactcacaagccagaagaacaaagttcagatatgggtttagatttttgctttctgggttccaagtaagaagacttgtgtttaagtcgagtgaaaatggaaaaagaaaaaaaaaatttaaaaaaagagacaagatatgcttcataggttattccattttttcgtcgatgtccatgccatngaataccagtcgctccaattcataaaactaacattaaatg

SEQ ID NO: 5190 - DNA, 497 bp, Gossypium hirsutum
  Clone ID: uC-gsronu33B168b08b1
ctttcttttagtccgtaactcattctctgtatcatggatcatttccttatttctactgtttcctcgctttccggcttcacatccttctcaggtgaacggagatggcaggaaaaggtggaaaggggcttttggcggcaaaaacaaccgccgctaacaaggacaaggacaaagataaggacaagaagcgcccggtttctcgttcatctcgtgccggaattcagttcccagtgggccgaatccaccgtcacctaaagactaggacttccgcaaatgggagagttggtgccacagctgctgtttacttggcctccatccttgagtacctaactgcagaggttcttgaattggctgggaatgcaagcaaggatctgaaagtgaagagaatcaccccgagacatctgcagcttgctattaggggtgatgaagagcttgacactcttatcaagggtactattgctggaagtggtgtcatcccttacattcacaagttccttatc

SEQ ID NO: 5191 - DNA, 352 bp, Gossypium hirsutum
  Clone ID: uC-gsronu33B168b09b1
ttctttctacttactctaagaatataaacttggtggagtattttttaaaaaatcaagcacatgggtgttgatgctgaacttgcgatcccggtcatcgagtttcggaccggttcgcgggatttggagcgagggactgaaggatggcaccatttgtgcaagagggttcgagaggcttgcgagacctacggttgtttcgaggtggtgtacgaaaagatatcgagagaagtccgagaggagacgtttgagttgttgaatgaactggttgaggtcccgttagagaggaaacaattgaacgttaattccaagccttaccatagctattttggaccatgtagccaagcttctttgtatg

SEQ ID NO: 5192 - DNA, 230 bp, Gossypium hirsutum
  Clone ID: uC-gsronu33B168b11b1
ttgtgcgtgggttatattatttcatattgtatgggggaattgtaaaacctatatgagctggaagaattaagtgactgctcacattagagaattaggagaaagatgggataagcaacatggaaatttattgattatttcatattttctttaaataggagggataaattctctatgtttttaacgaggaatgtgttcttatgtatatttaatacaattgaagaagtttattt

SEQ ID NO: 5193 - DNA, 501 bp, Gossypium hirsutum
  Clone ID: uC-gsronu33B168b12b1
gtggttttgaagctggtatctctaaagatggtcagactcgtgagcatgctttgcttgcttttaccctcggtgttaggcagatgatttgctgctgcaacaagatggatgcaacaaccccaaagtactcaaaggcaaggtttgatgaaattgtcaaggaagtctcttcttatcttaagaaagttgggtacaaccctgagaagatcccgtttgttccaatctccggttttgagggtgacaacatgattgagagatctacaaacctcgattggtacaagggtcctactctccttgaggctcttgaccagatcaccgagcccaagaggccctcagataagccacttcgtcttccacttcaggatgtctacaagattggtggtattggaactgtccctgttggtcgtgttgaaactggtgtcctcaaacccggtatggttgttacttttggtcctactggtctgaccactgaaagtaagtcctgtgagatgcaccatgaatccctcc

SEQ ID NO: 5194 - DNA, 476 bp, Gossypium hirsutum
  Clone ID: uC-gsronu33B168c02b1
ggatgtttgatagtgtgccagggatgaaggcactggaggggaatatagatgaggatgctatattgaggctgactagggaaattgtgcctgggatgattgtcaccgggatggaagttgctgagattgatggatccccaagaatggggccaacatttggagcaatgatgatatcagggcaaaaggcagaccatcttgccctgaaatcattaggattgcctaatgcaattgatggaacatatgtgggaagcattcacccggagctgatcttggccgctgcagattccgccgagaccgatgacgcttagttgcaagggtcatagttgctaaactgctatggagataggaggaattggaataatgtgcagtcattggtaggatttggaataatctcctgtaacttagtagcaaaaccttagcattttggagcttgttgatcttctccttgcatgccttttaattgagttctgttctctttc

SEQ ID NO: 5195 - DNA, 442 bp, Gossypium hirsutum
  Clone ID: uC-gsronu33B168c06b1
cccttgtttccggtattcttagattcatacctaggtggagagggtcatacagggctgtctttttttcttttcaactttatagtttccaaagtgaagaaaatgtactttttaacttggttatatagtgcgctttatttatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaagggacccaagtttacttccccgggcttgcaacgtaaaactttttttttgggggcccctaaattaaattgacgggcgggggtttaaaaacgtggggactggaaaaaccttggggttccccaattaaattcctttgaagaaaatccctttttcgccagttggggtaataacaaaagggc

SEQ ID NO: 5196 - DNA, 432 bp, Gossypium hirsutum
  Clone ID: uC-gsronu33B168c09b1
ctctttcgtccggctcattcaggcatttccgcagacactttctcaaaagaaacgtttcttttacactaacatggctagaccgcaacaacgatatcgaggtgtccgacaaaggcattggggttcttgggtttctgaaattcgccatcctcttttgaaaactagaatttggctgggaacatttgaaacggcagaagacgcggctcgtgcctatgatgaagctgcaaggcttatgtgtggacccaggactagaactaacttcccttacgatcccaatgcacctcagtcatcatcatccaagctgctctcagcaactttgacagctaaactacataaatgctacttggcttcacttcaaatgaccaaacaacaatcagtgcaggagccaaaaagagagccaccgacttcacatatcattaccaacaatggcattgc

SEQ ID NO: 5197 - DNA, 373 bp, Gossypium hirsutum
  Clone ID: uC-gsronu33B168c12b1
tcctcgcgtccgaaaaaaaaaaaaaaaaaaaagggggaatttttaaaaaaaaagggttaaaaacacaaacaaacaaaaaaaaaaaaataatataggggcgcccgatttaaaggaaccaggcttccttccgcgaccttgcgactggataacccttgtatggtgcccccaaaattcaactcgctggccatccttttacaaccaggtgacgggaaaacccctagggttacccaaataaatcgtcttaacacacatgcacctttaacgggttggggtactagccaagaggccgccccctaaggcccttccaaacaggtggtcaccctaaatggacactgtcactcgccctgtccctacccattaatcccggcggttg

SEQ ID NO: 5198 - DNA, 520 bp, Gossypium hirsutum
  Clone ID: uC-gsronu33B168d04b1
cccttgtttccgcccacgcgtccggtggggtttacggtggaattctccgagcaaagggtttagcaaaaagaattgctgttttctcttttcatttcacaacttcctttcctataaacactgcaaattttcaccagttttaatatggattccaatgtcaaagaactagccaccgaagttctcccttatatccgagtttacaaagacggctcagttgaccgattagtcgattcacccatcgtcccaccttgtaatgaagaccctgaaactggggtctcatctaaagacatcgttgtttcaaaaagcccaccgatttcagctagaatttacttacctaaacacgtcgaacaatccccaaaagttcctctgttagtctattttcatggcggaggcttttgctttgaatcagcgttctcttttgttgaaaccaagtacatgaacaggttggctaaacaagccaacgttgttgttatttcgatcgagtataggctagcccctggacaccctctccctattgttatga

SEQ ID NO: 5199 - DNA, 520 bp, Gossypium hirsutum
  Clone ID: uC-gsronu33B168d07b1
agtaataacaaaaatactattgcctcacatgcgtgggaacttatgcaactatccagtcattttcactactattactatttatttttattaaacaacttttttaaaaatattttaattgaataatttttcatagaatgatattattaaggcattgtttatggacactaatagaatattattaatattatttaaaattttttatgtttaataacaatatactaataatacgtattttataaatataagcttaattagtattatatatatgaaacaatattttcatttattttgaatgttgaaaaaataatatttaattaaaaactatttttatattgtttaatgaagagcaaaattgggagaaatttgtaggttttataaatggaaaaacaaatgcccccaaaatgtttgaagggccatatatgattttaacaaataattcccatttggttggagtactgaagtttagtagatcagcaaccattaattatattttcaaatattataatagtttcattggatt

SEQ ID NO: 5200 - DNA, 552 bp, Gossypium hirsutum
  Clone ID: uC-gsronu33B168d08b1
ttctttcgtccgcccacgcgtccgcccttaggcgtagctttcgatccacatcataaaaaaagtaaaggagaaaatgaagggtctgcaggcacttatattggcaatggtaacggttatggcgatcgctacaactgatgctcaaagcatttgcagcatgccagcttcaggtttgatggcatgcaaaccagcagtgacccctcccaaccctccgccgcccacgtcaacttgctgctccgccctctcccacgctgacatgcgttgcctttgctcatataagaactccaagctgttgccttcccttggtattgacccaaaccttgccatgaaattgcctagcttgtgcaagcttcctcatcctgcaaattgttagttcctggctctccatatttgatctcaaatgtgagggaaaatcatgcttattataagcctctacttcacattattgtactgagcttcgggttttctttttcctttatttctttttatgtgttgggtttcgattggtatcttatagtcgtgtaatatcacatacgtgtgatttctcccaataat

SEQ ID NO: 5201 - DNA, 551 bp, Gossypium hirsutum
  Clone ID: uC-gsronu33B168d09b1
ttcatgcgtccgcccacgcgtccgcgtatctcggcggctaattctcctacttatctgctgctcgcaaaaccctagccccttccttttttctttcgtagtaatcatccatggagttctggggtattgaagttaagtctgggcagcctattaaagcagatcctggtgctaactacgttatccatctttcccaggcttcacttggagagtccaagaacaaagcagaatccgttccactctatgtgaatgttgatggaaagaaacttattctgggaaccctttcccaccagatttgccctcaattatcttttgatttagtatttgacgaagagtttgagctctcccacaactggaaaaacgggagcgtatatttcctcggttataaaactttcataccagaggaaggtgatgattttggtatgtctagtgaagaagaaagcgaggaggaggaagatgaggagcttcctgtcgctgctgctgctgctgctgctgcagtaaatggaaaagctaagccagatgcaaaaacagccaaagctaatgctgggaaacctgat

SEQ ID NO: 5202 - DNA, 501 bp, Gossypium hirsutum
  Clone ID: uC-gsronu33B168d10b1
tgttgttgctccagtttggtccccgccatctgggggttacctttagcaatttatgggggttgaaagcggtatcggtgcaagctcatcttttcttcaagggcatccacagtcccaccaaatcataaattggaggcgattatctcaaaccgggtaaaacgaatgcacgccaaaggcagggacctagtacttgcagaacgctcagtctagtggccggattggacgataacatggcatgttatcaaccccatgtattgtccaccaatctaactcgatctgcagccaactcgggagttgggtgaatgatcagctatccaatgttctaccatacgcatagctctgctgtatagtgttttggcttctttatataaaagggtagatgagattcattgtagaaatgttgtaatcctggaataaacacaggcttctgtgtatttactttttaactgactaggaaggtgtattggattactcattcctagtgctccctcttttcctttcttt

SEQ ID NO: 5203 - DNA, 90 bp, Gossypium hirsutum
  Clone ID: uC-gsronu33B168e01b1
ctcgttgttacgaccattaccagtataactctcaaggaggaattttatatagtgattcagcatttatcacaccatttcgaaattctccag

SEQ ID NO: 5204 - DNA, 541 bp, Gossypium hirsutum
  unsure (1)..(541): unsure at all n locations
  Clone ID: uC-gsronu33B168e02b1
cccttgtttccggccgaagttctgtcaagatataccacgccaataccgaaggttatgttgctcaggtcggcaatatgctagtgatcaaactagggcatttcgattggaatccttcaaaggaaaatcagttggatgggagatggcaaaagttcattgataaaggagcagattatcaaatttggttaagacagtaattcaatgaaatcagcaaaaaggttagaagttatcctctgccacattatctctacttatagtaatagaagaatatctgcaatcgtacacacacaaaaataaaataaaataacacacccccatcagcgtcgactacaatatcagcttcagcaatggcaacataaaaccttgaacaaggatcgggaacggccgcatctctatcaagcagcatgggaattaacgttatggtttacagacgttatggtttaagtcaatgaatctgatatgctgatttcagccattcttatgtaactttttcatgtttagtgcctatgcttaatttnttgtgctttcttgcttaagatcatga

SEQ ID NO: 5205 - DNA, 129 bp, Gossypium hirsutum
  Clone ID: uC-gsronu33B168e04b1
cccttgtttccgcccacgcgtccggcactaatgcgtggggtcctattagaactccggaggtaatcgtgcttgggcgagagtagtactaggatgggtgacctcctgggaagtcctcgtgttgcacccttc

SEQ ID NO: 5206 - DNA, 554 bp, Gossypium hirsutum
  Clone ID: uC-gsronu33B168e05b1
attgttttagagcagcatgatagaagggagcagctaaagaaaagtggtcttggaaaggtcattatgttcttatcaaaatctgatgaggaaacgacatccaacaggaaacttgctaaggaattggttgataaatggagtagaccaatctttaataagagcactaggtttgaagacatgagaaatgttgaggatgatagagttcccttgcgaaggccatctgtgaaaaggcccacaaatagagctgcatcaatggaatctagagatggtgattttgatttggatatttctcgggaccacaagtctggtagatcatcgtcaggtcaaaatgcttccaggtctgaatcttcttcaaggctacatgcttcaaggccagatgcaacaccaatggattttgttgtgcgtccgcaatctaagattgatccagatgaaattagagctcgagcaaaacatgttgtacaagatcagcgtcgtttaaagatgaataagaagttgcagcagttgaaagccccgaagaagaagcagctgcaggcgtctaaacttagtgttgagggtcg

SEQ ID NO: 5207 - DNA, 476 bp, Gossypium hirsutum
  Clone ID: uC-gsronu33B168e06b1
tcttttttaagagtataaggaagcttgatttcagggcgggtgtgtgtttccaccattgtgcaggttagtgatctcaaaaactcgcctggacctggaaaaaaggagcttagattggcaacaaaacaggctcttcaggttcttcaagataattatccagagtttgttgcaaaacaggtatgttctatgtctatccatatttaactatcctatatatataatgtgaaaatttgattgtatagtagattctctggagatgcattgatttgggtttcttgttctgttaggtgtttattaatgttccttggtggtatctggcattctatacaatgattagtccatttatgacccaaagaactaagagcaagtttgtcattgcactgccatctaaatctgctgaaacacttttcaaatacataccacctgagcaagtgccaattcaatatggtggtttgagtgtggattattgtgattgcaat

SEQ ID NO: 5208 - DNA, 317 bp, Gossypium hirsutum
  Clone ID: uC-gsronu33B168e08b1
taataataaaacaaaaaaaaaaaaaaaaaaaagggcggacatttttagagagataacagagacttttttacacaagcaaacaacatggtagctcttttatagggttacctgcttttcattcccttgcccgccgttttacaccttcttgactgggaaacccttgtctgttcccatcttcctctgttttgccccacatcccctcttttgcccgctggcgtttcccccgtataggcccgttccgttcgctcttttttcagttgctcggccttaatggtgagtggcacgcgctctgtctcttgcgctttatgttcggccct

SEQ ID NO: 5209 - DNA, 546 bp, Gossypium hirsutum
  Clone ID: uC-gsronu33B168e09b1
ttattcgcccgcccacgcgtccggacactcgggggggatttttaaacaaaagagcgcctttagttcctccctcttctcgaacaagatgagtaccatgaaattttgccgtgaatgcaacaacattctctacccaaaagaagacagggaacagaagattctcctctatgcctgccgtaactgcgatcatcaggaggtggctgaaaacaactgtgtgtatagaaacgaagtgcatcactctgctggtgaacgcactcaaatattgcaggatgtggctgccgatccaactcttcctcggactaaagctgtaatttgcgcaaattgcaaacatggagaagctgtcttcttccaggcaactgctagaggggaggaaggtatgacactgttttttgtttgctgtaatcctaactgcggacatcggtggagagattgagatccgagatatcaaagcttgcttgatttaatgtctccttttttctttttttgacaaactaatttcagtaagacggttgtgatggatcctttttaaggattctagggttatttact

SEQ ID NO: 5210 - DNA, 59 bp, Gossypium hirsutum
  Clone ID: uC-gsronu33B168e10b1
attttgtggaatcttttatttatttattttaggggggccattatcatcttatccaaggg

SEQ ID NO: 5211 - DNA, 528 bp, Gossypium hirsutum
  Clone ID: uC-gsronu33B168e11b1
tttttaccacagaatggatctaagttcaacccggtgccttcaagtgcaagtccagccacatctgccgctgctgcagcagcagccaccgccaccgccactgcaactgctgcagctaaaggcaaaggggttgctcccgttggatcttagcatggaatgagctgttatgtacaaccttgtgtccgaccatgtattgaaagatatataagaatgagtgactttgccatggaagtagcagttgagttgtggagaaatgcacggcttccccctccaccccaatttttcctgaacaccctttttgacaaatttcctcgtggtacagtggtaatgttccattgaattgaagagtatactctccttgggataaattagtaaaaagccttaataataaagtgctatattatcaccattttgctgctggagtatattttgattacctggtctttgtgttattctggaaagtaaaaaagggggaaatgcaaggtcctttttgccaacttaaaaatgtaataatggaatggaagcttttaa

SEQ ID NO: 5212 - DNA, 477 bp, Gossypium hirsutum
  Clone ID: uC-gsronu33B168e12b1
ttctaactctcatgttagggtacagtcatccgggggggtttatgatatactggcgagaatgtataggcaataggttgttttttgctggtgaagccacaactcggcaatatccagccaccatgcatggtgcctatttgagtgggttaagggaagcttcgcgtattctccgtgccacaagaggtcgccaaaactactttaggaggtctgtgcagcggaatgttggaccaagcagtgatcaattgggtgatctgttcaagatgcctgatctagtatttgggaagttctcttttgtgttcaatccattaacagaggaccctaaatcattggggattttgagaattacttttgataattgcacagatgatatgaggaaggtgctggaaaaaagctgtggcccccaatcgaatcaatcattgcagctgtacgcagcattgtcccgtgaacaggcacatgagctacaaatggtaactggagaag

SEQ ID NO: 5213 - DNA, 467 bp, Gossypium hirsutum
  Clone ID: uC-gsronu33B168f01b1
agctttctgaccatcatctccggagttgcgccagtgaagaggacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaaaataatgtataagccatttggttgggagcaaattgtccttttctccaaaggatttttgctgctcattcatggtgacttggattatggttttatctgttgttgttaaaatcttataaaaatatatatcggttgctgctcttggtttgaatcaaatcattgtctgaaaatatatggcatctttta

SEQ ID NO: 5214 - DNA, 566 bp, Gossypium hirsutum
  Clone ID: uC-gsronu33B168f02b1
cccatgcttccgcccacgcgtccgggtaagaccacgctgtggcactttgtcgtccaagagggtatacgtacagaaggtttaagagctgcccgtgctacaagagaaaacaaaagttctcttcttgaggatgtttcccccgatatggaagagcactaccataaccttggtcttgaggtggtttcacatctaagtagtgaactcgaaaatgtcaagaaagcagcatctatcgatgcagaaaccttaacaggaacggttgctaaacttggccatggactcctaaaagcacgagatttcttgaagtcggagatgaaaaatacgaacgaacaaagtggtttccatgaagcattaaagagttttgtgcagaatgcagaagttgatgtcacgtcattgctcgaggaagagaagagaataatggcattagtaaagagcactggtgattattttcatggtaacgcacataaagacgagggcctacgcttgttcgtcatagtacgcgactttttgataattttagacaaggtttgcaaagaagtaagaatgccccaaggaaaccggtaaaacacata

SEQ ID NO: 5215 - DNA, 482 bp, Gossypium hirsutum
  Clone ID: uC-gsronu33B168f03b1
tgtttctttcttcaattcagagaacaaaattgttggccgattttattgaagccttcaggctgcattgaggcgctgcttctggaagggtcaaattgcgggaagtggatttggtgtagctcagttttcactatatgcttcttatgctcttggtctttgggatgcttcctggcttgtgaagcatgggatctctgatttttcaaagacaatccgagtctttatggttctcatggtttccgccaatggtgcagctgaaacattaaccctggctcctgacttcatcaagggaggtcgagccatgcggtcggtctttgatcttcttgaccgtaaaactgagatagagcctgatgaccctgatgccacacaagttccagaccgccttcggggagaagttgaactaaagcatattgacttttcttatccgtcgcgtcctgatgtcccaatcttccgtgaccttaatcttggtgcccgagctggaaaaactc

SEQ ID NO: 5216 - DNA, 285 bp, Gossypium hirsutum
  Clone ID: uC-gsronu33B168f05b1
cggatgtttgggctaagaatgacatgtttattagacgggccatcattatgcagtctgggtgaagttttaccagaaaagtagtggggtgagatgggtggtggcccagcatcttggtttattgttatgtatgtgtaatcggagtccaaataattttcttttatggaaatgaacgctgtttgagtgctttcgtggtaatataatacttggttttctgtttcggttatgaaaaaaaaaaaaaaataacaaaaataaaaaaaaataatataaataataactttactcttg

SEQ ID NO: 5217 - DNA, 58 bp, Gossypium hirsutum
  Clone ID: uC-gsronu33B168f06b1
atttttgttcggataggggaagcgtgattgtaaagggggcttttttttttgtcagggg

SEQ ID NO: 5218 - DNA, 438 bp, Gossypium hirsutum
  Clone ID: uC-gsronu33B168f09b1
ttctttcgtccgactttcccgactttcttttcgctggatttactgaaagctttgtggagttgaaatggagattcttccacagcgatcatcattatcctcaactctgaatcccaacgctccattgttcattccattagcatatcggatggtcaaggatttctctgatcaatggtgggctctcgtccaatcatccccttgcttccgcgactactggcttcaagaacgcttccacgatcccgaaaacgacgacgtttccgacgacgacgatgatcctctcttccccggcgacctcgatgacatatttgagcaatacgacgacgttttactcgacccaagaccggaggaaaaggaaaagaaattggtaccgtttgggacatccaagtggcggaaggaccgagttgtgactgagtcaccgaggtttatcgaaaaagcacccaa

SEQ ID NO: 5219 - DNA, 439 bp, Gossypium hirsutum
  Clone ID: uC-gsronu33B168f10b1
gaggaaaatcatgggtgccaaagttctgggcttctttgctttgctttccgggtcagctgtctcggcatttgcacaggatgaggaagaccaaggtcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttccttgggaggcccttatatt

SEQ ID NO: 5220 - DNA, 527 bp, Gossypium hirsutum
  Clone ID: uC-gsronu33B168f12b1
ttccctctctggagtctgacgaatggcggatcgggagtggttgtgacccaaagagtaccccatggtcgtatcacaatggtggatcgtggccaacactattgtggcagttcacattggcctgtataaaaatggggaagccagaattggcacaaaaagcagttgctttggtagaggaaaggctagcagtggatcagtggcctgaatactatgacacaagaagtggaaggttcataggcaaacaatcccggctctaccagacatggacagttgccagtttccttacctcaaagatgctattgcagaatccggagaaggcatcccttttattctgggaggaggactacgagcttctggagacgtgtgtttgtgggcttagcaaaaatggtcgaaggaagtgttcacgccttggtcctagatcgtaatgacggttcattaattactttgggtgggtaggatgggatgggaaataataataagttcggatggaagggtagtaaagtgctggagagacatggaagtgactgact

SEQ ID NO: 5221 - DNA, 443 bp, Gossypium hirsutum
  Clone ID: uC-gsronu33B168g01b1
cccatgcttctcgctcgtgccccacatgaacctgcatggggcgaaattgggtggctatgatgttcctgctgagagcaaaatcttggtaaatgcatggtggcttgccaacaaccctgctaactggaaaaatcccgaagaatttaggcctgaaaggttctttgaagaggaagccaaggttgaggccaatggtaatgatttccgctacctcccctttggcgtggggagaagaagttgcccaggaattattcttgcattgcccatccttggtattactttgggtcgattggtacagaattttgagctcttgcctccccctgggcaatctcaaattgataccacggagaaaggtggacagttcagtcttcatattctgaagcattccaccattgttgctaagcccaggcaattttaacttggtctcttctatccattttagtgaactc

SEQ ID NO: 5222 - DNA, 390 bp, Gossypium hirsutum
  Clone ID: uC-gsronu33B168g02b1
tatgcaagccggatttttgccccatcaacagcggcttactctccctaccctccaactcaatcaacaaatcaatctcaaccagaggcgttgccaaacagcatggccatgcaggtctcatattctggacttcctcaacccgtgtctagccgagctgataccattacttatgggtacggagtacctggcagaacagctccccaacaaccttcttaacaaatcaaaggcacttttggagcacaaccgactgataggtacacaggacctggctccaatcccacctttcctccaggaagtgcatacatggtatatgatagtgaagggggtagaacacatcacccgtcccagcagcctaacttcacacagggtgggtatcccccaacagcaaatgtc

SEQ ID NO: 5223 - DNA, 548 bp, Gossypium hirsutum
  Clone ID: uC-gsronu33B168g06b1
ccctttcttccggccagggtgacttgacttgtgtgggggagttacttggaagggggttgaatagatacacagacaattttctgtgattctgattgtatctattatgggtttatttttaccatttcctacatatttgcattttcttttttcagatttgaattccataaattggtaatgaagtcataaacaaacccattaaagtgtgagctacatgttagaatttgtcttctaataaaggagtagagatgaaatgatttttgatatataatagactattaaggttggtcaaaaataaaatccatttctcccatttccaattttgcctatatgacgaactcatatgacaattactttatcctactgctaatcatgtttatgaaatcacagaggaggatatagtcaaaatatttaatccaatttacagtcctcctaatggactttcatgacgggctgattggcttgtgtatggcaggttaataaaaaatttgttgaatgtttctttaccttagacacaatgagattatgctgcactaatattacttcttcta

SEQ ID NO: 5224 - DNA, 525 bp, Gossypium hirsutum
  unsure (1)..(525): unsure at all n locations
  Clone ID: uC-gsronu33B168g08b1
ttgtgaaaatgaaggagaaaaaaaaggtgatcctgggattcctttttttgtgacgagatttcaaaagcgtgtagggatagggttttaattaattaagcttgtaataaaacatgttagaatagttagcgtgttagcatggtgtgcttgtgttgtgttaacatatcctatccaaggatgtaaaccagtggatcgtatggacataatgggaggttctgcatcagctagtccatgctcatcatatcacccaagccctggttcatcttccttcccaagtccagcctcatcccattacacggccaatgccaatggcaatgctgatgccaattccctaatcccttggctcaaaaacctttcttctggttcatcttcagcttcatccaagctcgctcaccatctcttcatcgcaggtggttccataagtgctcctgtcactccaccacttagctctccaactttcagaactcctcgaaccagaagtgattgggatgaatgaatgctggcccaacttgcacggngaagcgcttt

SEQ ID NO: 5225 - DNA, 476 bp, Gossypium hirsutum
  Clone ID: uC-gsronu33B168g09b1
gtggttcaaggctgctgggcaagacacgatagtctgagctggagcagagtatggaagtggcagctcaagagattgggctgccaagggcccaatgttactgggcgtgaaagcagttatcgccaagagctttgagagaatccatcgaagtaatctggttggtatgggaatcattcctctttgtttcaagcctggtgaggacgctgattttttaggattaactggccatgaacgttattcaattgaccttccaaataaaatcagtgagataaggcccagccaagatgttacagtcacaactgacactggcaagtcgttcacgtgtactgttcgcttcgatactgaggtggaattggcatactttgatcacggtggcattcttccatttgttatccgcaacctaaacaaagagtagacaatttgggttcaagttagtagtctcttcactttgctatctgctttgattggttttgacagtc

SEQ ID NO: 5226 - DNA, 522 bp, Gossypium hirsutum
  Clone ID: uC-gsronu33B168g10b1
tttttctttccttttcagctgtctcggcatttggacaggatgaggaagaccaagggcttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctctcaaaactggaagaagagacggtagaaggagcagagcagatgttgtggaggagtatcttccggaccacaatgagaccatctctggcgttcttgacaggtttgccgccatgggtattg

SEQ ID NO: 5227 - DNA, 464 bp, Gossypium hirsutum
  Clone ID: uC-gsronu33B168g11b1
ttttacactcccccttcagatatcttcattttgatcttcttcctctttctttcggttctttgatttcttcaaatactgccctttcattttccttagttcttgttaaaaagaaaatgtgtgggattttagctgttttgggctgttctgatgattctcaggcaaaaagggttcgggtgctggaactttcccgtaggctcaagcaccgtggtcctgactggagtggcctctaccaacatggagactgttatttggcccatcaacgccttgccatcattgatcctgcttccggtgaccaacctctctttaatgaagacaagtctattgttgtcactgtcaatggagagatttacaaccatgaagaactaaggaagaagttggcccaccacaagttcaggactggcagtgactgcgatgttatttcccatctgtatgaggaggatggtgaagacttttgggacatgtta

SEQ ID NO: 5228 - DNA, 406 bp, Gossypium hirsutum
  Clone ID: uC-gsronu33B168g12b1
ctctttcgtccggaataaaatggatgaaatactggggcatcttgagaagctgaaggagatcatcagtgcatcaggatatcaagaaaaagttccatctcacattcaagaagagaatgcaacaaagctggcaaaacttctccaagaatttgagtttttcaagaaagaaagcgatcgtttagaatctgaatcgcagcatcaaaagtaaggttaacccctcccttttgagtttctcgattcgaatgataatttgaatggcattacactatctcttcttttttatgattgttttgttactgtctaaacctcaccaatacttttgtttatttttaacatttgatgcttgccatgtttgtcatacaagagtttacccagctagttaatcgtatgaaaatttcccactttgctt

SEQ ID NO: 5229 - DNA, 412 bp, Gossypium hirsutum
  Clone ID: uC-gsronu33B168h02b1
aaaacacgcacccaaaaaagaaaaccttttgaaaaccaaagaaggaagaagaagatgtcgtggcaagcttatgtagatgatcacttgatgtgtgaaatcgaaggaaaccatctctctgccgccgctatcatcggccaggacggcagcgtttgggcccaaagcgccagtttccctcagctcaagcctgaagaaattagtgccatcatgaatgactttaatgaaccgggttcactcgctccgaccgggttgcacctcggtggcacaaaatacatggtgatccaaggcgaaccgggagctgttatccgagggaagaagggacccggaggtgttactgttaagaagaccaatatggccttgattatcggaatctatgatgaccaatgacaccccgccaatgaacatgatcgtccag

SEQ ID NO: 5230 - DNA, 533 bp, Gossypium hirsutum
  unsure (1)..(533): unsure at all n locations
  Clone ID: uC-gsronu33B168h04b1
cccattcttccgttctcttctctttgaaaaatccggggggaattttccaaagggaaacttttgctcgtaatattctcagatctgctctcaaatcgtcacattttgaatagccaatatgggaggcgggttcagagtacttcatttggttagaccatttctttcgtttctgcctgaagttcagagtgctgataggaaaatcccttttagagagaaggtcatctatactgtgatatccctctttattttcctggtttgcagtcagcttcccctttatggaatacattctacgacgggcgctgatccgttttattggatgcgtgttatccttgcatccaaccgtggaaccgttatggaacttgggattacccccattgttacttccggtttggtgatgcaactcttggctggttcaaagatcatcgaggttgacaacagtgttcgtgaggatcgtgcactcttaaatggggctcaaaagctgttggggatcctaatngcttgtggtgaggcagtggcgtacgttctgtctggtatgt

SEQ ID NO: 5231 - DNA, 545 bp, Gossypium hirsutum
  Clone ID: uC-gsronu33B168h05b1
cttgctgagcctttgaagcagctttctgaaactcctgatacttttgaggattttgtttctgagaatctgaaagagtttcaagactggagtgaatactactcctgtgatgcaacgtatcgcaactggctcaaaattgaattagcgaatgcagaagtttctcccgacgaactttcggtagaggaaaaacaaagagcaataatggcagccaaagagacgttggatttatcttttttattgctactgagggaaagaaacccatggcttatttcttgggtggaacatattagtgaatcgatggaacctctatttcttgaattgcattctactgcaatgctccgcctcccttctggtgaatccatgtgtccagacgctactgtttgtgctgcattaatgagtgcactttactcttctgcaactgaggaagttgtctcagaaagacagttaacagtaaatgttgccatttcttcaaaagacagctacagcattgaggtaatgttgcgctgcttggcagtggagggtgatggaattggtccacacatcctcaa

SEQ ID NO: 5232 - DNA, 385 bp, Gossypium hirsutum
  Clone ID: uC-gsronu33B168h07b1
ttctttagtttccttccgctaccttctctcaacccggacacatatttcccaggaaaaggaaaaagcttgagccaaaagaaaatggccgatcagcttaccgacgatcagatctctgaattcaaggaggcctttagcctgttcgacaaggacggagatggttgcattactaccaaggagttgggaactgtgatgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcaggggtgtttgacaaggatcagaatgggttcata

SEQ ID NO: 5233 - DNA, 410 bp, Gossypium hirsutum
  Clone ID: uC-gsronu33B168h08b1
ttgtttcacctatggaatgagcgaatcctacactacttacggttaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggcggcaaactgtcaggccaaggcaacgggttcctgaagccccaagcatacggccctgggagaagcatggcctacggaatgaccgaaaccgaaagttgccgagtaccgcagcgaagtatactttttcaacgagtcacactacaac

SEQ ID NO: 5234 - DNA, 461 bp, Gossypium hirsutum
  Clone ID: uC-gsronu33B168h09b1
taatttaaaaaaaaaacagtgagatctgctacgagcggattcttaaatggagtatcgcaaaatcaaagatgaggataatgatggaggaacagtaagtaatgacattgagaatctacgaggcatagggttttcgggggttgcttctgtaagtaatgttcctccaagggaacaggccaagtggaaacgcaagacagttgttacagttgcattgacttttcttacaagttcacaagcaatacttattgtctggtcaaagagagctaggaagtttgtgaataaaagtaaaagaacccttgttttgtgttggttttcagactcaaaggagtgtggtctcttaacggatgctttagccatttatagtaagctgtcttttgctgaatgcttaattttggtgctttacttcctggtaaggggtctcatgattcatgaatgcttcaagccattttcatggttaattgtgc

SEQ ID NO: 5235 - DNA, 539 bp, Gossypium hirsutum
  Clone ID: uC-gsronu33B168h11b1
tttatgcgtccgagttgaagaaggtgctatcggggggaagttgttgtgcgctcatggtgatgctcgcttaggttatttcaattggtcaggaatccaatgcagttgtggaagctggattacccctgcctttcagctgcacaagtcccgagtcgatatcagcaccgtgtagtatcgttatccgccatagctctaaactgaatcactcgccggctcccggccagtgtttctaataagaactatataggattggaatttcccttgcacaaaaagtctatgagatgttcatatatggaccaacaattatgtaagagaaaaaaaaaaacaaaaaaaacaatgagttgttcaaaactttaaagtttgagggactgtctgaataatttgagagattgcattgatgtgcagtctttgcattgtggtgcacagttgaattaatattttataatggtttagacattatatgttttgtcttattattagactcgtccattcgttggatcggacctaaaattgatctaacctaaaaaatccatttttataac

SEQ ID NO: 5236 - DNA, 533 bp, Gossypium hirsutum
  Clone ID: uC-gsronu33B168h12b1
gaagttgttactggaaggaagcaggggggagacaaatccacagtagagagcggaaacaaatcacgaaatagcactaagaggtcactcgatgggcagccgagaaacaatcctaagatagctgataatagttacgaggaggatgaagaagagcagggcgataccttttgtgggatctgcgggggaggatacaattccgatgagttttggattggttgtgacaactgtgaacggtggtaccatggaaagtgtgtgaagataacaccagcgaaggcagaaatgattaagttttacaactgtcctttgtgccaaaagaaggtaaggcaatagccgtcaatggagggattaaccccgattggttttattcaccgatgttgttgtaaagcagctatgggcaaatgagtgcgtaattctgttgttactggcctatcctccctagaatcgcaagccagtcgctttggtgctttaggtacatgaataacatgtagtggcatacaaaatgaatgatgcataggctttacgtttgtgttcggttt

SEQ ID NO: 5237 - DNA, 471 bp, Gossypium hirsutum
  Clone ID: uC-gsronu33B169a01b1
gcgtcgttcgcccttttttttttttttttttttaaaccaaaatatagagtacattgtttgattaaaattgaaaacatggttcatatttatccattgcaatgttcagatgttcaataacatgcaaaagatatatatatatagtctaatgacagcttcaagtttatctaagcaaatacatatatcacccaaaacttcccacagaaactcaaatttaagtactaacaagttcataaaacaagttaaacgaaagattacatcaagggaaaaagacaatcaagacaagtaactataccggtactcgtatttaatcgaactcacaaagcgataaccgcgtgtcgtttgtgcttgaggaatgtctgaaaatctttataaccactcctgtaatggtccagactgaaagtaagctgtcttattacctctcttttctcttcagacacatctaagatcatgttcctttgcttatccactttc

SEQ ID NO: 5238 - DNA, 486 bp, Gossypium hirsutum
  Clone ID: uC-gsronu33B169a03b1
ctgataattctctatcgattcagcctcggagattggaaataaatattaaactaagaagagttctttgtatactacatgtgccgtggaatcccatagtttgcactgctttttatgctattaactactaacctcaccgtccatctccgttaccatctataaaaaaaactgttctactactcttcctttgttaattcataagaggaaatgggtgaggaagttaagcaggaacaacaacctccagcagaggagaaaacagaagacaaggtggaggagaagcctgccgaagaaaataaggaagaaacgccaccaccgccaccggcttcaccacctacttttgtattgaatgtggacttgcattgtgttggatgtgcaaagaagattgaaaaaaccatcatgaagatcagaggtgtggaaggagttgagatcgacatggctaaaactcagttactataaaaggaatgatcgaactcccagctatatgtgctt

SEQ ID NO: 5239 - DNA, 498 bp, Gossypium hirsutum
  unsure (1)..(498): unsure at all n locations
  Clone ID: uC-gsronu33B169a04b1
atcttgattgaaaggatccaagcatctttatccgccatggaggagaagaaaacaatcatctacatgggggatggactgggtgatttctgccccagtttgaagcttggagatggagactatatgttgccaaggaaagatttcccagtttgggacttggtttgcaaaaacaggagcctaataaaagctgaagtttgcgaatggagcaatggggaggagtttgagcatgctttactccacttcatcaccaagattaccattgacaaaagcaacactaatggcaacaatgctgctcagctatattcagattgcaaagtacagacaatgccaggctcttcccatcaagccttttcccaaaccctttatgttcctcattagaatgcaaaacttgctgaggttaaaaataaaacatagctgatgcccttggncttgctattcttttattgaaataacatttgtataattgtattagtttcaaaatgtaccagaattatatttaac

SEQ ID NO: 5240 - DNA, 542 bp, Gossypium hirsutum
  unsure (1)..(542): unsure at all n locations
  Clone ID: uC-gsronu33B169a05b1
gaagtgcacaagaaaaaggtggacgcaaagaacgcgttggagaactacgcatacaacatgaggaacacagtgaaggatgagaagattggtgccaaacttgctgcagcagataagaagaaggttgaagatgcaattgacgaggccatccaatggttagacaacaaccagcttgcagagtcagatgaatttgaagacaagatgaaggaattggagagcatctgcaaccccatcattgccaaaatgtaccaaggcgctggagctgacatgggtggcatggatgaggatgccccagctagtggaaccggcgcaggccccaagattgaggaagtggactaagaaatttctctccattcttttcgacccttacatttgttcctttagtcgtttcatgttggtttcttttttattggactttagacatgtttttgaggattttgtttgaagccaatttttgagtattttagttattggacacattgaactctggtgttattgccgggtacctnctttgttatacaaattttccattggttttccttttg

SEQ ID NO: 5241 - DNA, 549 bp, Gossypium hirsutum
  Clone ID: uC-gsronu33B169a07b1
actaacaagccctctttttacaaccatcacttccatgttgtgacagagaagaaaataaaacaatccatttctccaatgggtttgcctagaaaatccccttctttgctctctgtatctttggtttcaatcacaatctttttggggtcctttccttttgttgctacagctgcagattatactaacctggtgtttaagggctgtgctgaccagaaatttcaagacccatctgggctttacttacagaacctcaaaaatctaatgcaagatttggtttcacaatcatcacagagaactttctccaccgcagcctctggtgaagaccctaatgcaatcaatggactttatcaatgcagaggggacctatcgacaagccagtgttacagctgtgtgagcaagatcccgaaaataagtgataaagtttgtgggaaagcagtagcagccagggtccagctgagtggatgttacttaaggtacgagatatctgggttcaaacaggttccagaaacagagtttttgtacaaggtatgtgggtcgtcatcaagtggaaga

SEQ ID NO: 5242 - DNA, 466 bp, Gossypium hirsutum
  Clone ID: uC-gsronu33B169a08b1
tataatttcactgcgagattcatatcgggtttcaactcttttcctccaatttgcacttgaagtgatggataccggatcaaaggtgaagaaaggagccggaggaaggaaaggcggcggtccaaagaagaaaccggtttctcgttcagtgaaagccggattacagtttcccgtcggtcgaattggccggtacttgaagaaagggcgatactctcaacgtgtgggaacgggtgctccagtttaccttgctgctgttcttgaatacctagctgctgaggttcttgagttagctggcaatgctgcaagagacaacaagaagaataggatcattccaaggcatgttctattggcagtgaggaacgatgaagaacttgggaagcttttagctggtgtgaccattgctcatggtggtgttttgcccaatattaacccagttcttttaccaaaagaaaacgaaaaggtggcgacc

SEQ ID NO: 5243 - DNA, 529 bp, Gossypium hirsutum
  Clone ID: uC-gsronu33B169a09b1
cctctcgtccgcttgttcccatcattggtggttgcgctcttgctgccgtaactgaactcaactttaatatgaccggttttatgggagctatgatatcaaacttggcatttgtcttccgtaatatattctccaagaagggcatgaaaggaaactccgttagtgggatgaactactatgcttgtctatctatgttgtctcttgtaatactcacacctttcgcgattgctgtagaaggaccgcagatgtgggcagcaggatgggaaaaggccttatcccaaattggaccacagttcatctggtgggtggcggcccaaagtattttctatcatctctacaatcaagtctcgtacatgtccctcgatcagatctctcccttgacatttagcatcggcaacaccatgaaacgtatatctgttatagtctcatccatcatcatcttccacacgcctgtccaacctgtcaatgctgtcggagctgctattgctatccttggaaccttctgtattctcaggcaaaggcatgagaaaac

SEQ ID NO: 5244 - DNA, 289 bp, Gossypium hirsutum
  unsure (1)..(289): unsure at all n locations
  Clone ID: uC-gsronu33B169a12b1
gatcatcgcacgatgagagcccacggtggaggtgcagaaaagaagaaataaagctttattttcttggtttcttactgttgtcgtgctcgagtttcttgtttaggagcagctagaggtttgtttagcatatgtttcatttttgttgttttgagactgaaatcagtgctttggaacttttgtttatttgagttagagatgagaaattggaagaagtaataacttttaaattttatgtttcttgaattatatttaacgccattactattctacgtgcaaattttgggtnnaa

SEQ ID NO: 5245 - DNA, 51 bp, Gossypium hirsutum
  Clone ID: uC-gsronu33B169b01b1
cccattcttccgcttttaacactttaaagattaatatgttccaatctggtt

SEQ ID NO: 5246 - DNA, 521 bp, Gossypium hirsutum
  Clone ID: uC-gsronu33B169b02b1
ggttgttcgagtaattgaaaaagaggagagtttacctcctgcattattgggaagttgcaatgatcgcgctaaacgacttcatgcttctccttctggaagattgttaactgcactagtgtgtgagtacttagactgggcgcaactaaaccacactctaaaagtgtaccagccagaatgcaatttgcaaaaagactcctggaaagctgagttgaaagactttagcgtcaaaaatggttatgaccttaacagaaatggagataatcctgtccttatggatgttcttgattgcttcttgaagtttgagaacttaacccaagcaagaggaagtggaaggagatcacaagaaattgagtcctcgtctagttcagagtctcgtaacacaagaagaccctcatcatctactgttgctgggggcttgcctccattgggaaggccggtccctgctcgcagtcgtctgataggagagcaggctcctccatgtctggttacaggaaagaagagtatagttggagatatgatga

SEQ ID NO: 5247 - DNA, 436 bp, Gossypium hirsutum
  Clone ID: uC-gsronu33B169b05b1
ctctcgtgtccgcacgatcaaaaaattcagagatgcattagtcaaacacacaccagaccggtgcagcctcagcacgacaaaagggctcgaggagaaggagcttttggcattatccgcgaacaaagacctttccttcaactacacaccaattcgcacacatgaagagattcttatttggaaacaagctccatctgattcaacgagaaagctcccgctttcagtcccgacaacatccgcaaaacaaagggacagtgaggagaaaactttggttggtgtcggaagatgatgtagttaggttttctgccatttccattgcccagtgtacattcttacagtataattggaggtgcagggcagtttggatttattttttggatcctagcccttgatgaatcaagggtaagtttgaagaccaaaactagtgtgtatatttttg

SEQ ID NO: 5248 - DNA, 526 bp, Gossypium hirsutum
  Clone ID: uC-gsronu33B169b06b1
ggattataggatccaacctttcttagagctaaccattgttttgcaatgtagaatgctgtaattcattctgcttgtgtttcaatttgttagttgttcatctactaatgagtttcttgctgtaacatatgcagggctatggataatcaggtatggttccaaatgtttccccttttcttaaattgaccagtgtaatggtatgctgtaatgtttggtttagtagaaaaaattgtcctagtactattgaggcagttaaaaattatgtagattctgtcacggtattgtcaaaactagaatgcaatggtctaatgccgttcttctgttttattaagctctgaaatacttgtttataattcatgtgccaatgtcaccgtggatactgaatggtaaaagtgaagttgattcatcagaacaggaaacttgagatccttaagagctctttgttgtctataacatgaagatctgactgcttatagaattgctctcttttttggttctttaaatgacagttatatgttgcaccttgttc

SEQ ID NO: 5249 - DNA, 430 bp, Gossypium hirsutum
  unsure (1)..(430): unsure at all n locations
  Clone ID: uC-gsronu33B169b08b1
ttttatggctacccttaaccttaatgccatgaacaagctccagaccaagaaaccatggtcactctcattctcatttggacgtgcccttcagcagagcactctcaaggcctgngctggaaaggaggaaaacgtgaagaaagcacaagatgctttccttgttaggtgcaaggctaactcggaggccaccttgggtacatacaagggtgacgcaaagattagtgagggtgctgcagagagccttcatgttaaggactacaaatactaagaatttagtcttgtggtctgtgtatcagagaaattttctgtattgatgattttgggggttttccgtttcttctcatggaatttaggttgtgaaatcagaccgtttcttctcatggaatttaggttgtgaaatcagactcaaataagcttggggggccttagttct

SEQ ID NO: 5250 - DNA, 540 bp, Gossypium hirsutum
  Clone ID: uC-gsronu33B169b09b1
catatatctattgttttcaaatatatttgggttttcaacccttctctgttcaattgtttcttccattttgtttgacgatggtttgcttggtttctcgtacgggaaggcacttgcagcgatacaatgccctcggccgccgccaagttgtcggatgcattccgtacagatacaaacgtaatagtgatggaactctgagcactgacttggaggttcttgtcatctcctcacaaaaatgtcaaaaaatgatgttccctaagggcggttgggaacttgatgaatctaaagaacaagctgctttaagagagtcagttgaagaagctggagttagaggcaacgttgagtgcgaattaggcaaatgggactttatgagcaaacgctatggcacgttttatgaaggttacatgttccctttgcttgtgaaggaggaacttgccctctggcctgagcaaaatgtgcgacaacggacatggatgagtgtgaaggaagccagggatgtgtgccagcattggtggatgaaggaagcctttgacatactggttg

SEQ ID NO: 5251 - DNA, 392 bp, Gossypium hirsutum
  Clone ID: uC-gsronu33B169b10b1
ataatccgccgacaagtcgtagaacgggagcgagagttgtaggggagacatgctaggatgggcgagcatgcgaagcagacactatagcatcgggaggactaatagtaagcgatagaaagtgggaaaacattgattacatgggcaaaaacatgtactgacgtagagcagtaactgtggatgacacagaggtttgaactgatatggtcagttcaaagatgcaggtacacagctatcatactagcagagagtccagcggagtgacaaaagggacccttcttaagagacaccattaaaactaccaagggtatgggttagctgcattgggactaggaggcgtgcaagtgactgagcctcagttgcatactatatatccccatgggttaactgacaca

SEQ ID NO: 5252 - DNA, 358 bp, Gossypium hirsutum
  Clone ID: uC-gsronu33B169b11b1
atgaagcaaactggggagaggacggctattacaaaatatgcaccgggcgcactgactgtggcgtgcactccatggtctcaagtgtggcggcatcgcatacaaagtctcagtcccatagcccacgacatgactgatgtaaggaacaggactattcccatccatcactatgtcttaactatggatctatgccatctgctaaaacgggctaataccaatcctgggatatgcatccacctcaaaaaggctgcatgtagtagctttagaattctaatttcagcatatgaacctcttttttcttgggcaatgatactcattgtaccaaataaaagggtgtgcatgctagagatgattattactt

SEQ ID NO: 5253 - DNA, 573 bp, Gossypium hirsutum
  Clone ID: uC-gsronu33B169b12b1
atcatgcgtccgaaaaatcaagaggattcttggtgaagtgaagcaggcagtctctctaccacctgttccttcaaagaagcctgctgcccagccaaaagaaactaaaccaaaggctgaaccaaagaaagaagccaaaaaggaggttgagaaacaggcagcaaaggcagaggccgctgaggaggaggaggcaccaaagcccaaaccaaagaatcctcttgatttgctgcctccaagtaagatggtactggatgactggaaaaggctttactctaacacgaagaccaatttccgagaggttgcgattaaaggattctgggacatgtatgatcccgagggatactcactgtggttttgtgactacaagtacaatgaggagaatacagtttcatttgtcacaatgaacaaggttggaggattcctgcagagaatggatttggcccgcaagtatgcatttgggaagatgttggagatcggagctaaccctacattcaaggtgaaaggatatggcttttccgtgggcaagagaatccttaaattgtgattgacgagtgctatgacatggaactctacgag

SEQ ID NO: 5254 - DNA, 397 bp, Gossypium hirsutum
  Clone ID: uC-gsronu33B169c01b1
ctgtctgtggggcgtcgcatggattttgtccccgatgaatcggccatcaaggtcgaccaaatcgaagttgataaggaaacacttgatatgctttcggttattggaatgggtgatattcccggccttgttaaggttgacccggttgctgtttcggttcctcaagttgggttcggtcgcggtggtggacccgggaggaggttttgagtggtgggtctacatggatttaatgggtttcatgggttttttttttaagcttctatgtttttttgttctgttttggggtaatttctaattttgtgttttttatggaacaatactagttaagtggaactgaaattttatcaattgtgatgtgtactttatttttgaagaaatttgaaatgggttattttagttt

SEQ ID NO: 5255 - DNA, 525 bp, Gossypium hirsutum
  unsure (1)..(525): unsure at all n locations
  Clone ID: uC-gsronu33B169c02b1
aatatcntaagctattgaagaagaatggcaagttcctccattatttttctcttgctttcccttctatgcattgtttgcgaggccagatctccaactgctgcaagatcaggtgcctcaaatttcatcaaggcttcatgtagtgccaccaaatatccatcactttgcatccaatctctcgcagcttttgccccttcaatccagcggagcccacgccaactggctcagactgccctttcggtgagcctagagagggcaaagtccacccaggcattcgtctccaaaatgaagaaattcaggggacttaagaggagggaatatgaagcaatcaaagattgcattgaggagatgagcgagagcgtggacaggctgagcaaatcagtgcaagagctcaagtacatgggtcaagccaagggtcaggatttcttgtggcacgttagcaatgtggagacctgggttagtgctgcactaaccgatgagaacacttgtgtggatgggttcgcaggaagggctttggatggtaagatt

SEQ ID NO: 5256 - DNA, 497 bp, Gossypium hirsutum
  Clone ID: uC-gsronu33B169c03b1
gtattattcctcctcaactttgctcccattaaaccacagccacaaccagctcaaaaaccccatcttttttcctccattaaagcttaaagcttgagttttttgagctgttcagccatggaaggaacctcattttcaaagcttttacttgcattttgcttagctttgttctatttgagtcctcagcttgttcaaaccagtgttacttatgataagaaagctatagttatcaatggtcaaagaagaatccttttctctggttctattcattatcccagaagcacacctgatatgtgggaagatctgattcagaaagctaaagatggtggacttgatgtgattgagacttatgttttttggaatgtccatgaaccatctcctggaaattataattttgaaggaagatatgaccttgtgagattcataaaacagtacaaaaagcaggtctttatgctcatcttcgtattggaccttatgtttgtgcttgatggaacctttga

SEQ ID NO: 5257 - DNA, 458 bp, Gossypium hirsutum
  Clone ID: uC-gsronu33B169c06b1
caatttgtaatctcacgaaagtgtacggcattctagttgaaataatttcttcctgggttgcttcctgtcacaaaaaatggggttctggacattggtagaaggattgctgctatttgccaatgcattagcaatactgaatgaagatagattccttggtccaagaagatggactttagcagaatttcaaggaggaagaaacactctcaaggggcagatagttgggctcatacatgcatgtcaattcctcagactaccacttatccttttcaatatcatcactattgtagtaaagttagtctctggttgagatcaacatgaagaataaattcatggcttgtgacatgaatgaattaatccatacatactctgatgatatgttaataagctgtttttgccacctgtgtgtgtacgatactcgaaatgacagaataagagaatggttcatatgcttgtaaaaa

SEQ ID NO: 5258 - DNA, 535 bp, Gossypium hirsutum
  unsure (1)..(535): unsure at all n locations
  Clone ID: uC-gsronu33B169c07b1
ttcttgcgtccgcccacgcgtccgcaccaggcaaatctgcctgctcgtcgtcactccactcctcttccttgaatggggctccgtattgggaaccatttcttgggcccagaccatccttcttgaaaacaacataaagcatatacatatcttgaacaggccctctgtcagccaatattttttcttcaagcctatactcatgcataacccagtctgttcggtcaccacgtggagctttacctttgtgaaataccaaggttttgatcattccaacaacttcgtcattgtacttcacgggccgatcctttcccgtggctttccagtagccgaatatagtagctcgattcaccctatcccctctagcatatttcttctcgatgggacaatagaagtaccatttaagatccccagtcttcatacaggacatatcaagcaagtcccagggagcaaacttataaacatcaactttagcaatcacattcaacaagagcttttggcctaatacttttcttttcaaatatacataacangttctaca

SEQ ID NO: 5259 - DNA, 521 bp, Gossypium hirsutum
  Clone ID: uC-gsronu33B169c08b1
agtatgcaacaacatcgaaaaccctcctcatgttttggctactcgtcacctgcattgctgcagtttcattgggatcagcagtggaaacccaaggttttgggggatgcctcatgtcgttcgcaagtgtaaaaggttgcgttgaggcaatccacgaggttgtttcgcacgagaagttcgatgcactccaacctaaatgctgcaaagcaatcatcaagctgggcgacaattgttggccaattgtttttcccaatcaaccttgccttcctgtcttactcaagaccgtttgtaaggttttagggatggttgtgaaagttgagaatgttgcagcagcaccttgatagtttgcgctgttgagattttaacttccttggattaagagataacacagctctattcgttcttttagtctttcaaatcttaaagaacaagtattctttttactagtttgccacatcgccatttttctattatcccaatacattagtatatataaagttaaggaggttagacattttatagag

SEQ ID NO: 5260 - DNA, 447 bp, Gossypium hirsutum
  Clone ID: uC-gsronu33B169c10b1
atcatgcgtccgcttccttttcttttgtctctctttcttcccctgtcagctattgagatcgcgtttcactcagttctggaaaaaagatggggattattgagaggattaaagaaatcgaagccgagatggctcgaacccagaaaaataaggccacagaataccatctcggtcagctcaaagcaaagattgctaagctaaggacacaattactcgagccaccgaaaggttctagtggaggtggagacggttttgaagttacaaaatttggtcatggacgtgttgcactaataggatttccgagtgtggggaaatctacccttttgactatgttaactggaactcattcagaagctgcatcttatgagtttacaacacttacatgcattcctggtatcatacattacaatgatactaagattcaactgctcgatctttctggaattattg

SEQ ID NO: 5261 - DNA, 563 bp, Gossypium hirsutum
  Clone ID: uC-gsronu33B169c12b1
gtaatcttgacctggcagtttcaaaatgcgtcgctatgatgatcgttattgtcatactcgtctctatgttggccatatctcctcaagaacccgaacacgtgatctagaacgtctctttagccgatacgggagaatacttgatgtggatatgaagcgtgactatgcctttgttgactttagcgatccccgagatgctgatgatgcaaggtatagcttggatggtcgggactttgatggaagccgcattgttgttgagtttgcaaggggggtgccacgaggttctcaggaatatctaggaagaggcccccctcctggatctggtcgctgctttaattgtggtgttgatggccattgggccagagattgtacagctgaggactggaagaacaaatgttatcgttgtggagaaagaggtcacatagaacgaaactgcaggaacagtccccgaaaactgagttctcgttcacctattagatctcgctcacctcgccgtggcagaagccggggtcgaagttacagtcgtggcctgagctactctcgttcaagatctttcggtaggagag

SEQ ID NO: 5262 - DNA, 92 bp, Gossypium hirsutum
  Clone ID: uC-gsronu33B169d03b1
tgaatggtcattcggccgtgtatcttttttgctttttatgcgttgtcataaaccttgaactatgtattgaagatgagtgatcaagttatttt

SEQ ID NO: 5263 - DNA, 402 bp, Gossypium hirsutum
  Clone ID: uC-gsronu33B169d04b1
gtattctaactctgctatccgaaaatgtgctcgtgttcagttgatcaagaatggaaagaaaattgctgcttttgtacccaatgacggttgcttaaactacattgaggaaaatgatgaggtattgattgctggatttggacgaaaggggcatgctgtgggagatattcccggagttcggttcaaggttgttaaggtttcgggtgtgtctcttctagctcttttcaaagagaagaaggagaagccaaggtcttaaaagaatatgacttttaatggttcacttaatatttgttatttatataaaaacctagtgtttgggattttgtaatgaaggattttagatatccaaatcaaactgtgttctgtttttggtttcaaatctaaaattttgtttggtcgatcatt

SEQ ID NO: 5264 - DNA, 367 bp, Gossypium hirsutum
  Clone ID: uC-gsronu33B169d05b1
gaataataaggtgaaagggcttctatactgcaatttgtgatggtggatgtgtggtggtcccttcttggggctgccatcccggctgtaattgcagggcaagcttttagaatgaagaaaaagcatgccgaagaagagagaattaagagtgccaggggaagggagaagacctcggatgatatcttcgattgcgagagagtctgtacatcaaagcgaatgttgaaaaaagttggggcattttcaaaggatccaattcctgatacttgtgtaactgcctgcggcgcgtcagagatagatgcttgctctgatgcttgtgctcggaccgattgtgttaaccaacatcaggcacccaactggaatgacatttgcc

SEQ ID NO: 5265 - DNA, 554 bp, Gossypium hirsutum
  Clone ID: uC-gsronu33B169d06b1
ctctcgtgtccggaacttcgtttcatctgcttcatttgtttcgaaatctttgaacaaaaatggcctctttcaattgctttgctttagcattcttgattgctttgtcatttgcaggcattgatgttggggtagcagctcgtcaccttctgcagcagcctcgaacgcaaagtttaccatctttccctaatctcccaacgccatcccgaccatcattctcatggcctggggcgcttcctccacttcctaccacattcccaacaggactgccccctctgccaagcattccctcagtcccaacaatcccaactgcaattccccctattcctttctcttttccgccattgccatctttccctaatctcccaaaccctggggcgcttcctccacttcctaccacattgccaagaggactgccgcctctgccaagcattccctccatcccaactgcagttccctctattccttccttttctccaccaccttttcgttctattccttgaaatacccccttttcttggatgctgcatactggatctggtttaataatgttttta

SEQ ID NO: 5266 - DNA, 526 bp, Gossypium hirsutum
  Clone ID: uC-gsronu33B169d07b1
ataatcttggggttttttttccctttccaactctaactcatatctttgactgctcaacaaatacaggcagtttgtgctgctggaaatcgctttgttgccatcatgctcaagcaaattctaagcaaactcccacggaagtcgcaaaaatctgattctttagattcagctggacttgattcaggcaatcatacttcaaactcgagcaatggagttcaatgtacgaatattgggaatagtataacaagtcgactaagtgttgttaaacgggtgtcgtcagctgtttttcctgctagtatcatggctggagtggaggcagtggagccgaatctatcattcaaggatgtttcaaatccgcagaagcagaacttgtttatcagtaaattgaacctgtgttgtgaggtttccgattttagcgatcccaaaaaggcttcttctgagcaagatcttaaacgccaaacattgatagaacttgtcgatttcgttttctccgggtctgcaaagttcaacgaacagcagtggctgcaat

SEQ ID NO: 5267 - DNA, 542 bp, Gossypium hirsutum
  Clone ID: uC-gsronu33B169d08b1
ttttggtgacacccaaaaaccttagctatctaaatccttttcttgctttacactctcccaacgttaaacccctcgtcttccctttcccttctcacccttccctccctcatggagtcgaacaaatgcaagatctccccatttcctttcttccccacattgttaacgccttgggaaaactctaccaccctttggttcaatggtttcgagcccaacaatcaccatccgtcgcgattctatctgatatagtgctcagttcttggactgttaacctcgcctcgcatctcaatatcccaaatatctgcttcgttcctttcaatgttgctgcagtttacttctggattagtacaccgagcttcctgttacccttttatagggaagcttttacgatgagtatgcaaagccaggggcttgttttcaactcgtttaaagagttggaaggtacaaaattgggtttaatcaaggagaaattcgctaaacattatagggtttggggtgtcggccctttgccgccggtgaaagtttgtgacgaagggttaaatgag

SEQ ID NO: 5268 - DNA, 100 bp, Gossypium hirsutum
  Clone ID: uC-gsronu33B169d09b1
gtggatttgctgtgattctaaaagggatttatcttgtttgtaaaaaatctcttacgattttgttggtaatgcaagagcaaaatgtgtgattcacctaact

SEQ ID NO: 5269 - DNA, 544 bp, Gossypium hirsutum
  Clone ID: uC-gsronu33B169d12b1
ttttctttcacttaaaattgttagcaagatcgaggcaggagaacggtttacagtttatgttgttgtccctatgtggccagaaggaatcccagagagtgcctcagttcaggcaatattagattggcagagaaggacgatggacatgatgtataaggatgtcattcaggctctcagagccaagggtagcgacgagaatcccagaaactatttaacatttttctgccttgggaaccgagaggttaagaagagtggagaatatgaaccttctgaaagaccagaccctgatacagattatgccagagctcaggaggcccgtcgtttcatgatctatgttcatgcaaaaatgatgattgttgatgatgaatacataataattgggtctgccaacatcaaccagcgatccatggatggtgctagagactctgaaatagccatgggagcctatcaaccatatcatttatcattaagggaaccagcacgaggtcaggtccatggtttccgtttgtcactgtggtatgagcaccttggcatgcttgatgacaca

SEQ ID NO: 5270 - DNA, 391 bp, Gossypium hirsutum
  Clone ID: uC-gsronu33B169e02b1
cccactcgtgcggcaggaagcacttcacaagagaactaaaatgttttatccttcaagacaaagactaacacttcccgtgccatcgggatcaagggagaggcctgtcgcccttaactacaagaagagtcttaaagactactgcgctcgaaatgacaacagcttaaccatagtgtgcagggacttgggtccacaagtggcgcatggaacactacccttcttcgaatacttgcgtcctttgatcctatatcctgtcgtcatactacttacctgaatacaagcactgtggataccaacaaaagcgcgccatccaccctgtttaaacataggctttatattactgtgtgtttgctgcatttgagcgaaatgagctacatgctcttatttccgagtg

SEQ ID NO: 5271 - DNA, 510 bp, Gossypium hirsutum
  Clone ID: uC-gsronu33B169e03b1
ataatcttctctttcacttgtaacacgtcttgatctttgaacttctttccttgtttagtgatggaaggtgagttagttttacttggcggtggtggtggtggcggcggcggtggttcttctggggtttctacaaatgaatcagcagtgttgtctaacgtggaggttgtttctgaggcatgttcatatccagctgagagtgagttggagttaggtctggggctgagccttggtggtgctacagggaaaactaagcctgccactgccacttcttcatggggtgagtgtggtagaatcttgactgcaaaggacttcccttctgtggtttctcatagaaccaaaaatggcggaccttctgtttctgtttctgggaccaaaagagctgctgaatctgtctcccatgagggtggatcccctacttgtatcagtggaagcagtcaagttgtgggatggccaccctaagagcttataggatgaacagcttggtgaacccaagcaaagtctcaaagagct

SEQ ID NO: 5272 - DNA, 552 bp, Gossypium hirsutum
  unsure (1)..(552): unsure at all n locations
  Clone ID: uC-gsronu33B169e05b1
ctcacgtgtccgcaaataccagaatggctatgcgatgtcttacagcgaacatgaacgccatagccaaatccgctgccccacctatggaatgagcgaatcctacactacttacggccaatctcatggcacccacaacggaaacgcaatgtcgaaaccccaatttcatggtcatgggaatggctacggcagccacatgagcaacgggatggctcacactcaagcatatggctctaaccatcacaacagccctggaaaacaccaaggccctgggtatggcagtggctttgggggctaccctcccaaaaaccatggaatgccgcatagcccaccgcaccacggtggcaaactgtcaggccaaggcaacgggttcctgaagccccaagcatacggccctgggagaagcatggcctacggaatgaccgaaaccaaagttgcgagtactcgagcgaagtatacttttccaacgagtcacactacaacgacngccgtggataccaccacgctggcaaaagtggccaccctgtcaagggtctgctaaggaaaataaagggt

SEQ ID NO: 5273 - DNA, 522 bp, Gossypium hirsutum
  Clone ID: uC-gsronu33B169e06b1
atatcttggatgtaatgaactctgttcttaaaggtgcaagtcttgcaggttatgatgctgacaccatcaacaaagccacttccctgaatatgattttagcaggcagtgacaccacaacagttactttaatatggggtctttccctaatgttaaacaaacctcatgtactcaaaaaggctcaagaagaactagacacccatattggcagggataggtttgtgaatgaaacagacattggaaaattggtgtacatccaagccatagttaaagagacattaagaatgtatccacctgcacccctttcagcgccccgtgagctcagtgaaagttgttccattggaggctatgacatccccaaaggcactcggttaattataaaccttcacaagatccaaagggatcctaaaaaatggccagaaccatcggaatttaagcccgagaggtttctcactacccacaaagatatcgatgttaagggtcagcattttgaattgatgccctttggtagtggtaggaggagct

SEQ ID NO: 5274 - DNA, 537 bp, Gossypium hirsutum
  Clone ID: uC-gsronu33B169e07b1
ctactcgtccgcccacgcgtccgggaactcataactcctcaaaagtcttcttcaatggcagctcgagttcttgttttggcttcaattcttattttctcttgttttgcagagacatgctatggggtgatctctttctcatcccttcaaagaacacttgttgttactgcttctcatagacaaggacttttgaaagccggggaagacaagatcacagtgagatggggattgaaccagagtttcccggccgggaccgactcgtcttataagaccatcaaggtccagctttgctatgcacccatcagccaagtcgaccgtgcatggcggaaaaccgaggaccatcttaacaaagacaagacatgccagttcaagatcgtcaagaaaccctacaccaacgtcaacgaaacccttgaatggaccatcgaacgagacgtgccgacggcgacgttctttatccgagcctacgcttttgactccgacgaccacgaggtggcgtacggtcaaaacaccgacgccgagaagaaaaccaatctgtttgaa

SEQ ID NO: 5275 - DNA, 441 bp, Gossypium hirsutum
  Clone ID: uC-gsronu33B169e08b1
ttattatcgcttgaaagtgcgcttaatggaaagaaattctttggtggagaaaccattggaatggtagatattgttgctagctctgttgggtatttcattagggtcactcaagaaattatggggctaaatctgctgtcagctgacaaatttccccaattattccaatggtctgaagatttcgcaaattgcagcattgttaaggaaagtttacctccaagagacaaactacttccctttgtcaaaggtctcattgccaaatatcagcaagataatgctaaggcctaagccctcccaatgaacgcctgtcacaatgattgtcgcatgcaatttgccttttttgtatttgctgcttttgtgtgtaatgagctacttgctcttattttcgagtgaaaaaataaattaactcattgtacccttaaataaaattgattattaagttat

SEQ ID NO: 5276 - DNA, 534 bp, Gossypium hirsutum
  unsure (1)..(534): unsure at all n locations
  Clone ID: uC-gsronu33B169e09b1
ctcttctctgccgaacactccgtgctttaaaatttaagttttttctgctaaaaagtcgctatgggtaaggagaaggttcacatcaacattgttgtcattggccatgtcgactctggaaagtcaacaacaactggtcacttgatctacaagcttggaggtattgacaagcgtgtgatcgagaggttcgagaaggaagctgctgagatgaacaaaaggtcattcaagtatgcctgggtgctcgataagttgaaggctgagcgtgagcgtggtatcaccattgatattgccttgtggaagtttgagacaaccaagtactactgcactgtcattgatgcttggacatcgtgacttcattaagaatatgattacgggtacttctcaagctgactgtgctngccttatcattgactccacaactggaggttntgaagctggtatttccaaggatgggcagacccgtgagcatgctctccttgccttcactcttggtgtcaagcaaatgatttgctgctgcaacaagattgatgccacaac

SEQ ID NO: 5277 - DNA, 543 bp, Gossypium hirsutum
  Clone ID: uC-gsronu33B169e10b1
gatactaaaatcccatcagtcaagaaataaaccatggcaacgaatgaagtaaaagttttgggttcctggccgagtccatatgcgatgaggccaaggattgcccttaacctcaaatccctcacttacgaatacattgaagagaagttatgggaaggcaaaagcgagcttcttctccaatcaaaccctgtttacaagaaaatcccagtcctcattcacggcgataacaagccaatctgcgaatctctcatcatcgtacaatacatcgacgaggcttggtcttccggtccttctattcttccttctgatccctgtgaacgtgctgtcgctcggttttgggctgcatatcttgacgacaagtggttcccagcggtgaaaagtataggagtcgctaaaggagaggaagcaaagaaagcagcaatagcgcaagtggaagcagggttggctttgatggaagaagcatacgacaagtgcagcaaagggaagggttactttggtgggatgaagttgggtaccttgaatagcttttgggagctttttgggatg

SEQ ID NO: 5278 - DNA, 316 bp, Gossypium hirsutum
  Clone ID: uC-gsronu33B169e12b1
cttggtcatgacacaggctggggtttcgagggccaaggctgtcaaggctctcaagagtaacaatggtgacattgtgagtgctattatggagcttaccacttaggcagtctctatcgtataagtcggccctggtcgactgtcaatgagtgtttcggaattagtatcaatgttttagttgttatagtcaaggtggctagatttttaccctcccatttgtttcgcttgtcattgagacagttttcttggaacttatgatcagtgtcactacgactgattgtttcctttgcccatttctataagcaaattttgcaactca

SEQ ID NO: 5279 - DNA, 527 bp, Gossypium hirsutum
  Clone ID: uC-gsronu33B169f04b1
gccaatgagctgaattatttcttcgctaagatcaaaggaggttggggatggcgcctgagtttgggtggcgcaacggaccctgcccttattatcaccgttggatccctagttctacctgacacaccaaactccatgatcgaacgtggtcaaaccgaggaagccagagccaaactcaagaaaatccgaggggttgatgatgttgatgaggagtttaaggacctagtcgctgccagtgatgcctcgaagcttgttcatcacccttggaccaacttgttgcagaggaaatacaggccccatctaaccatggccatcttaattcctttcttccaacaactaaccggcattaatgtcattatgttttatgcacctgtattgttcaacacaattggtttcggggacgatgctttcctcatgtccgcagtgatcacccggaattgtaacgtaggtgcaacaattggttcaatctatggtgttgataagtggggaaggaggttcctttttctagagggtggagttcaaatgttgat

SEQ ID NO: 5280 - DNA, 524 bp, Gossypium hirsutum
  Clone ID: uC-gsronu33B169f05b1
ctattatttcccgcttcttctagggttttacatataacaataattttctgaaactcttaccagaaacaagggtttgttatttattggcgggagctgaatccttaaaaataaatacaaataagagattgtttctttctattgagttctttaaaggaaagattcatggcgtattctcaagcacgagacttcatgttctgtaacttgtgtggtacgatgctgtctttggtttcacctaagattgctgaatgctctttgtgtagatctaaaactagtgctaaaggtattgtgggacgagaaatcggctacacactcactgttgaggatattcggagagaccttggcatctcacatgctgcggaagagatgacgacaaaagaatcagctgcgttgatcaagcagacttgtaaatcctgtggaaacgcaaagcttgagtacactacccgacaaatgagatcagcagatgaagggcagactgtattccttggatgcccgaagtgtaaaagaagggataccgaaaatgagtc

SEQ ID NO: 5281 - DNA, 550 bp, Gossypium hirsutum
  Clone ID: uC-gsronu33B169f06b1
ctgtatttcagctgttattaacattacaccataaaaatctttctttcaattcgggttctgagttgggttcgggttatatccaggaaacatgtcaatggggccaggggatcaaagcatcaaaggtataccaactcatggtggacgctatgttcagtacaacgtttatggtaacctcttcgaagttccctcaaaatatgttgctcctcttcgccccatcggccgtggtgcttatggtattgtctgtgctgctgtgaattcagagacacaggaggaggttgctatcaagaaaatcggtaatgcatttgacaatcggatcgatgccaaaaggacattgcgagagatcaagcttcttcgtcacatggatcacgaaaatgtggttgccatcaaggacatcatacggcctccacagtgggagaactttaatgatgtttacctcgtttatgaactgatggacactgatcttcatcaaattataagatccaatcaaccattgacagatgatcattgtcggtactttctatatcagattcttcgagggctcaaatatgta

SEQ ID NO: 5282 - DNA, 507 bp, Gossypium hirsutum
  Clone ID: uC-gsronu33B169f07b1
caggcgccgggccagtaattgccgggtcccacgcggccggctaaaatagctcgaaaaggcaaagcccctcttataaatcattccatattccccccccccccgccggcgatttccttaaaatattatttatttactttatcaaaaagaacccaaatcaatggcgcccgattccaagtcgagcaacgatcttttaattcacaattcctccggtctatctcctacaaacgtggatcccttcagctactcgaccagagaaaactccctttggaaacagtgtacttagatattcaagatgctacagattgatggaatgcaatccgggatatggtggttcgtggggtgcctgctatcgccattgcagcagctttttcgcttgctgtagaagtggccaactttaaggactttaatgggacatctgaggaagctgcttctttcattgaattgaaattggaatatcttgtctcaagtcgaccaacagctgtgaatctttctgatgctgctaaaagc

SEQ ID NO: 5283 - DNA, 286 bp, Gossypium hirsutum
  Clone ID: uC-gsronu33B169f08b1
tcctctcgtccggccgaatatctgcttcaacagctattttgtgcgaagaatatacatttaagggagggggaaacttttaagggagtagtagaaaatcatttggtttttgaagagcccttaaaagagcaaattgatgggctctatcaaatctgttgtgatctcattctaaatggggccaacagtagctactttctaaaaattgtggaattttatggatccacgcttggtatgtagccaagcccaagaaaaaaggaacgaggggaagaatcgacaaggaatccataac

SEQ ID NO: 5284 - DNA, 518 bp, Gossypium hirsutum
  Clone ID: uC-gsronu33B169f09b1
atactcgtccgtaaggacttgttatgaacttctacaaggattcttgtcctcaggctgaagacattatcaaggagcaagttaagctactgtacaagcgacacaaaaacactgctttttcttggctgagaaacattttccatgactgtgctgtccagtcatgtgatgcttcactgctgctggactccacaagaaggagcttgtctgagaaggagacagacaggagctttggcctaaggaatttcaggtacattgagaccatcaaagaagctgtagaaagggaatgtcctggagttgtttcttgtgctgatatccttgttctgtctgctagggaaggcatcgtttcgttgggaggcccttatattcctttcaaaactggaagatgagacggtagaaggagcagagcagatgttgtggaggagtatctttcggaccacaatgagaccatctctggcgtttttgacaggtttgccgccatgggtattgacacccctggagtcggtgcccttctaggagcttac

SEQ ID NO: 5285 - DNA, 445 bp, Gossypium hirsutum
  Clone ID: uC-gsronu33B169f10b1
ggtagtagcaaagatgatggccatactagctatgcccgttgaaagcaccttaccatcactagtactctacactaagattatgaattttcttaccgcaagtaataacaaaaataaggttaatttaggtaagaaaatcaaaatgctcaaaagcattgctagagattattgaagtcaaatgaatggctttaggaattgtatgaaatgaaattcatattctataccaaaaaaaaaaaaaataaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaataaaaaaaaatatatataagattaaaatatatattttttctttataaaaatatacggggggggggtttttataaaataaaattatat

SEQ ID NO: 5286 - DNA, 178 bp, Gossypium hirsutum
  Clone ID: uC-gsronu33B169f11b1
atgatgcgtgggtttttcttttgttttgttgtttgaaattgcggaaaattaggactcgttttaaacattagttgaatttttgtattgggttttgagaacttttgcagagattcaagaagttacatggttaatcttacttggtttaattgatattgccattgaaattgttctttgtttc

SEQ ID NO: 5287 - DNA, 541 bp, Gossypium hirsutum
  Clone ID: uC-gsronu33B169f12b1
tttataccaggaatccctcggtggagttcacaacctctttggtggcccaagtgttgttagcgtgtcgcagagtgatggtccatatagctttgcggttacgcgggcggcgcctggtccgtcatgtggggatgtcctccgagtgatgcagcacgagcccgagctaatgtttgagaccctcaagcaccgtgcggaagaattttgtggacaggaccatggcaatgaaggcacccatgctgctttagttagcaccattgctcgttctttccacaacatgccttatcttgtagtggcatccccttgttcgttgactgccatgaataacaatggcttctactattgcaatgaggaagattacaatgctgctgtcgattctggggctagtgaggacgagcagtggtcctattgctacgcctgaggcagtgttctactatttgctttattgcatggtttgccagtccttgaatgtctagttattttagttttttgttcctctttaatgttcttctttactgtaatttccatcgcttgaagcagtgattgt

SEQ ID NO: 5288 - DNA, 319 bp, Gossypium hirsutum
  Clone ID: uC-gsronu33B169g02b1
cctttgctaccgcccacgcgtccgagaagataaaggaattgctccttctgctattaatgccagctttttttaatctcaaaagatgtttattttggttgggagataaaaaaatttgatttttggtatttgttatgttgggctgctgggtttattggaactcatcccaatgttacagagatgttcaagtctttgaaaaagataaaataaaaataaatcagctattatgaggtttttcaataaaaaaaaaaaaaaaacacagtagaataaaaaagtgagaaaaaatataaaattaaatatcaaaaattattctaaataaagg

SEQ ID NO: 5289 - DNA, 504 bp, Gossypium hirsutum
  Clone ID: uC-gsronu33B169g03b1
accgccgcggcggaatcggggggacccacgcgtccgaggtcattgatttctgcgtaagaagatagacaccgctaaccgggagctgaaaccattgggacagagctgccagaagaaggaaagagagtacaaagaagctcttgaagccttcaatgacaagaacaaggagaaaacacaactagtcagcaaattaatggagctggtgagtgaaagcgagagattgaggaggaagaagctggaggagctgagcaaaagtattgaaacacttagctaaaaatggtgctgctgactaaaacaacatacatgatgtgctttgcgtgttgtaatttgactgattgtttcatatattttattgctttactatccatgtttttcaactggttcttcaattaggaaagtagccactgagcaggtgtcaccaaacatgtcaacttttatttgctcctcgtgtttctatctaactcaaccataataattttgtccaataaaattatatatatatatatt

SEQ ID NO: 5290 - DNA, 418 bp, Gossypium hirsutum
  Clone ID: uC-gsronu33B169g05b1
gtaatactcaaaaagatccctctccaacaatggcttctaatttcaaggtcttcttcgacatgaccgtcggtggccaaccagctggtcggattgtgatggagctctttgccgattgcactccccggactgctgagaacttccgtgctctctgcaccggcgagaaaggggtaggccgtagcggcaaacctctccactacaaaggctcatccttccaccgggtgatccccaatttcatgtgtcaaggaggcgactttaccgccggaaacggtaccggaggtgaatccatctatggagccaagttcgcggacgagaactttatcaagaagcacacgggacctggcatcctttccatggcgaacgctggacccgggacaaacggatctcaattcttcatctgcccgaccagacggagtggctt

SEQ ID NO: 5291 - DNA, 550 bp, Gossypium hirsutum
  Clone ID: uC-gsronu33B169g06b1
aaataatttaacatatatattataatctctatgttacttaaagaataatttaaaagaataatttaaagaatatattgtctcaaatatttttactcatagatagatattgatatacagcaaaagaactaatgaaattgttatattgtgtatatatatttttaacatattttcgttaatttatttatgctgctagacgtgtataatataaaaatttcatgtaaaagtaaaaatgaataatatagatttaaatttgtaatcacaaactctcatgcaacttcatttttacatgtgtcaaacttcacaaagaacattgattgaaagtatctattcacaaagaatagcattaaggttcctttaaaatattgaccgagagtattctatagaatcaaatatgataatacaagactattttaatataatatatattaatagaaaattattaaacatataaagcttccctgcatcaatgactgaatgtattttagaagctggaaaatagaaagcaagaataccaatagacttgatatacttgaataacatgcaaccattg

SEQ ID NO: 5292 - DNA, 547 bp, Gossypium hirsutum
  unsure (1)..(547): unsure at all n locations
  Clone ID: uC-gsronu33B169g10b1
tgtaatttcgttcaaggaaaccttcccttgagagtataaaaaaaaaattaagaacatgggtgtcaatgctgagaataagtttccagccattgagttccgttcatcggatttgaagcgaggaaccgatggatggcgcaatttgtgcaaaaaggttcaagaggcttgtgagaaattcggttgttttgaggtggtttatgatacgatatcgacgaaagtccgagaagagagttttgggttgatgaaagaattggttgaggttccggtggaaaggaaacaaaagaacactagtcccatgccttatcatggctgggttggaccatgcgagcaagtttctttgttgtatgaaggtttcggaattggaaatgcctccaactatgactctgttaaaagctttactcaacttatgtggcctgaaggtcacccacacttttgcgacactatacatactattggaacacaaatggaggagctaaacaaattaatctggttaatgctaattgatagttatggattaggagatgactcattgaagntgaactacacaaca

SEQ ID NO: 5293 - DNA, 491 bp, Gossypium hirsutum
  Clone ID: uC-gsronu33B169g11b1
attatgcgtccgcccacgcgtccggagctttcgtgtttgtctattgaattctttccctcactttctcgaaaaaaaaaatgtcttcaggttgcaattgcggatctaactgcagctgcggtgacaactgctcatgcagcaggaaccttaaccttggatattcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctctgtctgtgtcttgtgtaatagaagctttgtttgtggtgaacataatgtataagccatttggttgggagcaaatt

SEQ ID NO: 5294 - DNA, 473 bp, Gossypium hirsutum
  Clone ID: uC-gsronu33B169h02b1
ttatattaacaggtttttcattcttcaagtctgtcaggacttgctgatttgcaaggattttttccaagtgggacagttttggctgcatgctcagattctctatcagttaattgtggaaggaacatttctgctgtgggcgcatttcctcgaactgtttttgttccatctgtttcaggccctgcctttcaggcttgtaggtatcatattgattgtgcacttgttgactccagccaaataccaccaactgtgagcaaatgtcagagtaatcctatggctgtttctagttctggagttgtaattggtggatttgttgattcattgaagttaaagcatgggcacctttcatcgtctacaagtagtgctgatatactttatggcaacagaagcataccattccagaataagtttgaaaaatttgagagacctaacaattttgcaatctatggacagctcttgcataatattggaaaaag

SEQ ID NO: 5295 - DNA, 294 bp, Gossypium hirsutum
  Clone ID: uC-gsronu33B169h03b1
cggtttttaacgcccacgcgtccgggaccagcaccgtacaatctagaggtacccacatacagcttcttggaggagaacaagctgctaatcgggtgagaatttatgcggaaattattattatcttttttttttgtgttgcgttagtcttgctgcaaattgtcataatagaattttctctgcacaagagggctgcattcaatttaatattcagtttactccggatttttgtatttgctgcctgttttaaggcattgccccaaggttctgaataatgaaaacaagatttgttgagcc

SEQ ID NO: 5296 - DNA, 532 bp, Gossypium hirsutum
  Clone ID: uC-gsronu33B169h04b1
attagtatataggcttctgcagctattcaaatatgttcctcgcgagcagttgaccatccctgatttcgtgtttcagcacgatatagaagtgaacggtggaaagggtcttattgtagaccctcgaacgaaatacatatatcatcgaccatagaacatttaaatacacagtttcagagttgatgaaagccagtaattcttggtttgatttcctcatcaccttgtatttgtaggcaggtagtgggttggttgtgtttggtttttcatgtagatatgtttctttttttttcgttttattttttgagcaatgatatgtttgttaataatatatatttcatggtgatgtgagcttttctatttgatttcaacatgttgcactacatcctgagaaagtggactctttcttggcatgttttaaagaggggaagggattgtcggcgttttgaatctgtcgattatggacatggtcgactttagacagatcagattgtaagtgttgagctttgaattctaatttgtacttcattttttaatg

SEQ ID NO: 5297 - DNA, 473 bp, Gossypium hirsutum
  Clone ID: uC-gsronu33B169h05b1
ggactaagttggtatttacagtgttcttaaccagaagcgtgtacatgtgtttgaggagatgcagaggcctggtactccactttacaacatcaaggcctaccttccagttattgagtcattttggattctccagcactctgagggctgcaacctccggacaggctttcccacaatgtgtgtttgatcactgggatatgatgtcatcagatccattggaacctggttcccaagcagcagcccatgttgctgagatccgtaagaggaagggattgaaggagcagatgaccccactttctgagtacgaggacaaactgtaaggttgagaataactcagcttctgccgctatattttctgctgcaatttattgttttcggtgtctgtctcttaatgttcttgctagtagttttgggtgcctatacccatactggcttatcatgcaaggtcattttagtccttttcaaacggtttttac

SEQ ID NO: 5298 - DNA, 481 bp, Gossypium hirsutum
  Clone ID: uC-gsronu33B169h09b1
tgtgcttatccacttccccctcctgcagcaccattacccggtttttcagccactgaccttttagcttacgaacgacaacttgccatgagcaagatgggtggagttcatgctctaatgcacccacagggacagcatcctctgaagcaggcagcaatgggggtgggtgctgctggagcaagccaggctatatatgatggtggatacccgaatgttgctgctgcccagcagctaatgtactatcagtaacatataaagaaataagtggttgtgtggtaatatccttatttcctgcatttgcaggtttttaatttgagttctaaataggaggaggctttttaaatgtattttcccttggatagcagtgagcctgcatgccatcctgctttttatctttatatagcatatgtttgtcgattgtatcaatcttacgtatttccagattttatctgagttctaaaacgtgtaggaagcttcttaatgt

SEQ ID NO: 5299 - DNA, 497 bp, Gossypium hirsutum
  Clone ID: uC-gsronu33B170a01b1
actccgttgccctttctctcctcctctatattttaagcgccgacaaccattactctctgtctttcagattttcttctttcctcagctcagacttgtcgttcctttccaaactcactccgcgtcaaccgagtcaagattcttttcccaactcaccattgtaaatactaatacgcttcttcctctctctctctctctctctcttttttcttgactgatattccaccttcgctctctttttttgagggccgagatctgatatttaaaactgccccaagcttattatttttttggtgaaattggaaattttttccagatccatggactcgtttttttagactcagtccgagttcagaccaaatcggtgatcgttgccgagttttggtgacagagaatatagttattaggatttttcatttaagtgtagggttaagagtatggcagctgtgcgaagatggagcgagggaatgttctcagataatattaaggggttggtttta

SEQ ID NO: 5300 - DNA, 182 bp, Gossypium hirsutum
  Clone ID: uC-gsronu33B170a02b1
ttcgtccgcccacgcttccgacaagattgggatacgatatgcacccgcgcagaatttattccttacgatgtgtaatgattgttgtgttttcctttggctttattactcttgtttataaattttatcactttaaaaattagaaagggatgttcgataaataaaaaggttaaatgacttttttc

SEQ ID NO: 5301 - DNA, 561 bp, Gossypium hirsutum
  unsure (1)..(561): unsure at all n locations
  Clone ID: uC-gsronu33B170a03b1
ggaaanatcnatccacttgtttccctctttttgtttgtatccgtgtctctcgggaaggcttattttctctccacaataatggcggaatccaagagcaagtttgaatccataagggaatgggttgtcgatcacaagcttagaactgttggttgtttgtggcttagcgggattgggggttccattgcttacaactggtctcaacctcacatgaaacccagcgttaagatcattcacgctaggttgcatgcacaagcccttacattggctgcattagctggtgctgcagtagtcgaatactatgatcacaggagcaagccgaaaggcgatccatatgcgaagtaccttccacactcacacaaagagtaggtttgtcttgatagattaagcaacattctcatcacattcttttcaactgtttaccttatttacataaacataaatgcggngcttgcaagtggattgatattaagtttttatctgagaatttaaacaaaacacgtgttgttttcatcatccattgatggatggctaattcctatttgtattcaatattgattatgg

SEQ ID NO: 5302 - DNA, 100 bp, Gossypium hirsutum
  Clone ID: uC-gsronu33B170a05b1
acgatcaggataagaacatccttccgagggcaaagttttaaactcatgtctgatgataacattcgcgaattcaatgaattaagtcatttgtttttcttgc

SEQ ID NO: 5303 - DNA, 405 bp, Gossypium hirsutum
  unsure (1)..(405): unsure at all n locations
  Clone ID: uC-gsronu33B170a11b1
cgcggacattattgctgggtcgtcctacgcgtccggggtanatagcgaactccaactggcgaagcatgacggggctgtctggggcaaacattggcgaacttgatgacataaaaacttggctgtacagggcggtggttcgaattttaacataaacgacgtcgaaacggccagatgccctgcaccatgtgcgcaactgaagcccgcagcaccgtttactacttctgtctagacaccggtcgatctatcaagactcggatgtccagaagatggacagaaaatgatcagtaacctcatggcgatatacgacaacaatgttcaagccaacaagaatgcgagtcccattaaaaatccagttacggaaggtcaaaattttctttaagcgaaaacccaacagtaacaggacga

SEQ ID NO: 5304 - DNA, 410 bp, Gossypium hirsutum
  Clone ID: uC-gsronu33B170a12b1
ctaatccttaagaccaaacttaataaacaaatatgaggcaaaccttgtcttcttcctttgtcacccctctctttctctgcattttcttcttctttgtttccatttcaacctcccatggcttaaccgccaccaatgacagtctcatacgcaagacctgcaagaaatgcgcccaaagcgacccaaacctcagctacaatttctgcgtcacctctcttcaagcagctccccacagccactacgccaacgaccttcgccaactcggcaagatttccatcaccctacttggccgcaacgtaaccaacacaaggtctcacattaaggaactgttgaagaaccaaaagaagatggaccctttcgtcagatcatgcttgcacgattgctttgatctttattccgatgctatccctaca

SEQ ID NO: 5305 - DNA, 323 bp, Gossypium hirsutum
  Clone ID: uC-gsronu33B170b01b1
caacttgtttcggatagactctttggtggacacttattgcggcatattgatcaatatgagggatgaattgaatgctgcatagtggcgatatgcataggcgcccttcttacagagcctatatataaacgagaatgcgatgcttctactgtattctactattgcggggtcactgctttgtaaacatgacaagggatgcacctgatctaaagactcattatgttcatgaaggtgagtgaacaattgactgtcatgttcctgaggaaagttatcctgtattggtatactggacaatggacggatgagattgatactacgggagctct

SEQ ID NO: 5306 - DNA, 575 bp, Gossypium hirsutum
  unsure (1)..(575): unsure at all n locations
  Clone ID: uC-gsronu33B170b02b1
gcggngtcnggcttggctgttgctacccatttcttccgtttggagccgtgactgaactctgaccagcttacgcggctccggaaaaaaagtgtaagcaacaagagactggcgcacgtggcagctaggcatgggcttaaccgcttcgtcaggaggaaagacactgctcctcttgacctcattgttaggaagtatgtaggggcagttaaacaaggagatgatcataaaaacttggcagttccaggtattttggctgatattgtcgaagctctagccggtgctgtttatttggatctcaattttgatctcaccaagctgtggacgatatttaaagatgtattagtgatagatgaaattaaggtgccaaaggattttaaatcttctgagattattggagcacaaaataagctgtatggattatgtggcaagagaaaatggggaaatccagtttacagcgaagtgaaagctgaactttgcgaatacggaatgaaatatgtatattcagttaaagttgaaacaaacgatggtgtttgcggccacgagggtgatgaaaaataaacccaaaagatgcccgtaac

SEQ ID NO: 5307 - DNA, 309 bp, Gossypium hirsutum
  unsure (1)..(309): unsure at all n locations
  Clone ID: uC-gsronu33B170b05b1
gcctggtaattaaaacctgactgccgggnaatctctcaaatggtgggctgatgatcatcaaaatgccggagtatgaagaaactctaccgtagaggcatggttcatgcatcaccatcgagcacgaccgatcatgtgttggttctgccggctgccagaatgacccctaatgctgctcttttccctgaagacaaacaagtgttggcctagctcatctcttgtttcaacaatgcctatggcaactttttacgccgccggtaaaacacttcaaaaccccacactcataggtgaattagcagcagcagtagtgac

SEQ ID NO: 5308 - DNA, 475 bp, Gossypium hirsutum
  Clone ID: uC-gsronu33B170b07b1
gttttttcttgcattcgctgttcctgagcagtaccctttgcaaccccctcaagtgcggttcttgacaaaaatatttcaccccaatgtgcattttaagacaggagagatctgccttgatatattgaagaatgcatggagtcctgcttggacacttcaatctgtttgtagggctataatagccttaatggctcatccagaacccgatagccctcttaattgtgattctggcaatcttttaaggtctggtgatatgaggggattccagtccatggcaagaatgtacaccagacttgcagccatgcctaaaaaagggtgaacttaaatggtgtaatgaacagtcttaaactgtaagcgattcacttgttgtgctttccaaataacattcaagaatgtctccagtttttctgatccaacatatagattatagaacaacattgatgtttatgtatctagattaccaataaatcattatcct

SEQ ID NO: 5309 - DNA, 385 bp, Gossypium hirsutum
  Clone ID: uC-gsronu33B170b10b1
ctttttcgtccgctcaaacgcctcgttttacccgatggttcgatcctccgctgccagtactacgctcttccaaccagggattgcctatttgaggaccctctccatgatggcaaaaccatgctcaaaatctggaacttgaataagtatactggtgtgattggcgcatttaactgccaaggaggcggatggtgccgagaaactagaagaaaccaatgcttttccgagttttcgcatacggtaaaggccgagatgaatccaaaaagcattgagtggaacagtggaaagaacccaatttccattgaagatgtccaagtattcgccatgtatttttctcagtccaagaaactagtcctctcaaaacccgctgaaaacatggaaatctcgc

SEQ ID NO: 5310 - DNA, 470 bp, Gossypium hirsutum
  unsure (1)..(470): unsure at all n locations
  Clone ID: uC-gsronu33B170b11b1
cngtacacaaactgaaggaggtcaaattctcttttctctgtgtgtaattcctttctgttttttctcctcactttggtttcatcttctcaaattaatggatgctgctaaatggtcacaggattttggtttggttaagcccatggaagagatgctttctaatacatgcacaaggggaccaatgttagagagaaaaacaaggccaccagagcaattgaattgcccaagatgtaactttaccaacaccaagttttggtattacaacaactacagcctcacttaaccaagatacttttgcaagacttgcagaaggtactggactgaaggtggatctctaaagaatgtttccagtggaggtggtttcagaaagaacagaagatccctattatcaagcccttcatcctcctcttcttcttcttcctcttcagcttcagccaaagtttctggagaactaaagcccacaagtttcttac

SEQ ID NO: 5311 - DNA, 533 bp, Gossypium hirsutum
  Clone ID: uC-gsronu33B170c01b1
ccggttgttctgctaaaggtccaagacctcggtatcctcgggtatggaaatcaaggaatagaattgggactgtctcaaaatcagcaaagcttgttagttgtgttaagcaactgtcaaatgtcaaggaggaagtttacggggctctcgactcctttattgcatgggaactaaagttccctctaattacagttaagaaagcattgaagatcctacaaaacgaacaagaatggaagagaataattcaggtgataaagtggatgttaagcaaaggtcaaggaagaagcttaaaacttttctcttctgctgtggtaaacttcattggccaggagattatgggggccctatgtttctacttcctggtttggttattacattatatgctactggagccttgaatactgtcctatcaaaggatcatcaatatgagatatgcagatatttgtacaatcatcaagcaagcaatgtgcactgtgtcaacgttttgtcgatatttgatcctgataggtgcttggagcatatgaatggtcagggaa

SEQ ID NO: 5312 - DNA, 417 bp, Gossypium hirsutum
  Clone ID: uC-gsronu33B170c02b1
cccattcttccgaagaaagttaacaccttgatcaggcctgatggaacaaagaaagcatatgttaggttgacacccgaatacgatgccttggacgttgcaaacaaaattggtattatctaggctagttggtagctaccttgttgagcatttattttccttttgtttgcaaagagaaattatttcgagacattgagcaggtatttttatttttattagcacttaaaagtttgtaatattgcattgttgttgccaattagccatctctggttcaacttaagacagaaggtgatttttgatttacatgctttggggcatttgtttaaaaaaaaaaattaaataaaaaaaaaaaaaaaaaaaaaaaaaaaaataaaaaaaataattaaaaaaataaaaataataaataaaatccaagatccg

SEQ ID NO: 5313 - DNA, 414 bp, Gossypium hirsutum
  Clone ID: uC-gsronu33B170c05b1
gacccatgcgtccgctttttttttttttttttttttttggggggttttttttttttttttgggggtgttttcttttttttttttttttttttttttttttttttttttttgggggggaaaaaaaaggacacaaccccctttttaaaaaaaaggggggaaattttaaacccccccaaggggggggttcacaaaaaaggggagggggggcccccccccccccaaaaattggtttttaagccccaaaaacaggggggacctttggccaccccagggggggggaaaaaacaaccccccccaaaaagggggggccaccccccaaaaaaaacccccaaaaaaaaaagggggggcccctaaagggggcccaagtttcccgccccgggggggggggaaaaaaaattttttaaaggggggccc

SEQ ID NO: 5314 - DNA, 511 bp, Gossypium hirsutum
  Clone ID: uC-gsronu33B170c07b1
gtgattttataatgccaactaaagttgtttctgaagataacatatcaccagaaggatttggtaaagatattcctgagacaacggtccatcctgtgccgccagtgcctagcaagacggtaagattttcgactgtaaatatcgaagagatgggtgcaacgaatgagaaatatcagtcgcctaggattcctgaaatagagatctcaactccacctccaaataatggaatggacaaggaaccaatgcatagcacgaagaaatggaacaacgaggagagccctcctaaagcagccaaagggtttagaaagcttcttttctttggaagaaaaagcaaaaactatgctactgcttagtgtatgcttgactttccatattgcttatgtttcgggttttcagttttttcgggtggaacgtaccaataaggcctttgatgttgctgccattcaaggattcatgaacttataaagaaaaatggcgataataagagagagattcataatgtaatttatctttg

SEQ ID NO: 5315 - DNA, 527 bp, Gossypium hirsutum
  Clone ID: uC-gsronu33B170c10b1
tttcctttttctttaaaacacttaaactctccctctctgtcggcgccgctcagcagttcatcgcccccttcaaaggctctccgaaccatgcctttaactccgacgacaacagaggaagagcaatcggtccaaacgtgaggtacgccctctctcttttattgctattatctctttagtaaatgctcaatagaatctcaaaatgaaaaacaacaaaacaaaaaaaggtcgaactacgaacaaataataagagagaaaaaaaatgaacctagaaatcaccttttggtgttttttgtttttgtattctgattgccctcttttttacaggttacaatcggcccttttatagccaaatagggacaaagaaataaaacttttacagtttttatttgctgctagtatttttgctgtcaattgctgctcctttagccgttggtatctgtttctgctgctcgtttgttcgtcttttgcaggtaccgagaccagttagcgtacggaggcagccgacgtggcaccacgcgcatggggag

SEQ ID NO: 5316 - DNA, 481 bp, Gossypium hirsutum
  unsure (1)..(481): unsure at all n locations
  Clone ID: uC-gsronu33B170c12b1
ttgttatcgaaatgctcaactgtatcaagcaacaaggactcaacattacccctcgtattctcattattactcgacttctccctgatgccgtgggaacaacttgcggtcaacggctcgagaaagtatatgggactgagtactcggatattctccgaatacccttcagaacagagaaaggaatcgtacgtagatggatctcaagatttgaagtctggccttacttggaaacttacaccgaggatgttgctcatgagatttcaaaagagttgcaaggcaagcccgatttaatcatcggaaactacagtgatggtaatatcgttgcctccttgctggcacataagttgggagttacacagtgtacgattgctcacgctttggagaagacaaagtatncagattccgacatctactggaaagaagctcgaggataaataatcattctcctgcccatttacagctgatcttttcgctatgaaccata

SEQ ID NO: 5317 - DNA, 179 bp, Gossypium hirsutum
  Clone ID: uC-gsronu33B170d03b1
tctagatgatgagcgcctgccctttttttttttatttaggagtcattggttttgagaacatgggtgttaatagctattattgtacgagatttttttaaaaaaaagttagtgccagtttgcgcggtcaaacttctgggaaaattatatttaataaaatcatattgtgaatcctttttgtt

SEQ ID NO: 5318 - DNA, 482 bp, Gossypium hirsutum
  Clone ID: uC-gsronu33B170d04b1
gagctttgttgcgactttaaactgagctttgctgaattgtcgtgatcgtcgagaaagaaaattatgggaaggaaattcttcgttggcggcaattggaaatgcaatggaaccactgaggaagtgaataagattgtgagtactttgaatgctggagaggtgccttctcaggatgttgttgaggttgtggttagccctccatttgtgttccttcctttggtcaaaacttcactgagacccgatttccatgtcgctgcacaaaattgttgggtcaagaaaggaggtgctttcactggtgaagttagtgcagagatgcttgtcaatttgagcattccttgggttattattggtcattctgagaggagacttaattttgaggagtcaaatgagttccgtgcggataaggttgcttatgcacttgctcaagggtgaaggtgatagcttgtattggggaaacacttgagcaacgtgaagcaggatctact

SEQ ID NO: 5319 - DNA, 352 bp, Gossypium hirsutum
  Clone ID: uC-gsronu33B170d07b1
gaaaagggagaggcaatggccggggagccgacaccaaagggccaaagagaagaaacccagagatcaaacgaagaacatgttgaagaaacaaaacgccataagtctaacaatcacatactctctttggttgaagccgaagaggatgagcccagccaagacttggcacccctaatgaccactttacaacaacagctatccgtggactccgttatggaagcccctttacctcttggggaaccagcaacaccatcgtccaaggaacccgacaaggaaaacgacaacgacggccttagcttagaagactgcacatcagcaaacggttccttgaaagaagatgacgatgatgaaaagc

SEQ ID NO: 5320 - DNA, 517 bp, Gossypium hirsutum
  unsure (1)..(517): unsure at all n locations
  Clone ID: uC-gsronu33B170d09b1
ggctangaagcttacaaggcccttcgtgaccgagcaccttatccttcaaaccatgtggttggccatctaattgggagctttgctttcattgtctttgacaaatccacctccactttgtttgtggcttctgatcaatttggtaaggttcctctctattggggaatcaccgccgacggatatgtggcctttgctgataatgctgaattgctgaaaggtgcctgtggcaaatctcttgcttcttttcctcaaggctgtttctactccacagcagtaggaggattaagaagctatgagaatcctaagaacaagatcactgcagtgcctgctgaagaagaggagatatggggtgctaaattcaaggtggaagggccaacagttgttgctgtcacagagtagtcctttgctttctccttctaaatctatggatccatgggaatataagagctgcaaatgcatagcatatggatcagtcttcatgtgaataactgaagtcccagacttgtagaatgggaatgat

SEQ ID NO: 5321 - DNA, 407 bp, Gossypium hirsutum
  unsure (1)..(407): unsure at all n locations
  Clone ID: uC-gsronu33B170d10b1
ttcttacgcgtccggtcatttgtccgcccacgcgtccgatttgcttctataggggtttctcaaaatccgcgaacgtagattcggatcgtaagaggaagaaatcttcgatctcatccgcagatcgaacggcggcgaaggagggcgaaaaacataaagataaagctcccacttcctccaccaatcaccaccaccaccaccaccaccacaaaaagaagagcaagatgtcttcttcatcgcccgccaatcaagtgagggcttctcacatcctcatcaagcaccaaggcttcccccgtaaggcctcttggaaggatcctgaatgtcgcgtaatctccaacactacccgagatgccgncgtctcacagctcagagccctccgtgacgacatcacttctggcaacgctaagttc

SEQ ID NO: 5322 - DNA, 601 bp, Gossypium hirsutum
  Clone ID: uC-gsronu33B170e01b1
gaccgtccggaattctggtcgcctattctccggatgtggttcaccaccaggcgctcttcttccttttctgcgtctatcatcaaaccccaaactcttaactagcctcttcctcctcctctttactttaatttcattttgctttcacaaatctaagaccagagctccaaaagattgaatttttaacccctcaaattaaaatccttcctttttcgcgttttcggttgaaaatttgtataaaaaagagggtgatttagaaacaatggatgctgattcatggagtgctcgtctttcttcagcttctaagagatatcaatcggctcttcaattacgatctgatatgcttatggggtttgaagaaattgatggagaagatgaaataagagaggagtttcgatgccctttttgttcagagtatttcgacatcgttggcttgtgttgtcacattgatgatgagcatccagtggaggctaaaaatggggtttgtccagtctgtgcaatgagggtgggcgttgatatggttgcgcatataaccctacaacatgggaatatatttaagatgcagcgcacgaggaaatcacgtaaaggtggatctcattccacg

SEQ ID NO: 5323 - DNA, 444 bp, Gossypium hirsutum
  unsure (1)..(444): unsure at all n locations
  Clone ID: uC-gsronu33B170e02b1
attgcatggttctgctctcaatctgctcgttgctgaccgatccaaaccctgatgaccctctggttccggagattgctcacatgtataagactgatcgggccaagtatgaagccactgctcgtagctggacccagaagtatgccatgggatgacagtggttggtgtgtaatacctatcagctttcttatgtgttttggggaaggaagggggtgttttttcttaaagtaacttgtcattgtgctttggatatgggaaagatatggaacattctttttatttatttcgtgctttataacttgtgtgaaacccttgtttcgttcaatgtcaaagttgctgtggaaccctttgtttcgttcaatgtaacaaaaaagtctttagttctcctntataaacattaatctccctccctattcaaattttttataaaactgggccggccgcttt

SEQ ID NO: 5324 - DNA, 536 bp, Gossypium hirsutum
  Clone ID: uC-gsronu33B170e03b1
atgcttgttcaaattgtaggatggccaccagtccgatcataccggaaaaattgtttacaaggcaagaaagatgacgttgaaggcgggacaggaatgtatgtcaaagtaagcgttgacggagctccttatctcagaaagattgatctcaaggtttatagaagctaccctcaactcctcttggctttggaaaacatgttcaagcttaccattggtaagatttcaaaacatccccaactgttgttttcccttgacaaatcaaatgaaattaaccccatgataaaaagctgtagtctgattggtttttttttttatctgcaattttaaaggtgcatactcagagagggaaggctacaatggatctaactatgctccaacatatgaagacagagatggtgactggatgcttgttggagatgttccctgggagtaagttcctctttcaaacctttttctcttgaactatatatacatataccctttgttctttccaaaagtaactcattaattttgctaatttcttgcgtttacagaatgtt

SEQ ID NO: 5325 - DNA, 546 bp, Gossypium hirsutum
  unsure (1)..(546): unsure at all n locations
  Clone ID: uC-gsronu33B170e05b1
cccacgtgnacgcttgcacttccagatattagaggaagcagacctggtgacgaaagaaactttgaagatatttatgatgttgagaagttcatgaaaagcctcaatggggttgtcaaagtagtgaaagaactacccaatgaaatatcaattcgggatcttgctgctgtgaaggttcccaatagggtcaccgaagatcacattgtggaaaatgtacaaccaatttttaaatcaaagggaaacataaggcttgctacctacttccctactgtaaatatgagaaaaactacacaaaagagtagtgttgattcagtctcatgtttgggaatgtttggaactttagagttgcaagcagaggtcagtgaagttgttgattcaatgattgaacggcttagaactttgagtcgcaaatctgatggcctgtttatagcagtggacttgagggttgatgtattggagaataagacttgtcatggtagtggtactaatgtagcaaaaagttgttataatgcacaggagattgtttgtttttgagaggttggatttgat

SEQ ID NO: 5326 - DNA, 528 bp, Gossypium hirsutum
  Clone ID: uC-gsronu33B170e06b1
accggccggaattccggtcgacttacgtcgtcgccttttgtcgcagaaatgtcgaagcgaggacgtggagggtgagctggaaacaagttcaggatgtcactgggtttaccagtggcagccacagtgaactgtgctgataacactggtgctaagaacctttatatcatctcggtgaaaggaatcaagggccgtctcaaccggttgccctctgcttgtgttggagatatggtgatggctaccgtcaagaaagggaagcctgatctcaggaagaaggttttgcctgctgtcattgtgagacaacgcaagccatggcgcagaaaggatggtgtttacatgtactttgaagataatgcgggtgtcattgtgaatccaaaaggagaaatgaaaggttctgctataactggtccaattgggaaggagtgtgccgatctttggccaaggattgcaagtgcagccaatgctattggttaggaagtcaaaatctgtgctttggactataatattatagtttgctgcttcaatattttg

SEQ ID NO: 5327 - DNA, 579 bp, Gossypium hirsutum
  unsure (1)..(579): unsure at all n locations
  Clone ID: uC-gsronu33B170e07b1
gtcatttgctggagtcacctgggaaaaaagtgggaatagttggcctggggggtctgggtcacgttgctgttaaaatggcaaaggcatttggtcatcaagtaaccgtcatcagcacttctccgtcaaaagaaaatgaggctaaacagcgtttgggcgctgattatttcctagttagcacagatgctaagcaaatgcagggaggtaagaggtcgctagatgttattttggacactgtctcagctaaacactcactcggaccaatcttggaactactcaaagtaaatgggactttggtagttgtgggggcacccgacaggccaattgagcttccttcttttccattaatatttggaaagagagcagtaaagggaagcatgacagggggtatgaaagagacgcangaaatgatggatgtgtgtgggaagcacaacatcacgtgcgatgtagagcttatcaagccagataaaatcaacgaagctttggaccgccttgccagaaacgatgtcagatacccgttttgtatcgacattgcccggaacctctaagctttgaagatggaatcagtgatcccttgcatgt

SEQ ID NO: 5328 - DNA, 536 bp, Gossypium hirsutum
  Clone ID: uC-gsronu33B170e09b1
aattttacgctttcccttttttttctttttttttgccgatgttttcttcaccaaaactcatctcttacttcttccttttagccctcttctccgttgaaatacatggtagggatttctttagcaaaatcccaagcgttaacacaaatgagaaagaggtgaccaacaaagaagaacaaaccactttggggaagaaggagcaagagccaaggtttatccccgagacccaaagctatgggctttacggtcatgagtctggtcagctccctcctagcaccaccagtaccaaagaaacctatgaaccctatgtcacacctgttaaataccaccctgatgaaccctacaatagcatcccagcgtccaaaaccaacaacaaagactcttacttttatagcaagacaaatgcctacgggaacgctgagcagcaaagtgaagccaagttcaatgagaaaggatgggccaccaaagaaaccaacaactacaatgtcaactattacaatggtaacaatgaggccttgttcactgagaaagggtggagt

SEQ ID NO: 5329 - DNA, 343 bp, Gossypium hirsutum
  unsure (1)..(343): unsure at all n locations
  Clone ID: uC-gsronu33B170e10b1
tcctcgcgtccgttttgatttaaagttgaatggcttagataaatccttttgtngaaaaaaaaaaaaaaaaaaaaaaaaaaaaaaaaaaaaaaaaaaaaaaaaaaaaaagggcgaacgaaaaaaaggaaaccaagaataaaaaacacgagcatgcaaagaaataactattatataggggcacctaatttaaaggaaccggccttactttcacaacctcgcgactgaaaaaaccttttttggggcccaacaaaataaattagcgggccatgcttataaaaccagttggcggaaaaaccaagaggctcccaaaaataaaccttcttaaaaaaaacccactttgaat

SEQ ID NO: 5330 - DNA, 536 bp, Gossypium hirsutum
  Clone ID: uC-gsronu33B170e12b1
cctcgtgtccgcccacgcgtccggtttggtacaagtgcatgatatgtttgcgacaaacttcagcttttgcttcggctgattcgacccaccaacctagtcaaaatgaacgggtgagttggtggatcagtcgttgggcctatggatgtccgatgtgcggcggaccttgggttcgagttgtatagaagccgccagggtgaatgtcgattatgtatttgttgtcaggggctcacttcggttcctcttttcgatgtacgggtatgtactttttggaagctttacaagttgctgcaggtttaaagcttaaacataggaaaccaatgattggcttttttaacactagaacctgtttctgtataaaatttgttggataaataatttgttaggttacttttttattttaaccaacgttaactaaaaacattgatttttaagggggtgagaaatgagaagaatatgggtaggtgtaatagtttccttttgtctaaatgaatgagtttaagacagtaacattgattgatgtaaacaatgtttaggct

SEQ ID NO: 5331 - DNA, 440 bp, Gossypium hirsutum
  Clone ID: uC-gsronu33B170f01b1
atgattatttagaaaaaccagataaatcttgtttcttacacagtgcactatatcctggagactatggaatcccaaaagaggagataattgaatattggatagaaggacttccagatgaaatggagagcagagaagaaatgaatagcagagaagaaacgaagagtaagggcaatgcttgtttggaaaggattttagacagtagcttgctacaagggaccaatggcaagaacattgtaatgatgcgcgaaattgtgagaggtatggcactgtctttgataccaaaagatcgtaggttttttgtgaaagctggtatgaaattgaatgagctaccaaatgaactagaactagaagaggctgtagatatggagaaggtttccctgatggaaaatttcatatcaaaaatacctccaaaaatgtctccaaagaggaaaaagctcaca

SEQ ID NO: 5332 - DNA, 454 bp, Gossypium hirsutum
  Clone ID: uC-gsronu33B170f03b1
ttattcgaccgccgtgttgaaacaaccctgagttgcctaagcccgataatgccgacttatggggggcactaagcaaataacaaaaggcgcaggatgtatcaacgccattggcaacatcaatcatagagggtagatcaaaactgttctttacggtgctgatgattgcctcgacccttttcctcatttcccgctaggtgcttttctttcgggatggtctgtgctagtccgaacacatgcttcacacgtaaggtttgtgattgtatgattaggcgtgcgggtgtagtgttgctgatatgaaactttggtgattttgataagttctattaggccctatgaataattgggcattttaagggtattggttcagaatgttgttaatgcattgcatcaagggttccttgcttaatttattgggagcataccattcttggatattgttttcaaaaaacgacaa

SEQ ID NO: 5333 - DNA, 565 bp, Gossypium hirsutum
  unsure (1)..(565): unsure at all n locations
  Clone ID: uC-gsronu33B170f04b1
ctctttcttatagtttcacccatcttttaatccatcgctgacaaaattatgggtttgaaggaggaattcgaggagcatgccgagaaagttaagaccctcccggccgccccttcgaatgatgacatgctcattctctatggactgtacaagcaagctactgttggaccagtgaataccagccgtcctggaatgttcaacatgagggaaaagtacaagtgggatgcatggaaggctgttgaagggaaatcaaaggaggaagcaatgggggattatatcaccaaagtaaaacaactgtttgaggctgctggaagttcttgatgtgtgtgtgtatgaccaatgaaactggtgtaatttcaagcccttgtcggttacttggggttttcattactatgaataaattatgtactctttttctattgctattatgttatttacagtagaaactctttgatttacttttattcttgtggttatttcaaagtagatttttacataatcatccatttatgttatgttatgaatgtcgcatngttacgatgtaacctttttcatgttatttctaaca

SEQ ID NO: 5334 - DNA, 537 bp, Gossypium hirsutum
  Clone ID: uC-gsronu33B170f09b1
gtagttccatcccctctttcagttcttttattttgactcagtggagtcacttcctacagagcctctggaccctagtgatttaaaaccattaaatacccgttatgatgcacaaatttcagtgtttgggtccaagctccaaaagaaactggaggatgcaaaagtattcatcgtgggatctggtgctctaggttgtgagttcttaaaaaatattgctctgatgggagtttcatgtggtgaccaaggaaagctaactgtcactgatgatgatgtaattgagaagagcaacttgagcaggcagtttctcttccgggattggaatattgggcaggccaaatccacagttgctgcttctgctgctgcatcaataaattctcgtttaaacattgaagctttgcaaaaccgcgtgggtcctgaaactgaaaatgtgttcgatgacaccttctgggagaatttaaccgtgattatcaatgcattggataaatgtaatgctaggctttatattgatcagaggtgcttatatttccagaaaccactttt

SEQ ID NO: 5335 - DNA, 485 bp, Gossypium hirsutum
  Clone ID: uC-gsronu33B170f10b1
tcttcgcgtccgaagtcgcatcgcgaagtgggttctaagaagggccggcgatgacgaagaacatccctatctgccaaagcatatcctctacagacaaaaagaacagttcagtgatggtgtcggttatagttggatcgatggtctcaaggcccatgctgcccgacatgtgaccgataagatgatgttcaatgcttctttcatatttcctcacaacacaccaactacaaaagaagcatattactacaggatgatttttgagaggtttttccctcagaactcggctagattgactgtccccggaggagctagtgtggcatgcagcacagctaaagctgttgagtgggacgctgcctggaaaaacaaccttgacccttcgggccgggctgccttgggggttcatctctctgcttatgacgcagagactccccttagcaacaagccattcaaggtttttgatagtataccacggatggactttcctggag

SEQ ID NO: 5336 - DNA, 591 bp, Gossypium hirsutum
  unsure (1)..(591): unsure at all n locations
  Clone ID: uC-gsronu33B170g01b1
caacgtcgttagctgctagcaaatgcccttttaattatggagctgtagatgttggtcttagggtggtattgtttgctgcagctgtaattgctgtggtggttatggctactagcaagcaaactgaaatggttcctgttccaggcttgcctacttcagttagggttccttattcggccgagttcactgattcacctgcctttgtatactttatggcagcactgtcaacaacaggcttatacagcatcatcactgctctcgcatcaactttgctcggctgcaagccttcttataccaacaccatctggctcgcctttgcattaatggatgtggtatttgtgggaatcgtcgcctcagccaccggtgctgctggtggcgtcgcatacatcggattaagaagcaacagccacgtccggtgggacaaaatctgcaacgtttacgacgagttctgtcgacacgttggaaccgcaatcgcattctcgttatttgcggccatcttgttggtggtcctcaccatgttctncaccttcgcactttacaaaaagatcccgtgatattttttagaaacacagttcttaattactcttatgtctg

SEQ ID NO: 5337 - DNA, 453 bp, Gossypium hirsutum
  Clone ID: uC-gsronu33B170g02b1
gtagtttaattgtgaatcagtgaattgatatccaagcgttccattccatttccgtatagttcgaaaacacttaagtaccttcgatcatattttagtgtcaaaaaatggccgaggagcataccagcaaggcccctgagttggagagcaacgttagcggtgaaggagcagtggagagcaaggagcgagggttgttcgatttcatggggaagaaagaagaggagaagcctcaagaggaggtgatcgtaaccgagtttgaaaaggttaatatcgaagagacaaaggcagaggaagaaggtgaggagaagaagaagcatggtctcctggagaagcttcaccgatcagatagcagcagcttcagctctttaagcgacgaggaagaaggtgaaggagaagagaagaagaagaagaaaaagaaggagaagaaggggactgaagaaaagattgaagagaatt

SEQ ID NO: 5338 - DNA, 500 bp, Gossypium hirsutum
  Clone ID: uC-gsronu33B170g03b1
atgctttgttcaaattgtaggatggccaccagtccgatcataccggaaaaattgtttacaaggcaagaaagatgacgttgaaggcgggacaggaatgtatgtcaaagtaagcgttgacggagctccttatctcagaaagattgatctcaaggtttatagaagctaccctcaactcctcttggctttggaaaacatgttcaagcttaccattggtaagatttcaaaacatccccaactgttgttttcccttgacaaatcaaatgaaattaaccccatgataaaaagctgtagtctgattggtttttttttttatctgcaattttaaaggtgcatactcagagagggaaggctacaatggatctaactatgctccaacatatgaagacagagatggtgactggatgcttgttggagatgttccctgggagtaagttcctcttccaaacctttttctcttgactatatatacatataccctttgttctttccaaagaaactca

SEQ ID NO: 5339 - DNA, 343 bp, Gossypium hirsutum
  Clone ID: uC-gsronu33B170g05b1
cccactcgttcggtttgcaaagtctatggagaaaatggggcggattaatatcaaaacaggatcccaaggtgagataaggaagcaatgtgcactcgtcaacagttaaaaaaaacacttaattcagctgaagaaggttccttcaaaattgtatagggaagtttcatagtgtggtctcggtgggtgctctgtgtgtgtgtgtcatgtcctgaataattgggctcactgttacgttttttcttctttttcctttttatgttctttttttgttgttgagctcaatgggtttcataatcttcatatgttatgtatttgggtggattgaataatttattcttaatttatt

SEQ ID NO: 5340 - DNA, 488 bp, Gossypium hirsutum
  Clone ID: uC-gsronu33B170g08b1
tttctctgaagctaagtctgttgagatgcaccatgaatgcctcccggaagctttccctggtgacaatgttgggttcaacgttaagaacgttgctgttaaggatcttaaacgtggttttgttgcttcaaactccaaggatgatccggccaaggaagctgccaacttcacctcacaggttatcatcatgaaccaccctggccaaatcggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgattcccaccaaacccatggtggttgagactttctccgaatacccaccactcggacgttttgctgtccgtgacatgcgccagaccgttgctggtcgtggcatcaagagtgttgagaagaaggacccaactg

SEQ ID NO: 5341 - DNA, 116 bp, Gossypium hirsutum
  unsure (1)..(116): unsure at all n locations
  Clone ID: uC-gsronu33B170g09b1
tgnctttccaagcatcctgatattcttttacatctgggggttcattcattcattcattgctatgcatattgttctgaaatgaattaatggacggaccctctcaactttttacatgt

SEQ ID NO: 5342 - DNA, 547 bp, Gossypium hirsutum
  Clone ID: uC-gsronu33B170g10b1
tttcctcgtggttggttgcacagaaagtgagagaaagttttacttttgattttgaaactccgatgagaaaaccttgctgcgataaacaaggcaccaacaagggagcctggtccaagcaagaagatcaaaagctcattgattatatacgtatacatggtgaaggctgttggcgttccctccccaaagccgcaggtttgcaccgttgcggtaaaagttgcaggctgagatggataaattacttaagaccagatatcaaacgtggtaactttgctcaagacgaagaggacttaattatcaaactccatgctctccttggtaaccggtggtcactgatagctggtagattaccaggaagaacagataatgaagtgaagaactattggaattcccatataaagagaaagctaatgaagatggggatcgatcctaataaccataagttgaaccaatatcctcatcatgttggtccccttaaccccaccaccaccaacttcatggatgtggcatgtaagcttagagtgttttcaacagaaaatgatgatggggt

SEQ ID NO: 5343 - DNA, 155 bp, Gossypium hirsutum
  unsure (1)..(155): unsure at all n locations
  Clone ID: uC-gsronu33B170g11b1
anttanatttaagtttcttcttttcccagcatttttaggacatatcataaggaaaaaaaaagtttgctttcggtatgtaagaaatgacatgtttccattctgtctttttgtgattcgaacagtatttaatgaatcaatttcttgctttcttgttt

SEQ ID NO: 5344 - DNA, 515 bp, Gossypium hirsutum
  Clone ID: uC-gsronu33B170g12b1
tccatgcgtccgcccacgcgtccgcgaaaggcaccggcaccctttctctcccaacatcaaacggaatcgccccttacattttccttccttcttttgttcctgaaggtaactgcaaaaaaaattggaggaccggccacacaagttcatcgttttcgagcaggaactagggcttcaagagattcgaaaataccagcttcatcagagaagtctcaagatttccttgatctccatcctttctggaattttggttttgatggcaaactggtggttaattatgcctgttctatggcatggggctaactcttgatgatggatcttcagagagatgagataaaaactgtcaactctgtaactgtttcctacaattctccattatgcatattcctcatagaaccatcttctataattcccccccccctttttctctgagaaactggtgatcctataacagatactaacttgcttctactcaagcaagggaatattggtgttctaaagattctgataatggcgac

SEQ ID NO: 5345 - DNA, 517 bp, Gossypium hirsutum
  Clone ID: uC-gsronu33B170h02b1
tagtgtccgcaaagtaatttaaagccaagatcttcaaatcatcggggctgttggattttccggcaacgaggcgagtacgttgctccatgcgaaccgcttctagctcgttgccagctgattcaccttggcttcgtgtttagtgatccattccttactgagtaagtgatgaagattggatttatggattctggagattacgtattggagattgttggctaagaataagtatgaaacaacgtctttgtaatacttggctttgctattgatattgcagagaggacgagaataagccgcgaaatgcggtcagagatgggcagtgttggagattcattggaaacatgactgtaaaagcaaatttctggcaaagatgatttcgccagcggtggccaatctgaggtaatgtcagtgaggatgttaccgtaatcggctaggatcatggactcaaaatctaataacaacaaccacactgactaagtcgagccatcgagttaaaagcttaagatcgaacagctgaaat

SEQ ID NO: 5346 - DNA, 359 bp, Gossypium hirsutum
  unsure (1)..(359): unsure at all n locations
  Clone ID: uC-gsronu33B170h03b1
gaggtttgtgtgacctgtagaaataatggagcagcctgatggcattgatgatgacaaagaatctttaaaccctacttatgaaaatcacatatgaaaccttttatgtctcttttgtttttttgtttttaagctaattgatcattttgtaatttaaacaatacatacataccgtaggttaatttatagttcccctaagtttaaatcacaagttttaaggtacttggtcttgtaatatacttctttttaatcctttcgatatatgtgagtgattatcaataaaattatacccnncaaaaaaaaaaaaaaaaaaaaaaaaaaaaaaaaattaaaaaaaaaaaaaataaataaataataaatcg

SEQ ID NO: 5347 - DNA, 560 bp, Gossypium hirsutum
  Clone ID: uC-gsronu33B170h05b1
cccactcgtccggaagggatcaagatttgatacgggatgctagtaaattgacattcttaaatgttaatgaatttaaattaagtcaacaagacctcatacaacattctaataaatttacaaactcaaaagcagctgggtgtagaaaagctgatttggaaagccagccgcaaatcaaatcaagtaaccaaggaagttctcatggctgcaacttaaaacttcctcttgccttacctttacctaaagctccatcagaatcttggttgaagcgcaccttgcctgctgtttcctcgagaaattcatcttcacggacggctcttggtacatgtaactatagtgaaactcaagcctacacagctctgtccagtgatctcaagtgggaaaacattgttaaatcttctaatgttcatcatggtcgtttgcggttttccgaggaacaacttcctcctataccagaagcttaaaagtattgggattcattacttttatggggttaaggatgcataaagaagattaaaccccttttaaatatttatatctacacacagtataagtaaatgatg

SEQ ID NO: 5348 - DNA, 444 bp, Gossypium hirsutum
  Clone ID: uC-gsronu33B170h07b1
tttattgtccgccagagtgttactgttgggtctggggtgaaaccgttggttaggcaccagacatagccagtcgatggatgggtcgaccagtattaagccggaaatgcttatgtccggtgcggaggaagtttcacctgctgaggctaagaaagctctgtctgctactaagcttgctgagcttgctattattgatcccaagcgtgctaagaggatctgggcaaataggcagtctgctgctaggtcaaaggaaagaaagatgcgatatatagctgaactcgaaaggaaagttcagacgttgcaaactgaagcaacatcactcaatgcccagctgtctctgttacagagagacaccggtactctgactgctgaaaacaatgaagtgaaactgcgtttgacaacaatggagcaacaagttcatttgcatgatgcattaaacgaagcgct

SEQ ID NO: 5349 - DNA, 432 bp, Gossypium hirsutum
  Clone ID: uC-gsronu33B170h09b1
ctactcttccgcccacgcgtccggactagttctagatcggtgctaaccctccattcaaggtgaaaggactatggcttttccgtgggcaagagattcctcaatttgtgattgacgagtgctatgacatggaactctacgagtggaagaaggttgacctgtcagatgcagcccagaaggaacgggtgaatcagatgattgaagactgcgagccatttgagggagagcctctcttggatgccaagtgctttaagtgatagaatatgttcttaattttacttttttatatttctggtacctttttgcatgtcaggttttatttatagatcgctgttttcagtttttgattaaggtaacattacaattaagtttttatgttctcagatgttggatttgaaatgctctatttatgttatattaaggagatatagtttc

SEQ ID NO: 5350 - DNA, 383 bp, Gossypium hirsutum
  Clone ID: uC-gsronu33B171a01b1
gggaatccccctctctctgctagggttccaggcttagtcttggaagcccggcgccgaccctccttaccacttgtaccatcgagccgccgaaatagttgacggtcagagacgcaagacgggcttcaaatcccagatggaagagtggcgagtgccaaccacctgggccaaggctaaccaggctcggaacacggcgacttcggaaagtgtcgcgatcaaagtgattgataaggagaaggttatgaaggctggtctcattgatcaaatccagcgagaaatctctgtgatgaagcttgttaggcatccaaacatcggacagctctatgaggtcatggccaccaaaaccaaaatatactttgtgctggaacatgttaaaggtggagagc

SEQ ID NO: 5351 - DNA, 253 bp, Gossypium hirsutum
  unsure (1)..(253): unsure at all n locations
  Clone ID: uC-gsronu33B171a03b1
ctagctcngttattgtaagtgacaaagtgcagaggatttcatctgatctgccactggagttaggtgtggatagcacgcgtacaattaaacaggtctcatggtaggatccgtccacttgtttccctattgccttcttgggctgcagttttgatgtttcctaaacctggaccccctctctctgatctgcctgacaaataacatttgctatgcatgtatgattctctctgttctatgggtatgcaaagattgctna

SEQ ID NO: 5352 - DNA, 433 bp, Gossypium hirsutum
  Clone ID: uC-gsronu33B171a04b1
cccactcgtccgcttgccaactgtgatttctcccagtgtttatattaaaagattcagaaagttcatgtcaacgtactctttgagtgtccctgatcactggtgttcacagggatcctctgacccttgccaactatgtggcactccaaatgatgcctcgtctcaacccgagtccctaaatggtatttctgcctagttcttgtattccttgtttcccatttattctttgaatcagccctcattttttatagccagttgaaaaatgctgtgtgtatatatatacccaaccccattataatgcaatttttagcaaatttgtggggatagtttcaactagcattcgtcttatgttcataattttgtatggtcgagtgagaatgtaaagacccgatgttattggaagattggtaatgtaaaatcaattaaaagtttagct

SEQ ID NO: 5353 - DNA, 438 bp, Gossypium hirsutum
  unsure (1)..(438): unsure at all n locations
  Clone ID: uC-gsronu33B171a06b1
cccattgtacgctgannncataaacnncccaaanctgttttctattnccttttccaagcgttgtttgatctcaaaaccttttactgcatggaagccggtaataaaatcggtgcatcagctcatcccacttccttacatcctccggtccgcggacatgcctcgactggcaccctgggacgccacctggcaaggcggctcgtggagatcggtgtcaaggacgtcttctcagttcctggtgacttcaacttgaccctcttggatcatctaatagcagaacctgagctgaacttagtcggttgctgcaacgagcttaacgccggatatgcggctgatggctatgcacgcgctaagggcgagggagcctgcgtcgtgactttcactgtagggggcctgggtgtgcttaacgctattggcggtgcttacagggagaatttgcct

SEQ ID NO: 5354 - DNA, 430 bp, Gossypium hirsutum
  Clone ID: uC-gsronu33B171a09b1
gcttttgcaggtgaatattacattacatagactcactttgttgaccttggttcaaaagatagatacattcttttgctctgtatgtctagatacattcttttgctctgtatgtctatttttctggggggtttcctctgaaacacggttgagagagaaacaagtgaattcatttgaggttttggtccacaatgttggcttccattattttaatggtgaaaagccacccagaagtcattgttaggaggactttcctctttgagctgccatttgcatgctgttgtaaggtctaccccctcctttcatttggctggctgtgttagaaagacaaattctttcatttaaaaaaaaaaaaaaaaaaaaaaaaaaaaaaaaaaaataaaaaaaaaaaaaaaaaaaataataaaaaaaaaaaaaatattacaaataattg

SEQ ID NO: 5355 - DNA, 204 bp, Gossypium hirsutum
  Clone ID: uC-gsronu33B171a11b1
actatttctagcttgcgagacagcctacaccaaattgtttgagatgttcttgttagtcgttaagaccatgaatgaccgccgttttgtctcgacgtatgtaatcatttctccattttttggtgtctttcattttttacccatggttatttgtttggagaagaagaatttggcacttgaaacataattcgttgttaatgcttttgt

SEQ ID NO: 5356 - DNA, 446 bp, Gossypium hirsutum
  Clone ID: uC-gsronu33B171a12b1
acagaagaacaatgatgggttcgagaattttttcttttctctgggtgttattatgctgctgctgttgaccgccccagcttccaacgctgccatttcgtgcagtgttgtgataaaggacctgaggccttgcgtgaactatcttacgaaggggagcggaaaaccaccgtccgcttgttgtgcgggagcctccgctctggcatccgccgcctcgtcgtctgccgacaagaaggctgcttgtgaatgcatcaaatcagcgtctaagaatattaaacccaataaccaattagctcaggctcttccttctaattgtggaatcactttgcccgtcgccatttcaccaaatgtcgattgttccaaggttggttgagagcttggaagctgaaactgggagtgcttggatgggcatgaaggaattaaaaactccatgatagaagctcaattggttt

SEQ ID NO: 5357 - DNA, 256 bp, Gossypium hirsutum
  Clone ID: uC-gsronu33B171b01b1
cggatgcgtccccccacgcgtccggggaaattcggttttagttatgattgagacagccctaaggcgacagcaatataacttgttgaatgcattgttcatgctgctgaagtactgtaagagttggtttgtttttcacgtccatttattcttccatcagctgactgatgggcaatcaattgaagtggacgttgttaaatgtcatgaccaagatttgatatctaagcatatgaatgtgctgcctgatctgctgatagct

SEQ ID NO: 5358 - DNA, 72 bp, Gossypium hirsutum
  unsure (1)..(72): unsure at all n locations
  Clone ID: uC-gsronu33B171b03b1
atcngtcnaaagctaatttaaatctaactactcataaacaatggaaaaaaaattaaaagagaaatcttattg

SEQ ID NO: 5359 - DNA, 518 bp, Gossypium hirsutum
  Clone ID: uC-gsronu33B171b09b1
cccatgcgtacgcccacgcgtccggacgattccagcttcataattcgatcgagttctcaaaatttgtcatcaaggttttcacagagtcaaactcaggatgatgaaggtaaattagaagagaaacagagtcttgaaaacccaaatggctcgaagattctcccatttgaatttgttgcattggaagcatgcctcgaagctgcttgcagctgcttagaaaatgaagcaaagacattggagcaagaggcacatccggccttagataaattgacttccaagattagtactctcaatttggagcgtgttcgccaaattaaaagccgattagttgcaataacaggacgtgtccaaaaggtaagggatgaattggaacacttgctcgatgatgatgaagatatggccgagatgtatttaactgagaaacaactacttgaaaattcttcaacctcgtctatgaatgagagggatgatatggatgatgacattcttcgaccagacatcaatgagaggacacctgctga

SEQ ID NO: 5360 - DNA, 487 bp, Gossypium hirsutum
  Clone ID: uC-gsronu33B171b12b1
gccgtccttttcttttttttttaatcttaaaacagctttcttaattaacttcaaatccgaccaaaacagcaatagtcaatgcaaaacatatatcaagatccactacaacaaagttctggaaacaaaactcaaaaccatgtctaccaatggaggatattgtatgttccaaacaaaggcttttaaagggttcctactggtggttgatagtagcctaaggtttactcttcatcatcttcatcaccatctccaccagcagccttcttggcagctgctctctggttctttctcttcactcttccggggcggccacctccaaacggactagtaagagagaaatcaatatgcttttgggagtcgaccctcaccatgaaggacgggatgttcacaacctgtctcccgacccttatgtgtcgttgcctgatcaacacacgtgcatggtgaattgacttggccataccagtcttgaacacgagcgtttgcaaacgac

SEQ ID NO: 5361 - DNA, 325 bp, Gossypium hirsutum
  Clone ID: uC-gsronu33B171c04b1
cttgtaaatcagttcttcagcttccgatgccaacgaacgatatttagatgctaattactgagtagctgccagccacagagtactgttgctgtatgtgaaaccgataggagtaagcttttatctatcacttgtgtataaaaggaatgggagtgaagtacttgatggttgcagactcaaaaaagatgggtctgtcaatggcttgccaaaatgtgctataagtaaaaaaaaatgtacttatatttgaactctagttttaaagtatgagatgtgaagaacaatgttggccacaacttttgtagtgatattgttatatggattcaagtgt

SEQ ID NO: 5362 - DNA, 522 bp, Gossypium hirsutum
  Clone ID: uC-gsronu33B171c10b1
gtgattttttggacactacccagaccattatctggaatggaccaatgggtgtgtttgagtttgagaagtttgctgccggcactgaggcggttgccaagaagcttgcggaactcagtgggaagggagtgacaacaattatcggaggaggtgactctgttgcagctgtggaaaaagctgggcttgctgacaagatgagccacatctctactggtggtggtgccagcttggagcttcttgagggcaaacaacttccaggggtccttgctcttaacgacgcttaaacttttaattttgcacctctttgctttttttgaacattgttcactgctgtaatggtggctagtatttttatccaagagtgaattttagtagagctgaggttgtagaggctgatagggtggacttgttataaataaattggtttctcctcattatccattagagatgcattttggatggatgtcttttttgctaacctgaatgtaatgataaaattgcagtagtgcttgttcttttaatcta

SEQ ID NO: 5363 - DNA, 512 bp, Gossypium hirsutum
  Clone ID: uC-gsronu33B171c11b1
cccatcacatcttggattcctataactgtctacatttgcttgctgaattgtactcagcagcttcgaagttacagtttgactctctttgcgtggcttggcaagataactctggagacttacatttcacaatttcatatctggttgagatcagacatgcctaatggacagcccaagtggcttctttcttttatcccggaatatcccctactcaacttcatgctcacaacagctatttatgtcttgatatctcatcgtctgttcgacttgaccaataaacttaagtcagttttcattcccacaaaagacaaccgacggctgctatataatttcattgctggagtagtcgtttcagtgtgtttgtactgcacttcactcattcttcttcagattccccattcaactgcctgagaacgcatgaagttggatagcgagcgcttttacatcggacataccaaaaacatacataaatagttggagcagaataagtgaaactggaagacgtatacacgatc

SEQ ID NO: 5364 - DNA, 431 bp, Gossypium hirsutum
  unsure (1)..(431): unsure at all n locations
  Clone ID: uC-gsronu33B171c12b1
tactaacactctctcctccctcttagcaaccaaagactcagatccgctcggatttctttgtcccagaactagaatggagacctttctattcacatcagagtccgtaaacgagggacaccctgacaagctttgcgaccaggtctctgatgctgttctcgatgcctgccttgcccaggaccctgacagcaaggttgcctgtgaaacatgcacgaagactaacatggtcatggtctttggagagattaccaccaaagccaacgtagactatgagaagattgttcgtgatacatgccgctccattggatttgtttctgatgatgttggtcttgatgctgacaattgcaaggtcttggttaacattgagcagcagagccctgatattgcccaaggtgtccacggacactntacaaagccgtcagaagagattggag

SEQ ID NO: 5365 - DNA, 56 bp, Gossypium hirsutum
  unsure (1)..(56): unsure at all n locations
  Clone ID: uC-gsronu33B171d04b1
cccagtcgaacgcgtgaaganagntaaaggcaagagggtgtgttttaaagggaggg

SEQ ID NO: 5366 - DNA, 77 bp, Gossypium hirsutum
  Clone ID: uC-gsronu33B171d05b1
gcaataggcctacaagatcgagttgggacctcagccggttccattaactgttatgggagaagtggtcccctaaaacc

SEQ ID NO: 5367 - DNA, 250 bp, Gossypium hirsutum
  Clone ID: uC-gsronu33B171d09b1
ccatgcgtccggtgatcccattgtgcaaagctgtgttagaagcttatagggatcttggataccggggcaataggcaaaagactagaatgatgtggctgattgatgaactggggattgaagtgttcagatcagaggtagccaaaagaatgcctcagaaagagttggagagagcatctgatgaaggtttggtttaaaagcaatgggaaaggagagactaccttggtgtccattcgcaaaagcaagaaggatt

SEQ ID NO: 5368 - DNA, 350 bp, Gossypium hirsutum
  Clone ID: uC-gsronu33B171d12b1
ctactcagaccggttttccggtcagctcgtagcgacgtttggaatctggtgttagccttggttcaggcgagtatttcattgatgtgtttattggtacacctcctaaacatttctctttaatacttgatactggtagtgatcttaattggattcaatgtgttccttgttatgattgtttcgaacaaaccggcccgtattatgatccgaacgaatcgagttcgtatcggaatataagttgtcaagatcctaggtgcaatttggtttcaccccctgatcctcctctgccttgtaaaacagagaatcaaacttgtccttattattattggtatggtgatagttcgaatacgacc

SEQ ID NO: 5369 - DNA, 443 bp, Gossypium hirsutum
  Clone ID: uC-gsronu33B171e01b1
ccatcgatacgcccacgcgtacgctcgcagggggacccgactgtgtggcgaggctaggaagaaaagatagctcgacagccagtcaagaggattccgacaacataatgccaagcccaagagctaacgcaacttctctcatcgatctcttcaccaaattcaatctatccgtcaaggatctggtagccctctcaggctcacactccattggagaagcaaggtgtttctcaatcatgttcaggctctacaaccaatcaggctccggcaagcctgaccctgccatcgaaccagggtttagagaaaagcttgacaagctttgcccacttggtggagatgagaatgtgaccggagatctggatgcaacacccacgctgtttgataaccagtatttcaaggacttggttgcagggagaggggatctgaattccgatcaactctgttcacat

SEQ ID NO: 5370 - DNA, 378 bp, Gossypium hirsutum
  Clone ID: uC-gsronu33B171e03b1
aaagtaaaggctccagcaaagaagacagtcgctgtcttgaagctttagagtgttaaatctccggctaacaaagcggcgccaaagaaggcaaagaagtgaatcgaaaggagtgtttgtttgtaggaggttgttcttttttatttttgttccttcctttttttcctttgcagatggtgtaaatttgatggcgaggtaggggtagtcgtggaatttagatccatatatgtagtatgtattgattatataaagcaggttacgggttttattaatttatcctattttactactctgttttatgaaaaaactcattagtcaggtttcaatcgtggttggatatttatttatatgttttatttaataaaaatttaatatttatgt

SEQ ID NO: 5371 - DNA, 556 bp, Gossypium hirsutum
  unsure (1)..(556): unsure at all n locations
  Clone ID: uC-gsronu33B171e04b1
ctcatgaaaggcaatggaagnagccaaaggagctggtgcattgttctcatatgatccacaccttcgcttgccactttggccttcagctgatgaggctaggaaacagattttgtccatttgggataaggcagatattgtcaaggttagtgatgtcgagctcgagttcctcaccggtagcaacaaagtcgacgacgaaactgccatgaaactttggcgacctaactttacactgctcttggtcacccttggtgaaaagggtagccgatactacaccaagaatttccgtggggcagtcgatgctttccatgtcaataccgtggacacaactggcgccggtgactcctttgttggtgcattgctatgcaagattgttgaaaacccaaccattcttgaggatgaagcaaaattaagggaagtgttgaaatttgcaaatgcatgtggagccatcacgacgaccaaaaagggagccattcctgcactaccaaccgaagccgatgcccttgccttaatcaatggagcttagattttaagaacttgaataatttgcacattgttt

SEQ ID NO: 5372 - DNA, 545 bp, Gossypium hirsutum
  unsure (1)..(545): unsure at all n locations
  Clone ID: uC-gsronu33B171e06b1
gccattgntgccacacaacgagaccatggtagaagagttgatcgttaatatagtaggatgaaatattccattagctcttgggggattgaaaaatttagaaatgttgttgagcaatattatggaaagaaattcgagcctttccacgagttgccggaatgggaatttaagagttacttgggatggcacgagcagggtgacggtgctttattttgcgggctccatgtagataacggtcggattggaggaaaaatgaaaaagacactgagggaagtgatagagaagtataatttaaatgtgcgaatcaccccgaaccaaaacctcattttgtgtgacattcgtagtgcatggaggcgtcctattaccacagttctcgctcaagctgggttgctgcatcctagatatgtggaccccttgaacttaaccgctatggcgtgcccggctttcccactttgccctttggcaataaccgaagctgaacgaggtatccccgacattcttaagcgtgtcagagctgtctttgagaaggttggactcagtacagtgag

SEQ ID NO: 5373 - DNA, 448 bp, Gossypium hirsutum
  Clone ID: uC-gsronu33B171e08b1
gtctacagtcctgttattgccatttacatcgttaatcaatccttcttaacacttaattatggcagaaacccgtagctgtgaatttggaatttccggaatgaagagagcggcagcggctgatagctttgaagtggatgatgagatattcgtggccaagaaatctatgttgccaacactggcagtggcaccagcagcatgggaaaatgaccctgctgcctccttagccggtctgcgccatgaattcggtgagcatggtggcattaacatgtccattgaagcttccgccaccttcaccgtcatggaacctgagacaatgcgccgcatgttcactggcgaactgggccccgatcgtgatttcttcatttatagtcgtcacttcaaccccaccgtcttaaatctcggtcgtcaggtggcagccctagaaagaacccgagctgcctattgcact

SEQ ID NO: 5374 - DNA, 430 bp, Gossypium hirsutum
  unsure (1)..(430): unsure at all n locations
  Clone ID: uC-gsronu33B171e09b1
ccgttgcgacacgatggngncaacgatgctcctgctttaaagttggcagacattggtatcgctggccctgatgccaccgatgccgctcgaagtgcttcagatatcgtacttactgaacctgggcttagtgtcattatcagtgcagtgctgaccagtagggctattttccaaaggatgaagaactacacgatctatgctgtttcaatcaccatccgtattgtgtttggtttcttgttcatagccttaatatggaagtttgatttcgcaccgttcatggttttaatcattgccattctaaatgatggtacaatcatgacaatttccaaggacagagtaaagccatctccacaaccagatagctggaaactcaaagagattttctctactggcattgggcttggaggttatttagcactaatgaccgtgttat

SEQ ID NO: 5375 - DNA, 478 bp, Gossypium hirsutum
  Clone ID: uC-gsronu33B171e10b1
cccatgcgtcccaaaaagttatctcatcttgagcaaagttacagtcgtcctcatcgaacaactatggcagccatcaaagtccacggaagccctctgtccactgctacacaaagggttcttgcatgcctttacgagaaaggcactgattttcagtttgttcccataaacatggctgctggtgaacataaatccgaaaactacctttccctcaatccattcggtcaagttccagcttttgaagacggggacttgaagctcttcgagtcaagagcagtcacccattacattgctcatgaatacagcgacaaggggacccaactcttaattcctggctctaacaaggatatggctgtcttacaattatggaaggaagtggaagcccaccagttcgattctccatgttcaaaaatagcctgggaggcgttttacaagccattaatgggcatggttaccgactccgcggtcgtggaaagaaatg

SEQ ID NO: 5376 - DNA, 191 bp, Gossypium hirsutum
  Clone ID: uC-gsronu33B171e11b1
cccatgcgtcccgttacttctcagtcaaagacaaatttcttgtttttgaggataagctatggtgtgtgtatgtgtgtgtttttctttcttcttcttcctttttttttttttaccaaaagcccaccgcgttcgcccacgcgtccgcccacgcgtccgcccacgcgtccgcccacgcgtccgctagatcgcga

SEQ ID NO: 5377 - DNA, 424 bp, Gossypium hirsutum
  Clone ID: uC-gsronu33B171f01b1
tttattttattttaattttttgtattattttatatatttatttttttatttaattaatttttttttattttattttcttatttttttatttttttttttattttttttattttttttttttttattattttttttattttttttttttttttttatttattttatttttttttatattttttattttattttttttattttttattatttttttttttttttttattattttttaaatttattattattttttttattttttatactttatatttattattaattatattttttttttaatttttaattatattttatattttatttattttttttattatttaataattttttttaatattttatttttttttttttttttttatttactttatttttgttattatttttttttttttttatt

SEQ ID NO: 5378 - DNA, 242 bp, Gossypium hirsutum
  Clone ID: uC-gsronu33B171f02b1
cccatgcgtccggtaatttccaagttccttcttcaattcattatctctcttgtctctgcctttcattccatcactcacgaaatccagcgatcaaggtttccccaaactcccttcaaatcctcgtctcaacaatttttttttaaagcctagcaaaatggcgtccacatttagcggtgatgaaactgctcctttcttcggcttcctcggagccgctgctgccctcgatctcctctgtacgggtg

SEQ ID NO: 5379 - DNA, 344 bp, Gossypium hirsutum
  Clone ID: uC-gsronu33B171f04b1
gtaagtttcatcccacataacatcactcttctcccacggacccaaccactttcctttctatcccaccattttcccttttttttttttgttttctaaaacatggccaacacactacttcacaaacctctcattaccttcttcttctttttcttcttcagcttatttattcaaaccaagcaagataacccatgtccgtatccatgttacccaccaccaacaggaaccggcggcggtggcggcggcacagtgacacaaacacctccagctagttactcaccacccttccaaacaggagtatatcctccacctacagggaacttaccatattactattcaccaccacc

SEQ ID NO: 5380 - DNA, 496 bp, Gossypium hirsutum
  unsure (1)..(496): unsure at all n locations
  Clone ID: uC-gsronu33B171f05b1
ggaactcagaggagattccatggggcgagaccggagctgaatacattgttgaatcaactggagtgttcactgacaaagacaaggcagctgcccacttgaagggtggtgctaagaaagtaattatatctgccccaagcaaggatgctcccatgtttgtcatgggtgttaatgagaaggattacaagccggaatatgacattatttccaatgctagctgcactaccaactgtcttgctccccttgctaaggttattcatgacaaattcggcatcattgagggacttatgacaacggttcattctattacggctacacaaaaaactgtggatggtccatcaatgaaggactggagagaggngaagagctgcttcgttcaacatcattcctagcagtactggagctgctaaggctgttggaaaagtgcttcctgccttgaatggaaaattaactggaatggctttccggtgttccaccgttgatgtttcagaggttgacc

SEQ ID NO: 5381 - DNA, 288 bp, Gossypium hirsutum
  Clone ID: uC-gsronu33B171f07b1
cccatgcgtacgccaatctctctttttaaattccctggtgtaatgtttgttcgaacacgcgtgagagccccacatgcccgctacaaggagaagcctgggtgcgtcacctttccaatggcatcgccgtccctcctacgtgcaacctgtgcgcttctagagtgctgaggctccctgtccctaagacaagcttgcgcgcgcgatggagggtttctcgagggacttgctgtgcgggattggcaagggggacgcgccgccaccggagaagaggccggggcagctgctggagga

SEQ ID NO: 5382 - DNA, 58 bp, Gossypium hirsutum
  unsure (1)..(58): unsure at all n locations
  Clone ID: uC-gsronu33B171f09b1
gtgatactgaccctcagacgnaaagagcaaaaaacatttgttgtttttcaatggaagg

SEQ ID NO: 5383 - DNA, 418 bp, Gossypium hirsutum
  unsure (1)..(418): unsure at all n locations
  Clone ID: uC-gsronu33B171f12b1
aacccgcggatgaaaaaccaccaacgngnaaagaaananagggttgaatttaaaaaagaaagagcccggaaaggcccccaaacaaactaaagatgaaaaaaacaaaactacacaaaaaaaaacaaacaacaaacaaaaaacaaaaaaaccaaaatacaacacaaaaaaccaacaaacaaaaaaacaaaaaaaaaagaaaaaaaaaaaaaaaaacaaaaaaaaaaaaaaaaaaaaaaagaaacaaaaaaacaaaaaaaaatataaaccaaaaacaaaacaaaaaaacacaaaaacaaaaaaaaacaacaagaaaacaaaaaaaaaaaaatcaaagaaaacacaacagtaaaaacaagacaaaaaaaaacaaaaaaaaaacaaaaaaaaaaaagacaaaaagacaaaaaaaacgaacaag

SEQ ID NO: 5384 - DNA, 407 bp, Gossypium hirsutum
  Clone ID: uC-gsronu33B171h01b1
cggactcttgggcgaatttctcagcaaccaaacaaaatcttccattgtcttctagaactctccaagcacactagagttaatcaatggctcgtacaaagcaaacagccaggaaatcaaccggtggaaaagctccacgtcagcaactggcgacgaaagccgcgaggaaatcagctccagccaccggaggagcgaagaatcctgaccggctaaggccatgaacagagggctggcgagagagctctgacaggacgaaaccagacgccagccatagagctgtccctggactgggtgccggttgggctggacgaactgtagagcggctacgaggggcattctctgttcttacgaagatgcgcccccaagatcggcgcgttctatttcctggaccagctgctcatggggttcga

SEQ ID NO: 5385 - DNA, 99 bp, Gossypium hirsutum
  Clone ID: uC-gsronu33B171h02b1
ccaagtacttatctggcattcaagcttctattttcctgatgttattttagttcgggctgcgatatccacagattagacaatgtagtggtggctactaag

SEQ ID NO: 5386 - DNA, 329 bp, Gossypium hirsutum
  Clone ID: uC-gsronu33B171h12b1
gcctttgccggctacatggagaagaatttgaacaaaaatgggatccagttttacagatatgtttactgtaatgatatagttcctagggttcctttcgacggcatgttcaagcactttggtacctgcgtttactacaacagcaaatatcaagcaaagatagttgaagaagtaccatacttgaactacttctcgctgtatggattcttctcgatgcatatgaacgccatttatgaggtgataagatgctttacactgattgttaaatatggagctctctatatcatctggttcgcttctgttttctacttctcctccctcttttactatac

SEQ ID NO: 5387 - DNA, 533 bp, Gossypium hirsutum
  Clone ID: uC-gsronu33B172a07b1
cccacgcgtccgcccacgcgtccgctttaacaagttgactgacaacggagcaaccaccccggctggtctcgtagccgccgctctagctcatggcttcggtcttttcgtcgctgtctccgttggcgccaacatctcaggtggccacgtcaaccctgccgtcaccttcggtgcttttgttggcgggaacatcactctcttgcgcggcattctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccctggttagctggacat

SEQ ID NO: 5388 - DNA, 431 bp, Gossypium hirsutum
  Clone ID: uC-gsronu33B172a08b1
cattctggttctgtgaatgtaactgctggaccttcgaacaagagcatggcatacgcggtggatgctatcctaaatggagtggagatcatgaagataagtaactggatgggtagtttcgacggtacgttgcctgcagagtcagttttgaagtgtttgccaaggaaaagaagagttggttttctgcttcctttgattgctcttgtgtgtttattgctgagcttatcagcaatcatacgtaggaggaatgaaaaggtggagtcagtgctatggtcaaaattgccaatggaggtccatgaaatttctccaaagcaaggtaaacaacaattatcaagtaaagtataaatacatggttatggatccactgggttttgtgatataataccgcatactaatggtggctatcagttcccatcatattaaatagtttgttt

SEQ ID NO: 5389 - DNA, 308 bp, Gossypium hirsutum
  Clone ID: uC-gsronu33B172b01b1
tctgagatattattttctaggaacaaagaatcaaaagtcaacatttcttatattttttgcatttcaagtatgaaccattcaacggagacaaattgagcatatttcattgtcaattgaagaccatgtattccagacttggttgtgtcatcacttcatttctatctttcatgaagtctttccattattggatgtgccttttttttttatttcttaggtgataaggaggaatcaccctgccatgcaatcttggtataaattgcttaaagtgaaacgcctctgagaaagagactgaggggaagattgtccac

SEQ ID NO: 5390 - DNA, 196 bp, Gossypium hirsutum
  Clone ID: uC-gsronu33B172b02b1
cccgggccggaaaacccgggacgacccacgcgaccgaaaaaactctcggctcccagcccaaaacgacgcaaaaacaagggaaggggcacgaaacaaaaacggggaggggcacaccgagaagcagaaaaagacgcaagagaagacggaaacacccgcactagaacggcccgcacgacaagaacacggccggcccccc

SEQ ID NO: 5391 - DNA, 435 bp, Gossypium hirsutum
  Clone ID: uC-gsronu33B172b05b1
cctgatactggatttcagcggaaaataccttccaccattcaagtgtttgactcacgagcaagagaaagatgttgataaactcataactcgtttggttaccaaggaagaagcacatgttgcactgatggagctcatgaaatggagatcagaagggttagaaccactctatgctcaagcctaacacctttggcaacagaatccacaggatgctgaaactcggcttgagcattgatgaggatgctgatgccgaaggcagcaagatggaggaagttgattaagcctaacatgtttttataagatcagtagatttatcttacttttgaagcatctgttagcttgttttacattttgtttggtgcttttgcttttggtatgttgctgctagctattggcgagtactcttaaatgataagtgctgttattttctgggttatt

SEQ ID NO: 5392 - DNA, 506 bp, Gossypium hirsutum
  Clone ID: uC-gsronu33B172b07b1
ccctcgctgtccgcacaaagctctcagttcttaacgtcttctgcgtttaatataaaaatggcggcttcaactttgtgttgctcatcttctccattggtatcagacagagctaagccttcttgttccattaaagctgtaacgccattctctgtatcttttccatccaagaatccctgcatcagccgactctctcttgtaagggcacaggctgctggggataataacaaagatacgtcagtggacgtgcatgtcaacaaagacaaccaaggcacagctgttgagaagaggcctagagggctggctgtcgatgtctctccttttggtttgctggaccccttgtctcctttgagatcaatgcgtcaaatgctggacacaatggaccggatattcgaggatgccatgatattgccgggcagcaagagccgaacaggaggacaggtgctgcaccgtgggatatcaaagaccatgaacaagagatcaaaatgcgattcgacatgccaggactg

SEQ ID NO: 5393 - DNA, 424 bp, Gossypium hirsutum
  unsure (1)..(424): unsure at all n locations
  Clone ID: uC-gsronu33B172b11b1
ccttacctttttagttncacctcaacaaaacacctacaaagcatatatgccaattgagagctcttccactaatggcccaaccgtctgtgtcaccggtgccggtggcttcatcgcctcctggattgtcaagcttcttcttgaaaaaggttacactgtcaagggcactgtaaggaacccagacgatcccaagaattgtcatttgagagagcttgaaggagcaaaggagaggctatctcttcacaaagcttaccttcttgattaccaatctcttaaggaagccattagcggttgcgatggagttttccatactgcttcacctgtgactgatgatcctgaacaaatggtggagccggccgtgattgggactaagaatgtgataatggcagcggcagaggccaaagttcgacgtgtggtgttcacatct

SEQ ID NO: 5394 - DNA, 241 bp, Gossypium hirsutum
  Clone ID: uC-gsronu33B172c02b1
gccaactctccgtttttgaaggggacacttttgatcatgtgggctgatttaacattgattggactataacctcacggtctccatggaactgctcacatattcaaggatactctgccatggtttccccagaaacttgtgaacctctcaaggaaagtatctaccccaaccattcttcagattgttaccatctatccaatcatttgcggagttcaggccatcaaaacaaaggctcttggttaca

SEQ ID NO: 5395 - DNA, 522 bp, Gossypium hirsutum
  Clone ID: uC-gsronu33B172c03b1
cgtaattgttggttatggagtgcttgggtaccaaaacaattcacccataccacctaaccatatggcagttttgggtccagggaatggtctaagtgtgtggaacagatcatcaaagccattgagatttgtgctcattgcaggtcaaccgttgaatgaaccagcggttcagcatggtccttttgtgatgaacacacaagctgagattgatcaaaccattgaagactatcactacagcaaaaatgggtttgaaatggctaagcactggagatcacattgagtgatgatacgatttgaaaagccctttaccaacaatgacagcatctccaaagaataaaaaaagggcaccccatatatatatatatatgtatgtatatggcattcactatctccatccatgatagagagaggtgagataggagagctgaaaaggagagatttcctactcattggagccaaaaaaaaaaatgcttctagaagtccaaagtgcaagcttggagagtgtgtgcatatttagttcatcac

SEQ ID NO: 5396 - DNA, 499 bp, Gossypium hirsutum
  Clone ID: uC-gsronu33B172c07b1
cgttcgacttcctgccgccgcaacaatgaagtacaacccgcgtgtctcctcctctcgccgcaagagccgaaaggcccatttcacagcaccttcttccgtccgccgcgtcttaatgagcgcacccctctcatccgatctgaagtccaagtacaacgtccggtctatgccggtgcgcaaggatgacgaggtccaagtgattcgtgggacctacaagggacgggaagggaaagtggttcaagtgtaccgccgcaaatgggtgatccacatcgagcgcatcacgcgcgagaaagtgaacggttccaccgtcaacgttgggatcaacccatccaaggttgtcatcaccaagctgaggctggacaaggataggaagtctttgctggatcgtaaggctaaaggacgcgtcgctgctgataaagataaggggactaagttttcagctgaggatataatgcagaagcgcgatttagggtgggttttttctttttcgttcttttttttt

SEQ ID NO: 5397 - DNA, 435 bp, Gossypium hirsutum
  Clone ID: uC-gsronu33B172c10b1
tcgaacgcttagcgtccggaacaagaacccagccttctgatctctggggcaaagctaaaaagatctcatcttttacaaccacaggtactgcttatttattttcatggctcaaggagattctaacttccagcaagacatggctaaagaggaagaagaacagaggctgaaatacttggaattcgtgcaagtagccgtcgatcacgccgatttgtgcttcaccaaccttgacctttacgctaaggaaagatcggggccgtagaaacctagcgacgagaccgttgagggaacggctaagtgcgtggctggaccggattatgataaataccatgatgtccctgttgaattccttaaattcgcagattcccaggtgggtgaatcagtgacccagcttgaacgtcgagttccttcaggcttaaacaggtctaaccgaagcca

SEQ ID NO: 5398 - DNA, 460 bp, Gossypium hirsutum
  Clone ID: uC-gsronu33B172c12b1
tgtcctgtaattttgcctgccgctccatctctacatcacaggaatggcgacagaagttgcaccccccgccaccaccgcacccaaagaccccacccaacctcaccttgaagtaaaactcttcaatcgctggagcttcgaggaagttcaggttgctgatatctccttgagtgattacattggtgtccaagcttcgaagcatgctacctatgtgccacacactgctgggaggtactcagttaagcgtttcaggaaggcccagtgcccaattgttgaaaggcttacaaactcacttatgatgcatggccgaaacaatgggaagaagcttatggcagtcaggattgtgaagcatgccatggaaattatttatctcttgactgatcagaacccaattcaagtcattgttgatgctattatcaacagtgggccacgtgaagatgctactcgaattggttctgctggt

SEQ ID NO: 5399 - DNA, 161 bp, Gossypium hirsutum
  Clone ID: uC-gsronu33B172d06b1
cccacgcgtccgcttccattagcatcgaaatcactccagttttctttatcactgaaaaatgtcttgctgcggcggaaactgcggctgcggttctggctgcaagtgtggcagcggctgtggaggatgcatgatgtccccagaccctgacggtgccgatatga

SEQ ID NO: 5400 - DNA, 486 bp, Gossypium hirsutum
  Clone ID: uC-gsronu33B172d09b1
ccctctcgtccgaataaataataaataattaaataaaccaccacctttttctctgatcttctttattttctctttattttttctttttttttgccttttaatttctcaggttaccctgctttgtacgaatcggctgaaactcgaaggttaatatcttctttggtactttgaatgaaggatgtctactggagatgttaaaagggtttcgcgccaggatatacagttggttcaaaaccttatagaacgatgtcttcaactctacatgacgcagaaggaagttgtggaaactctgctggctcaagccaaaattgagcctggttttactgaacttgttctgcaaaagcttgaagaagagaatagagaattcttccaggcttattatctgagactgatggtgaagcaacaaatagtggaattcaacgagctgcttgagccacaagttcgattgatgagtcagattcgtacagctggagtttcctcaatctc

SEQ ID NO: 5401 - DNA, 119 bp, Gossypium hirsutum
  Clone ID: uC-gsronu33B172d10b1
tctctaggtagtagccgaggaaggtattgctgtcggcggtggatgtactttgctgagacttgcttctaaggccgacgctatcaaggattcacttgacaatgatgaagaaaagcaaaggc

SEQ ID NO: 5402 - DNA, 289 bp, Gossypium hirsutum
  Clone ID: uC-gsronu33B172d11b1
agtctggcttcgattcgaaagtgggctcctgttgccattgtgttgggagttgtgttcctcctcttctgggtgaaagcaaagttatggtgattcaactgtgatccatagtgttaagaactcatcagaatttcttgggtttctctgttgctgagtaacctcttgtccacacccaagaccaaatattggagtgcattctggtttttattcatctcacaattcgcctcgtaggtacaattacaaattcgcaatgtggaactgtgtgaaagggagcatctgctcaaaacaaaaa

SEQ ID NO: 5403 - DNA, 449 bp, Gossypium hirsutum
  unsure (1)..(449): unsure at all n locations
  Clone ID: uC-gsronu33B172e05b1
cccacgctttcgctttgctaaacttgntgctactttcttcttggctctcattgccatctccatggttcaaactttggttatggcatcacatggacatggtggtcaccattatgataacaaacgttatggacctggaagtctcaagccttaccaatgtccatctcagtgcacaaggaggtgtagccagacacagtaccataaaccatgcatgttcttctgtcagaaatgttgcaggacatgcctttgtgttcctccagggtattatgggaacaaacaagtttgcccttgctacaacaactggaaaaccaaggaaggaggccccaaatgcccttaaattactcaaaagaagaccctttttttttttacattattatccctataaatttcctatttgaaattcaagtcatttaagcataaggttgcactgtaatactaactatatattttat

SEQ ID NO: 5404 - DNA, 419 bp, Gossypium hirsutum
  Clone ID: uC-gsronu33B172e11b1
cctttctctcctagtggtacggcaagaacgcaaagttgcgtgagttgtctaacctcgtagttgcaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgtaacggtggaccagccgagattattgtccatgggaaatctggtttcaacattgatccttaccatggtgatcaagctgctgacatactggtcgatttc

SEQ ID NO: 5405 - DNA, 421 bp, Gossypium hirsutum
  unsure (1)..(421): unsure at all n locations
  Clone ID: uC-gsronu33B172f04b1
tcgacctattagctcttcttgtcttttcactntcaagctctcatggctgccattattgaatctgggtggctgtatctgatcacgcacttcagtgacttccaactagcaagtctaggaagtttctttcttcacgaaagtgttttcttcttatccggacttccatttatatatctggaaagagctggattgctgagcaaatacaagattcagacgaaaaacaacagccttgctgctcaggaaaaatgtatcacccgcctgcttctgtatcacattggtgtcaaccttccgcttatgattgcatcttatcctttcttcagattcatgggcatgaagagtagtctgccatttccatcctggaaagtgggtctgtcacaaataatattctatttcatcctggaggattctgtgttttactggggac

SEQ ID NO: 5406 - DNA, 435 bp, Gossypium hirsutum
  unsure (1)..(435): unsure at all n locations
  Clone ID: uC-gsronu33B172f06b1
tcggacgcgtgtgctttcgcgtgggctgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaatttaagctgttaaataacattgggccggtttttcttggagaataatattctgctttgtaatttcaattggagaagctcttttgtatttcatcttgtcttttccttttccttttttcgccggcattgtttgaacatggggttgtgcgcccgtcaattccagttaaatatggtgacttttgtttttcaaannaaaaa

SEQ ID NO: 5407 - DNA, 514 bp, Gossypium hirsutum
  unsure (1)..(514): unsure at all n locations
  Clone ID: uC-gsronu33B172f08b1
aacgagaaaaangggaaagaagggaagggtttaatttaaaagnaggcggccggaaacgacccccaaaaaaaaaaaaagaaagaaccatgaccagagatcaaaaaaaaccaaaaaacaaaaactagaactaccaaaaaaaaaataaaatgacaacaacaaaaaaaaaaaaaaaaacaggacaaaaaccaaaaaaaaaaacaagacaaaaaacaaaaacaaaaaaaccaaaaacaaaaaatatcaaaaattcaaataaaaacaactaacacaaaaaaaaaaataaacaacagaaaaaacacgaaaaacagcaaaaaaaaacaagataaaggaaaaaaaagacaaaaataataaaaataaataaacaaaaaaaacataaaataagaacataaagaagaaaaaaaaaacttaaaaaatgagaaaaaccacgattaaaactaaatagaaaaaggaaacacaacctagcataaaacaaaaaaaaacaaaaaaaaaaaataataacaaaaaagataaccac

SEQ ID NO: 5408 - DNA, 442 bp, Gossypium hirsutum
  unsure (1)..(442): unsure at all n locations
  Clone ID: uC-gsronu33B172f12b1
cctttacctaaggccctatgttgttagccttcctgatggtagtcatagtagtggtgctgagaatggcaggcattggggaaggcaaggtctagacttaaatgctgggcctggaggcccagacattgaaggaagagatgagatggtacctcttccatcaaggcaactgtctgttgccggttcacatacccaggcagaggagcaagcaagaatccatcaggttcctggtggtattttgaaaaggaaggaacccgagggaggatggaatggatacaagcaatcttcatggcagtagtaatcaagaatccttaaatgtcacattctgatgactcaaggtattcagggatgggaattagctaaaaccccagaggtcatctaccctgtgtgctcttagaggatgggtggcaagtgagccatttgatgttcatagtctncgacccccaca

SEQ ID NO: 5409 - DNA, 185 bp, Gossypium hirsutum
  Clone ID: uC-gsronu33B172g06b1
ggcccggaattcctgggtgtaccacactcgtcttccacacgcgtccgatgataagaagctgcttgggcaatttcaaatgctacttccggtggcacccacgaacagataaagttcctggtgagccaaggttgcattaagccattgtgcgatcttttaaactgtccagacccaagaattgtgacagt

SEQ ID NO: 5410 - DNA, 411 bp, Gossypium hirsutum
  Clone ID: uC-gsronu33B172g12b1
caaaaataaaaaggaaaaaaaaaaagaaaaagacaaacaaagaaaaaaaagaaaagcataaaaaaaccaaaaaaaagaagaaaacaaaacaaaaaaaaaagaaaaaaaaaacaataaaaacaagaacaaagaacaaaagaaaaaggacaaagaacaaaaaaaaagaaaaaaaaaaaaacagaaaaaaaacaaaaaaaacaaaataacagaaaaggaaaaaaacaaaaaaaaaaagaaaacaaaaaggaaacaaacgaaatgaaaaagacaaaaaaacaaacagaaaaaaaaaaaaaaacaaaaaaccaaaaataaaaagaaaaccaacaaaaaaaacaaagaaaaacaaagaaaaaaaacaataaaaagaaaggagaaaagaaacaaaaaacaagaacaaacacaacatgc

SEQ ID NO: 5411 - DNA, 513 bp, Gossypium hirsutum
  Clone ID: uC-gsronu33B172h05b1
aaaaaaaaaaaaaaaagagggaaggttttaaaagaaaaaaaaacgggaaaaaaccccaacaaaaaaaagaaaaaaggaaaaaagaaaacaccaaaaaccaaaaaaacaaaaaaaaacaaaacaaaaaaaataaagaaaaacacaaaaaaaaaaaaacaaaaaaaaaagcaacaaaaaacacaaaaaacaccaccccaaaaaacaaagaacaacccactagaacaacaccaaaaaacaagcaacacaaagaaaaaaaccgaaaaaaaaaaaacaaaaaaaaagcacaaaggaacaaaaaacaaacaacacaaaacaacaaagacaaaaaaacaacaataaaaaaataaaaaacaaacacaaaaaaacaaaccaacaacacaaacaaaaaacaaacaaaaaacacaaacacacaacacgaggtcaaccaaaaacaaataaccaacgcaaaaaacaaacaaaatcacacacgacactaaaaaaacaacacaaacaacaaaaccaagacacaaaaac

SEQ ID NO: 5412 - DNA, 145 bp, Gossypium hirsutum
  Clone ID: uC-gsronu33B172h11b1
acgcgctcgcgtggtccgcatactgaaagcaagggaagccggcgagttgaataccgatgccactctcactgaaatgctccgtgaaatagtaggaagagagagggaggaaagcaccgctgacattccgaatgactatgacaagctc

SEQ ID NO: 5413 - DNA, 536 bp, Gossypium hirsutum
  Clone ID: uC-gsronu33B178a01b1
cctttctctcgtgaagctctatggatgtacctcgagacgtagtctagagcttctccttgtttatgagtacattcctaatggaaccgtggctgatcatttgcatggaaagcgatccaactctggtttgcttacctggcatgttcggttgagaatcgccttcgagacagcgaccgcattggctttcctccatggaaaggaagtcatacaccgcgatgttaaatccaacaacattctcctggacaagaatttccatgtaaaagtggctgattttggactctcacgactttttcctaatgatgtcacgcatgtctcgactgctccgcaaggcaccccgggttatgtcgacccggagtatcaccaatgctaccacctcactgagaaaagtgatgtttacagcttcggggtcgtgttggtcgagctaatttcggcgaagaaagcagtggacatcagcaggcaccgacacgacataaatttggctaacatggcaatcagcagaatccagaatcaagcattgcatgaactggtggatccatctc

SEQ ID NO: 5414 - DNA, 534 bp, Gossypium hirsutum
  Clone ID: uC-gsronu33B178a02b1
gtttcttgtgttattccccttcctcctcaggaggagagggaactaaaggagaccttgcaggaaataattggacaggggaagcaggttaagctggaacagaagatcgatcctagtattcttggtgggcttgtcgtagagtttgagcaaaaggtatttgacatgtccattaagactagggcacgacagatggagaggttcttgcgtgagcctatcaactttggttccctctgaaggatgttataaccgccaagtgaccatttcagtttccttgtgcaccaattgggttattccgagaactgcaaagaataattaatggtctttttgttttgcctctgttttcttctactcttgacattatatgatggaatgcatccattcacaataaaagaaactttctcggcatttattattttttatctgggaaaattactaaaataccgtttgtatggctttttgtgtatggttgctttgacttatatgatggaatgcatccattcacaataaaagaaactttctcggcatttatttttttta

SEQ ID NO: 5415 - DNA, 539 bp, Gossypium hirsutum
  Clone ID: uC-gsronu33B178a03b1
atttcttaaaacctaaagattctctctcccaaaccagaccttcaaatttcagcaagagagagagagagaacttacatagctcagacttcgatcatcaatttagggtttcttaattcgattccccgattacccgataccccaattttacagatcaggtctgagtgttctagttgttcggctgtttctatccgctaagtttcatgtctgatcttgacatccagattcctactgcctttgatccgtttgctgatgcaaatgctgaagacgctggtgctggtgccaaggaatacgttcacattcgtattcagcagcggaacggtaggaaaagcctgaccactgttcagggattgaagaaagaatttagctataacaaaattctcaaggacctgaagaaagaattttgttgcaatggcaccgttgtccaggacccagaattaggaaaggttattcaacttcaaggagatcagaggaagaacgtctccactttccttgttcaggcttgtattgtgaagaaggatagcatcaaaatccacggtttt

SEQ ID NO: 5416 - DNA, 64 bp, Gossypium hirsutum
  Clone ID: uC-gsronu33B178a04b1
tctcttgtccgaaaaaaaaaaaaaaaaaaaaaagaaaggaatttttaaaaaaataggggggatc

SEQ ID NO: 5417 - DNA, 450 bp, Gossypium hirsutum
  Clone ID: uC-gsronu33B178a05b1
cacctccatagctgcaaaaggaaagaaaaagggtttctcctaaaaaaaaaagggcacaaacaaacaacaaaaaaaaaaaaaaataaaaacacaaaaaaaaaaaaaaaaaaaaaaaaaaaaaaaaaaaaaaaaacaaaaaaaacaaaaaaaaaaacaaaaaaaaaaaaaaaaaaaacaaagggggccccccccaaaaaaaaccaaagctaacaacccccgcaccgaacgacaaaaccttttcattaactgcccaaaaaaaaaataaacggcccccttataaaaacccttaacccggaaaaaccccgggggtcccccaaaaaaaaaccttaaaaaaaaggccccccttcccagaggggccaaaaaaaaaaaagccccccccaaaagccctttccaaaaaatggcccccccaaaaggaaaaagggacccccccctttaacaacccaaaaaccc

SEQ ID NO: 5418 - DNA, 398 bp, Gossypium hirsutum
  Clone ID: uC-gsronu33B178a07b1
tcttagtggctgacaactaggctcgccgatagaacattgcctcgatttttttatatttgctctgttcctatacccaaacatcaatttagaataaggttcaaaatgttatatttttgttcttttttgggccaaaaaacgttatatttttgctagacatttgtggttgtaagtgtttttccaggaaaactttgggcttcattgccccttttctttaaatttgacctcataattttcccttttaatggggccattttatgatgttttctgagggtcggccttgatcggttcgtagacaatgttattgtaatgtaatgcttcgcagacagtttgtgtattgagtttttttccccaaatataattttatgaaattaaaaatattttattatctttattatatt

SEQ ID NO: 5419 - DNA, 59 bp, Gossypium hirsutum
  Clone ID: uC-gsronu33B178a08b1
gtttttagcgtgttaaaacgatacctaataaaagcaggttatataaaaaatgcagagag

SEQ ID NO: 5420 - DNA, 167 bp, Gossypium hirsutum
  Clone ID: uC-gsronu33B178a09b1
ttttgttcatttttatgtgagattcatatgtcaggtcagtataattcacactttgtggcgtatacccagacacagtcttcattcgttttgttattatcattatagtttatcatatggagtgagatttttgtatgtttgaataaaaaagcttgattcatttgctttcc

SEQ ID NO: 5421 - DNA, 277 bp, Gossypium hirsutum
  Clone ID: uC-gsronu33B178a10b1
tctcttcgcgtccggttgaaggcatggatgtggttaaagcgattgagaaggtggggtctagcggtgggaggacttccaagcctgttgttattgctgactgtggacagctttgaaaaagggcttattgaattgtgtttccttcataatatctggtctttttaggctccttttttttatgctatgctgcttctatggctactgggttttggtgttttttaagaagttgcttgatgtagctttttcattaactgccataaataagataggctttattttc

SEQ ID NO: 5422 - DNA, 494 bp, Gossypium hirsutum
  Clone ID: uC-gsronu33B178a12b1
ttgtttctcgtgggcggacgcgtgggatttgtaggagcaaaatcacttgtaagctttacaggaaaaagggggaaaaaagtgaggatcaagcatagatggaaaacatgggagttctaggcaaggtggtggattaccttctattgttatcattcttcagcatcacattaacagctcagttggacatccccgagtccatcctcccccacgcctacaatcccttctatcaagtttataccacgttaacccaagattatttggtgcttgagcagcctgcttttttcaaggcacttatgacgttggaacttgtttaccaactccctctcgctttgcttaacatctatgggttgttatactctaagccctggttcaacaccacctgcctcctctttggtgcctctatcgttgcctctacgacagctatggtgggagacattctcaattcccagaaggcatcagccaatttgatggccatgtattatccaccgtttctttca

SEQ ID NO: 5423 - DNA, 440 bp, Gossypium hirsutum
  Clone ID: uC-gsronu33B178b03b1
gtttttgtcggtgcacttattaccgctggagtgctgactgcggggttgatcagttgtagacaaggaaattctcagttgggtcagatgctgatgcgagctagggtggtagttcagggagctacagttgctcttatggttggcactgcatactactatggggataatccctggaaatcgagttagaacactcggtttcatggttgcaaccattatattgtttttattttgatatgcaatttctttttatagctatagatgttgaacaaaagcatcataccaagaaagcaaatgccctcagattgatatagcttgggaataaattaaatatgctctatgcatgtcttattctaagatattattatttggtacatatgtatatgtaatgttgaatatgtatttgtttaaaacccaaaggatagggacaaagaaccagctgctca

SEQ ID NO: 5424 - DNA, 513 bp, Gossypium hirsutum
  Clone ID: uC-gsronu33B178b05b1
ccttttcttccgataaaagtcggtattggcttcgaggcagagccataaaatcacctggttaagcaatctcttccttaaatccaaccattaaaaaccctcgtttcttaaacatcagatcggatccttgaaatctccatcgattcatttttggtacagttttcgtagtatcgatcaaacatgagtttcctctttgggaagagaaaaactcccgcagagcttctgcgggagaataagaggatgctggacaaatctattagagagatagagagggagaggcaaggtcttcagaaccaagagaagaaactgattgcagagataaagaaaactgcaaagcaagggcagatgggagctgtaaaggtgatggcgaaagaccttatccgaactcgacatcaaattgaaaagttctataagctgaaatcacagctccaaggcgtatctcttcgaattcaaacattgaaatcaacacaagcaatgggagaagcaatgaaaggtgtgacataggcaatgggccgg

SEQ ID NO: 5425 - DNA, 484 bp, Gossypium hirsutum
  Clone ID: uC-gsronu33B178b06b1
ggttttcttagcttctaaaatacttttaaatctgcatgtttaatgctaaacattgaagttgtattttgcttagttggatctgcaagatggaaagcatgaatagcttttggcagttaggagatgatctccggggacaatctaaagcctcagaggatcacaaatggttgatggttgcctccaaactggctgaacaaacgaggataaagggtgagcgtatgaacaatctcgacctttcaaagggtccagctgaagtaaggacaagggataaatttgggttccatgaagacaacaaattcgagaaccttaacttcaatatgttgaacttggactccaagatcggagatagtataagcaaaagtaccttccgaaatggtatttacaacaccgatgctgtttaccagaaaaataacagccacaacattgggaacctgtctgccaacaaatatagtggcaacaaccattgcaacaaagatattaataataa

SEQ ID NO: 5426 - DNA, 400 bp, Gossypium hirsutum
  unsure (1)..(400): unsure at all n locations
  Clone ID: uC-gsronu33B178b08b1
tgtccttgctgatcttgaagctgccgtttgcctttgcacggcaatcaaagcaaatattttgggcatcaaccttaatgtcccactttccctcagtttgcttcttaatgtctgctcaaagaaagtaccctctggcttccaatgtcgctaaatcagttctctaaattctttctcttcttagtgctgcgtggttttgatgttcttaaggtccagtttgaagtgatcaatgttttctcggtaactggtcgtttaatctacgatgttgtagtgttgtttccttttggattgattctgaataaatgtaacaccatataaaaaagaagatgtttaatttctttggatttatgtatcttcatggggaatgaaatattagtataattcagctatgtttcatcccananna

SEQ ID NO: 5427 - DNA, 420 bp, Gossypium hirsutum
  Clone ID: uC-gsronu33B178b09b1
gctagattatgttaaactggtcaaggccctctgcgctgatcataatgttaaaatgctacgtgctcctagtgccaaagctctcggcgagtgggctggtttatgcaagatagattccgaggggaaagcaaggaaggtagttggctgctcttgtgtagttgtcaaggattacggtgaacaacacgaggctgtcgaggttgttcagcagcacaaggattaagcaaattagagggatggttccctttatttattattattttttttgtagaagcagttttttgttttgtgttttatggatttgatagtgaacaacagaccaatgatgttgagattttgtttctttgagaaatgttgcaatgctgagttgctgccttgctggtgtggttgattgaaatatatataaattcatgggattgtggtttt

SEQ ID NO: 5428 - DNA, 518 bp, Gossypium hirsutum
  Clone ID: uC-gsronu33B178c02b1
ccttctcgtccgcccacgcgtccgtccacgcgtgcgcaaaagcctaggctcacatggtccttataacattgctgatttttcaacacagggtggctatgcggttgattatgcttcacaaggagctcagagtgggtttccagggaacttcctaaaccagaattctcaagctgggtattctcgttttggtgctggaaatgatttcatgactcaggactacatgaatcatggatcacaaggcctgtttactcaggctggctttaatgatccttcacaagatgatgcatcacagagccactttggtgcggctaatcccaaccagcttcagtctcagggtttgatgaactctctctactcccagccctttgcacactacaacacacagccactaaacttgcagtctcctcaacagcagcaaccacagcagggccagggttcccaaaaccagaatcttcgctataatggttaataataaagatgtatttggctctgatgggttatggtctttgcaatcagcaact

SEQ ID NO: 5429 - DNA, 414 bp, Gossypium hirsutum
  Clone ID: uC-gsronu33B178c04b1
ctttctttggaggagggaagtcaactggttttgggggtatttatgactcagttgagaaggcaaagaagtatgagcctaagtaccgcttgatcaggaacggacttgataccaaggttgaaaagtctagaaagcagatgaaggaaaggaaaaacagggctaaaaaagtcagaggtgttaaaaagaccaaggctggagaggctgccaagaagaagtgagatccccatagatatgaactaagtttcatgcagcaatacaatcaagcccctacttatttacctacatttatattgattgccattgaacttcaaacgtgtaatgctgagttcattgttcttttgaatatccatttggatttttgtattatggacctactttacctgttcctgtggagattttaacttgaaatgaattttt

SEQ ID NO: 5430 - DNA, 525 bp, Gossypium hirsutum
  Clone ID: uC-gsronu33B178c05b1
ctttatcgtatggcgtggggcatagacatgaggcggggaatctacaactcttctggatgacaatgattgacacactatggcaaagccttgttctgttctatatacctctattcacatataaggagagcacaattgatatatggagcatgggcagtttgtggactatagcagttgttattcttgttaatatacacttggcaatggacattcggcgctgggtattcattactcatgctgcagtgtggggatcaataattatcacatatgcctgtatggtagtactggattctatacctgtcttcccaaattactggacaatctaccatctggtgaagtcacccacctattggctcaccattttgcttataataattgtggctttacttcctcgttttcttttcaaagttatacatcagattttttggccttcagatatccaaatagccagagaagccgagatattaagaaaagtggctcctaatttgaggtcaaagccagatgaagactccagttaacatgtacatt

SEQ ID NO: 5431 - DNA, 493 bp, Gossypium hirsutum
  Clone ID: uC-gsronu33B178c07b1
ttatactcacaagagaagcagccgctcctccttgcatctcctaaacaagaatggattcgcaaattaagtttgctgtggtggtgaaaataatgggaaggaccggttcaagaggtcaagtgacgcaggtgagagtgaagttcttggacgatcagaaccggttcattatgaggaacgtgaagggaccggttcgtgagggagatatcctcacattgctggagtctgagagagaagctaggaggcttcgttgaagggttatttttatactttttggggtttatgcttgttttgaattgtctaccgtattgcttttgaattacgtttagtaggtattcgtatatcgagacttgcgatttgggagaatggttgttgcttaaacctggattttatgatgattatgttgaaatgaactgaattggttttgagttttggttaaaaaaaatatatattatttcaatatattctcactatcttttaatatttattttatatcttg

SEQ ID NO: 5432 - DNA, 426 bp, Gossypium hirsutum
  Clone ID: uC-gsronu33B178c10b1
tcttctacgcgtccggcatgtcatagattcaatggcttgggatcaaccattacaatgttgtgtattttactctccaccagatgtaattcgtaacttactgaatgcaaatgcaaatggagttgtgacaccaagattggtggttgttttctcttcttaatcaaaaaaagaaaaagaaaaaaggagttgatttttatctatttgtattttggaaattattaattcctctttattatagctttgatatgaaatatgctttgaattaaaaaaaaaaaaaaaaaaaaaaaaaaaaaatataaaaaaaaaaaaaaaaaaaaaaaaaaaaaaaaaaaaaaaaaaaaaaaaaaaaaaaaaacaaaaaaaaaaaaaaaaaaaaaaaaaaaaaatataataataaaaattacaaaaaaaaaaaaggggggccccttt

SEQ ID NO: 5433 - DNA, 525 bp, Gossypium hirsutum
  Clone ID: uC-gsronu33B178c11b1
tctttcgcgtccgaccacgcgtccgcccacgcgtgcgcccacgcgtccggccaatgactgttttctggtcatctactgcacaaagcatgactgcacgcccaatgaagggaatgcttactgggcccgttaccatcctcaactggtcctttgtcagaaatgatcagccccggtttgagacttgctaccagattgccttggccatcaaggacgaagtggaggatcttgagaaggccggtatcaatgttatccaaattgacgaggctgctttgagagaggggttgcctcttagaaagtcggagcacgccttctacttgaaatgggctgtccactccttcagaatcaccaactgcggtgtccaggacactacccagatccacactcatatgtgctactccaacttcaatgacatcatccactcaattatcgacatggatgctgatgtgataaccatcgagaactcacgttcagatgaaaagctcctttcagtattccgtgaaggagtgaagtatggtgctcgaatcggcc

SEQ ID NO: 5434 - DNA, 519 bp, Gossypium hirsutum
  Clone ID: uC-gsronu33B178c12b1
tctttttgaagccttcttcgaatttcctcattcaagatgcaaattttcgtcaagaccctcaccggaaagaccatcacattggaggtggagagttctgatactattgacaatgtaaaggccaagattcaggacaaggaaggcatccccccagaccagcaaaggttgatcttcgctggtaagcaacttgaggatggccgcacgttggctgattacaacatccagaaggagtccacactccacttagtgcttcgcctccgtggaggaatgcaaatttttgttaagactttgactgggaagaccattacattggaggtagagagttcagataccattgataatgttaaggcaaaaattcaggacaaggagggaattcccccagaccaacagaggctgatttttgctggtaagcaactggaggatggccgtaccctggctgactataacatccagaaggagtccaccctccacttggtgctccgtcttcgtggtggtatgcagatttttgtgaagacacttact

SEQ ID NO: 5435 - DNA, 404 bp, Gossypium hirsutum
  Clone ID: uC-gsronu33B178d02b1
gcctcttgcccggggaaagcacgaggggctcgcacgagttgtttaacgcgtgtctgagtggacaggcatactatacggcgaatccaccagcgaaggaactggcttggccgattctgcggctgacggcgacccggtctagcagagctgtagacgagctctatgagatgacctgagaggtggacgattggctagagcatttaatggaagatagataaacactactatgaaggtgattttactgacactgggaatggtgggcgtgaggacctcgctctttgtggacccaaggccgactaccgacggacgatacactctgtagacattgtcaggtggggagtttggctggggcggcacatctgttaaaagagtccgccggtgtactaagatgaggctaacgagaacag

SEQ ID NO: 5436 - DNA, 530 bp, Gossypium hirsutum
  Clone ID: uC-gsronu33B178d03b1
acttctcactcatgcactcatacataaccacgtggggggaagcctaagctcacatgttgcttataacattgctgatttttcaacacagggtggctatgcggttgattatgcttcacaaggagctcacagtgggtttccagggcacttcctaaaccagaattctcaagctgggtattctcgttttggtgctggaaatgatttcatgactcaagactacgtgaatcatggatcacaaggcctgtttactcaggctggctttaatgatccttcacaagatgatgcatcacagagccactttggtgcggataatcccaaccagctctaggctcagggtttgatgaactctctgtactcccagccctttgcacactacaacacacagccactaaacttgcaggctcctcaacagcagcaaccacagctgggccagggttcccaaaaccagaatcttcgctataatggttaataataaagatgtatttggctttgatgggttatggtctttggcatcagcaacttggtttgtgctg

SEQ ID NO: 5437 - DNA, 526 bp, Gossypium hirsutum
  unsure (1)..(526): unsure at all n locations
  Clone ID: uC-gsronu33B178d05b1
ctttctcgtccgcacaaaaccaaatcttctttgctgggctattttggttcgttttgctgagaactggctaacgcacagcaaaaaaccgtggaggaaaccaacaagaaccaagcggtggttcttgccctctatgaagccttaaacacacgagacgtcaacaccgttcaccaaatccttgctcccgacctagagtggtggttccacggtccacccactcaccagtttttgatgcgcttactcaccggcgcttcatccgacgatcctttccgtttcgaggtcgaccctgtctcagtcaccacctttggatccaccgtcatcgttgaaggctgtgataacagccgttcgatctcctgggttcacgcttggactgttcgtgatgggataatcacccaagtgagggagtatttcaacacttctctcaccgttactcgccttagagactctccaccgtcagcttgcagntcttcgacggcggagattgcgccagtgtattgcccttacgtttgggagagtagtctttccaacc

SEQ ID NO: 5438 - DNA, 506 bp, Gossypium hirsutum
  Clone ID: uC-gsronu33B178d06b1
cagtaccacccatatctttgatgattgcattgttgagaagctgttgtggggttgttgggttctcctctccgaagagaaacgggtcaagttaccaatcagaaaatttccttagctactgtcatgcttgtaagaagaatctttctccaggaaatgacatttacatgtacagaagtgagaaagcatcttgcagcaaagaatgtctgtaccaagagatgatgctagaagaaagcaccaacaaactagaatctgatgacatctttgggacttattcctaacatttgtttcaagttctcatgatcagtcttgcataaaagccagtcaaggattaagtaaaaccagcacaaataacttctgtgtgtcaatcatcgcgagagtttttaattgcttttagctgtttaaaagatgaaactttgggtctactctgttgtatcttcttcacaggctctatggtatttgtagaattgatctttcttcctttttttgcaagtgatcttttgtgttttttc

SEQ ID NO: 5439 - DNA, 528 bp, Gossypium hirsutum
  Clone ID: uC-gsronu33B178d08b1
tgataaatatcgaaagccctaactttgccggtcgagcctaaaggcggaagccgcagttttctccttcgcgacactcacaacttaccagctttcttttgaatcccaaaaagaaacaatgtctcgtgtgtacgtgggtaaccttgacccacgagtttcggagcgggaccttgaagacgagtttcgtgtctttggagttattcggagtgtatgggttgctcgaaggccacctggttatgctttcattgattttgatgatcgcagagacgccgaagatgcaattcgtgaattagatggcaagaatggctggagagttgagctttctcataattctagaggaagaggcggacgtggaggtggtcagggacgctctggtggttctgatttgaagtgttatgagtgtggtgagcctggtcattttgctcgagaatgtcgcatgcgtggtggttcaggaagacgccgcagccgcagccctagatatcgtagtagcccaagctatggaccgagaagttatagtcctcgtgcccgatc

SEQ ID NO: 5440 - DNA, 537 bp, Gossypium hirsutum
  Clone ID: uC-gsronu33B178d09b1
ttttactaatgccataaaatataagccattgaaacgagaacatttcgttagggtttagccgtggctagagagagatgggaaggaggatactgaacgatgcgttaaggtcaatagtgaatgctgagaggaggggcaaggccacggtggaactgaaaccaatctccaacgtcatatcttcctttctcaatatcatgaaatatcgaggatacataaagaacttcgaagttcatgatccacatagagtgggcaggataacagttgacctgcaaggaagggtaaacgattgccgggcactcacttacaggcaggacatcaaagcaaaggaaatcgaaaaatacaaaacacttaaacttccaactcatcagtggggttatgttgtgatttcaactccggatggtgttttggatcatgaagaagccattcgaaggaatgtaggtgggcaggttctgggttattttcattagacttgtttatctttctgatagttgtttgagctctgctttatctgtgaactttcaatcaaatatctatctgaat

SEQ ID NO: 5441 - DNA, 510 bp, Gossypium hirsutum
  Clone ID: uC-gsronu33B178d10b1
ataaaaaaaaaaaaaaaaaaaaaaaaaaaaaaaagaaaaaataaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaaaaagggggggggcctttttttaaccaaacccctcccccccccccggcgacgcaaatattttttttttttttggcccaaaaaaaaaatattggccccccttttaattcaccctgggggggaaaaaaaacccctgtcccaaccaaaatttttgggggaaaacacccctcttttcacgggggttttaaaaaaaaaagggggcccccatcccccctcccaaaaaaaattccccccttaatttaaaggggacgccccccccccttatgcttaaattcaaggggggtgggggtttgtttccccgggttacttccctttttctgttgccgtttcctggcccccttatatttattttccccccctttgccccaccaaag

SEQ ID NO: 5442 - DNA, 538 bp, Gossypium hirsutum
  unsure (1)..(538): unsure at all n locations
  Clone ID: uC-gsronu33B178e01b1
gctgatattgaagtcaatctcttacaagacagtgtgagtctcatgcgcgccgccaccggccgcctcgagaacgcctccgccgctctccacgacctttccctgcgccctcaagggaagaaaatgttggttcctctcactgcttccctctatgttcccggcacactcgacgatgccgataaggttctcgttgatattggcactggatacttcgttgagaaaacaatggctgaaggcaaagattattgcgagcgtaagatcaacttactgaaatccaatttcgatcaacttatcgaggttgcatctaagaagaaaacattagccgatgaagctggacttattttacaagcaaaattgaagcagtcatctccttcgagttaggaattgcgtgacctcataatcatctcattatcattaagttcttaagggttgcttagaancttattgcacgtgatgtcaaactttatcttcttaaagctttcgtttttgatgaaggtagggaccatgatctttccggttggtcatttatagagattaatgt

SEQ ID NO: 5443 - DNA, 323 bp, Gossypium hirsutum
  Clone ID: uC-gsronu33B178e02b1
tggtcgctatcttgcacaccgctgggtgctttatgatggagagaggaattataccctaatgcaggcctgcttatattgcaatcgaagatttgaccattgtgttaaaacttttgaaattgcttgtggcaaactttacatagattcttatcactgttcagtcaacttaaaaatgtgatatggatttctgatttaaatagtctaatcagctgactgcttcattcccacttcctgcctaatcagtatcctctgtcatagctcatgctatcttgcaattttttttcccttcgatccattggtactgacttctagagtctgtaaaagaa

SEQ ID NO: 5444 - DNA, 532 bp, Gossypium hirsutum
  Clone ID: uC-gsronu33B178e03b1
tttctttcgattccacttaacgcaaatagttcgagtggcgtaatcaatggctttgccgaaccaacagactgttgattatccgagcttcaagctcgttatcgtcggcgatggaggcactggaaagaccacatttgtgaagaggcatctgactggagagtttgaaaagaaatacgagccaacgatcggtgtggaggttcaccctttggacttcttcactaactgtgggaaaattcgattctactgctgggatactgccggtcaggaaaagtttggtggtcttcgagatggttactacatccatgggcaatgtgctataattatgtttgacgttactgcccgtttgacatacaagaatgttcctacctggcatcgtgatctttgcagggtgtgcgagaatattcctattgttctatgtggtaacaaggttgatgttaagaacaggcaggttaaggcaaagcaggttacattccacaggaagaagaatctgcaatactacgaaatctcagccaagagcaactaccattttgagaag

SEQ ID NO: 5445 - DNA, 523 bp, Gossypium hirsutum
  Clone ID: uC-gsronu33B178e05b1
tttttctccccaccataaaaggcattaactttgattggcctcatgtcattgaggatgctcctagctgtcctggtgtggagcatgttggtggagacatgtttgtaagtgtaccaaaaggagatgccattttcatgaagtggatatgtcatgattggagcgacgaacactgcgccaagtttttgaagaactgctatgaagctttgccagacaacgggaaagtgattgttgccgaatgcattcttcctgattaccccgaccctagccttgccacgaagttggttgtccatattgattgcattatgttggctcacaaccctggtgggaaagagaggaccgcaaaggaattcgaggcactcgcaaagggtgcgggatttcaaggctttcaaattacatgttccgcttttggcaccaacatcatggagtttctcaaaagtgtttgaatcttacatgcttttggattctgaagcttggtgattgttgtctcaaagtggattttctggattacatactttttgtctgacag

SEQ ID NO: 5446 - DNA, 526 bp, Gossypium hirsutum
  Clone ID: uC-gsronu33B178e06b1
gttttctcatcgaagctaattagacaaaagaagaagaagaagaaaatgactgtcattgatatattgaccagagtagatgtgatctgtaagaagtacgacaaatacgacgtcgaaaagcagcgagaccaaaatatctccggcgacgatgcctttgctcgccaatacgctgctattgaagccgacattgaatccgctcttcaaaaagcggagcttgtttccaaggagaaaagtaaggcatctgctgttgcggtgaatgctgagattcgtcgaaccaaggctagattgcttgaggaggtccctaaactgcagaggttggctgttaagaaggttaaagggatttcaaccgaagagatgactgctcgtagtgatctggtcctcgcattgccggataggattcaagctatacctgatggaactgctgctcctaaaactggaggcgggatgtcttcagcaccttcagcttctcgtactgaaattaagttcgactcagatgggcgatttgataatgaatactttcaagaatctg

SEQ ID NO: 5447 - DNA, 492 bp, Gossypium hirsutum
  Clone ID: uC-gsronu33B178e07b1
tttgagcttagatattcctccaattgttttgacagacttttgttttttttggcttcaaacttgtcaaaaaacaattcttggcttacttttggtaggtggtgttggcatatcaaacatgatcgggaaaatcgagcggcacgagtacatgggattcgagaacctgtgcaagtacgaaagctgatatctcaggttattttatctctcaattgatccacctccttaagtctcctgtaagttaggctagattgcgttttggggaagaaagaagatggtcaataattttccattctttacacaatccccatttttcactttccgttccgttttatatttatgagatacatttattgacaatattcagaaattgtctagatgaatggaattatagcttcctgttaaaaaaaaaaataaaaaaacacataaaaaaactaaaaaaaaaacaacaatatacaataaaaatatcaaataactactcatctcttaaaataaaaa

SEQ ID NO: 5448 - DNA, 447 bp, Gossypium hirsutum
  Clone ID: uC-gsronu33B178e08b1
tcttctggctcttcttaaggggtttcgaagatgaatgcatgcatgtggaacaatacagggcccaagtgaggaaaacattaatggatcaagggtaccgcatatggggaatcgttggagatcaatggagcagcttaaagggtttgccagaagcaaagagaacattcaagctgccaaattccatttactacatgtcttaacttcatctgaataaatttttatgcactcattttcccacctcatgtgcttttgtatttgcttgcggttgttttcagaaatccaatataaaatatcagtaaaaatatctatatttatcttctaaaaaaaaaaaaaaaaaaaaaaaaaaaaaacaaaaaaaaaaaaaaaaaaaaaaaaaaaaaaaaaaaaaaaaaaaaaaaaaaccaccaaaaataaaaaaaaaaaaaaaaaaactcaacccatcatgggggg

SEQ ID NO: 5449 - DNA, 248 bp, Gossypium hirsutum
  Clone ID: uC-gsronu33B178e10b1
tctcatgcgtccggctactagtaatttctcaaagtggagtaatcctgaaacgttggcgggatagtaggagagaatatagaaagttgtgcttttgattttgttaacatatggtttggtacttcctactcttatgctagtcggatcatgatggaactgtttcaagggttgtagctttgtgcaagaaatttattttttgattatgctggctcatcttttgtcatatgaataaataaaggcatctgacattt

SEQ ID NO: 5450 - DNA, 126 bp, Gossypium hirsutum
  Clone ID: uC-gsronu33B178e11b1
tgttctcgccctttttttttttttttttttttttttggtttttgttggtatctgatgctatgttgcttactcatttctcttagacatttatgatttttaatctctcaaaaatagaatcttttaatt

SEQ ID NO: 5451 - DNA, 525 bp, Gossypium hirsutum
  Clone ID: uC-gsronu33B178e12b1
tctgttacagttcacctcaaagatggaaggcatggtcacagatctgacattggcaagggaaaaccaagctagctttgaggactatcttaggaacaatcctgctgcacatccggggattgatttaacagttacagttcttactacaggattttggccgagttataaatctttcgatctcaatctccctgctgagatgatcaagtgtgtggaagttttcaaaggattttatgaaacaaaaacaaagcacagaaagcttacatggatatactcgctgggaacttgccacattaatggcaagtttgaacacaaaactattgaacttattgtttctacttatcaggctgctgtcctactgctcttcaatgcttctgatcggctgagctattcagagattatggctcagttgaacttgacccatgaagacttggttagattactgcattcgctgtcatgtgccaagtataagatactaagtaaagagccaaacacaaaaaccatcttccagagtgactacttcgagttcaa

SEQ ID NO: 5452 - DNA, 489 bp, Gossypium hirsutum
  Clone ID: uC-gsronu33B178f03b1
ctttctagtcctttgtttttcgactcttgctgcttggacaaattcaagagatcaactttgctatcaaggtgattccagatcattttcaagtctcaactcctcccagtgaggattctcttcaaaacagacgttcacctgattcacaaccaagtactggaaattcttcgaggataggtcccgcagcagtttatggactcggcgaaaattgagaagggctgcattcacgttgaatctggtcaggttacgtgggttgccatggagtggtgctgatggtcaggaaaaggttcaattgactgctgcagagttggaatcactaaggccggaacttgccgatatagaagagggagaagctcactctgaagctcagttggaacatatcgatgtaattttgcggtcagcacgtctttttggctatttgcacatacgaagcatgtggacagcgttacccggagaacctgctcctattgacgatatagatgttgacgactg

SEQ ID NO: 5453 - DNA, 482 bp, Gossypium hirsutum
  Clone ID: uC-gsronu33B178f04b1
gtttttccttgttggtttcatccaaaacaaaggagcggattggaacacttaagatgaacggaacagtccgctctctagcttttgctgataatgggaaccaattattgagctctggcggggatggagaagtctaccattgggacttgagaactagaacatgcatccataaggccgctgatgaaggctgcattaatggtacggctctttgtacatcaccgaatggaagaatgtttgcagctggttctgatagcgggatagtgaacatttacaatagggatgaatttttgggaggtaaaaggaaaccaatcaagactgtcgagaatctaaccaccaaagtcgattttatgaagtttaatagtgatgctcaaatactagctatctgttctaccatgaagaaaaacagtttaaaactgatgcatgtcccatcatttacagtctactctaattggcctccactgaataagaacttacagtatccccgc

SEQ ID NO: 5454 - DNA, 526 bp, Gossypium hirsutum
  Clone ID: uC-gsronu33B178f06b1
cggtctcgtgggcggacgcgtgggcaacatctttgggattttctctctctctccttagaaccctaccgccaccatggcaatagcatgcctgccaaaactccgacttgccaccgccacagccgtctccgtttccaccttccttaagccactcagacatgggctccgatcattcggatcagcagctgcgttggagcttcctgacgaggatgtatactacgagtacgaacaagctcaccgggatcggcgctcagctcagccgaagattgacgtggatgggtcagcgacagacaggggagtccaatgggtacttataggagagcctggggtcaaacgacatgcttatgctgaaaggctttcgaagcttctagaagttccacatatttcaatgggtaccctcgttagacaagagcttaatccccactcttctctttacaaacagattgcaaatgctgtgaatgaagggaagcttgttccagaggatgttatttttgctttattgtctaagaggcttgaagaaggtactatg

SEQ ID NO: 5455 - DNA, 542 bp, Gossypium hirsutum
  Clone ID: uC-gsronu33B178f08b1
tttttgcgtccgtttttaaagggattcgtgctttagctcaggtaatcatggcagctgagtctcccagttcagcacgaaaagttgttgtccatttgagagcaactggggatgcccccatactaaaacaagccaaattcaagatacttggaactgacaaatttgctaaagtaattgattttttgcgtcggcaattgcaccgtgatacactgtttgtgtatgtaaacagtgccttctcaccaaacccagatgaattggtgattgatctgtatgataattttggttttgatggcaaactggtggttaattatgcctgttctatggcatggggctaactcttgatgatggatcttcagagagatgagataaaaactgtcaactctgtaactgtttcctacaattctccattatgcatattcctcatagaaccatcttctataattttcccccctttttctctgagaaacgggtgatcctgtagcagatactaacgtcttgcttctactcaaagcaggaaaatatgggtgttctgaagattctgataa

SEQ ID NO: 5456 - DNA, 527 bp, Gossypium hirsutum
  Clone ID: uC-gsronu33B178f10b1
tatcactccagttttctttatcactgaaaaatgggttgctgtggtggaaactgtggctgcggttctggctgcaagtgtggcagtggctgtggaggatgcaagatgtacccagacctgaacgttgccgagatgaccacaactgagactctggttcttggtgtagcaccccagaaagcacactttgagggagctgagatggaattcggggctgagaacggctgcaagtgtggagacaactgcacctgcaacccttgcaattgtaaatgattagagaccaaagccaaagctccctggaagcagagacgcctttgtctttaagaaataatatgttttgttgtttatgtgtttttagaataaagtagccatggcttgtcgtaggttttgcctgttgccgccacggttacttggtgcttgccaatagatagagtgaagtactaatatttacttgtttttctgtccagtgtgagcatctctgctatctcaggatatattgtgactattacataattaatgtaaggaagtgagtc

SEQ ID NO: 5457 - DNA, 324 bp, Gossypium hirsutum
  Clone ID: uC-gsronu33B178f11b1
tgataatcacggcttgtgactttcctgcagagcctttgtccattgatagagtggtgctcaaaagttgtacatataggatgaaatacatgtgactgatagtagcaaagtaaaactaagtttggtagctagatgtagcaagagctctcatagttgggatcttatgggtttctgtttcttaattatcttatcaagtgttacattatatataaatatataaagccaatgcactctcaagtctcatccatgaaaaaaaaaaaaaaaaaaaaaaaaaaaaaaaaaaaaaacaaaataaaaaaaaaaagaataacataaaataaaatccag

SEQ ID NO: 5458 - DNA, 519 bp, Gossypium hirsutum
  unsure (1)..(519): unsure at all n locations
  Clone ID: uC-gsronu33B178f12b1
tgtttattgaattctttccttcactttctcgaggagaaaaaatgtcttcaggttgcagttgcggatctagctgcagctgcggcgacagctgctcatgcagcaggaaccttaaccttggatactcggagaagacaaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccctagattatgaaaaaagaaagcagcaaaataacaggcctctgtaatgatttattttcaaggatgaatgcctgcaaggtctatgactataattatgtctctgtctgcgtcttgtgtaatagaagctttgtttgtggtgaaaataatgtataagccagttggttgggagcaaattttccttttgtccaaaggattttttgctgctcattcatggtgactnggtttatggttttat

SEQ ID NO: 5459 - DNA, 551 bp, Gossypium hirsutum
  Clone ID: uC-gsronu33B178g02b1
ccctcttgttcgatggcccctccctttctgtctgctggtactttgctaagtccaagcctgggacaatggccgaaccctctaccatttcaccagctcccctcttgaaagatgagctcgacatagtcattccaaccattcggaacttggactctgtggagacgtggaggccctttttccagccttaccatctcatcattgttcaagatggcgatccttccaagaccatcaaggatccggagggcttcgactatgagctttacaataggaacgatatcaacaggattttggggcctaagtcttcttgtatctctttcaaggattctgcttgtcgctgctttggttacatggtttccaagaagaagtacatttataccattgatgatgattgctttgttgcgaaagatccgtccggcaaagacattaacgcactggagcagcacataaagaaccttctttgttcatctactccgtttttcttcaacactctctatgacccgtaccgagctggtgcagatttcgttcgtgggtacccattcagtctccgtgagggg

SEQ ID NO: 5460 - DNA, 535 bp, Gossypium hirsutum
  Clone ID: uC-gsronu33B178g05b1
gatctctttgaggcaattcctggagttcccaaaagtaaggaaatgtataatccagctacatggatgttagaagtgagctctatagcagctgaagttaggctcggaattgattttgctgaacagtacaaatcatcttccttgtatcagagaaacaaggcgttagtaaatgagttaagcacaccacctccaggagctaaagacctctattttgccactcagtactcacaaaatacattgggtcaattcaaatcatgcttttggaaacaatggtggacttactggagaagtccagattacaaccttgtcagatacttcttcactttgatcactgctctcttggttggttctattttctggcaggtcggcactgaaaggagtagcgcatctgatcttacaatgatcatcggtgcaatgtatgctgcagtcgtgtttgttggaatcaataactgctcaacagttcaaccagtcatagccattgaaagaacagtgttctatcgtgaaagagctgctgggatgtactctgcattaccttatg

SEQ ID NO: 5461 - DNA, 499 bp, Gossypium hirsutum
  Clone ID: uC-gsronu33B178g06b1
ctttctcgtgaagaacaaaagcctttcactgtatctgcttcttctgcatcatcatcatgatcatcttgatctggttttggatttgatattgggtgattcatttcttaattagcctcgtatatctccattgccaatggaagggccactataatatatatatatacacatatagatcatttgagaaattcagtgtgtgaatccatattacccttaaaaaattatggatgctgtgtaaatcttgagacacattgtcttcacttcaattgtaactgattaataagtgtgattgaatgagtcacatataaccattgccaaaacttggaatatatgatttatgcagtcatttttaaaaacactagttcgtcttattttaatgcatatgatattttttttctgtaaaatgcacgcaaaagatgtttcttattagtattatttgaaatataagacatgaaaaaggccggccgttttgtagggtccaatctatcgtcccggttcttgc

SEQ ID NO: 5462 - DNA, 325 bp, Gossypium hirsutum
  Clone ID: uC-gsronu33B178g07b1
ttctgtgctgagagatgccatcaatcgaagagagagacttttgttaccttcgggtacgaacctgtcaaaaaaccagcttagggtgactcatagtaggaggggagagattagcaaccatgaactgacatacctagcgaggccagtacatcagatgtgggacaccacactagtgcagagagctgtatcatagagaatgacatgtatacaaagatccaacgtcttaaacctgcaatagacttggactgattgggtgatgaggaagaaagaagattgataccctctgttccttgcctcaacaagaacaatacttgaaggatcgatccag

SEQ ID NO: 5463 - DNA, 486 bp, Gossypium hirsutum
  Clone ID: uC-gsronu33B178g08b1
tgtaaattcaagatcgtgttcactttgtgaacaaagctctaacagtagctccatatttagctgccgtagatgttcttgttcagaattctcagggacggggagaatgctttggacggataacaatcgaagcaatggcatttcagttgcctgtgctgacagggaacagctgccgggggcacaacggaaatagtagtgaacggcacaacaggtttattgcaccctgctgggaaagaaggggtgacaactctggcgaaacatattgtgaaactagctacgcatgtagagaggaggcttacaataggaaagagagggtacgaaagggtgaaagaaagatttctagaacatcacatggcagagagaattggtgaagtacttaaagaagcgttgaggaagtctaaaatcagatcaagtaaacacctttgacagtgaatacccccgcccaccatataattacaatgaggtatatccagttttcaatcaatatta

SEQ ID NO: 5464 - DNA, 94 bp, Gossypium hirsutum
  Clone ID: uC-gsronu33B178g09b1
tggtaactgtaaatcagcttcttgtacattagaacgagatgcaatgtattactaaatttccataaagtgaagaagattcgattctttttttatg

SEQ ID NO: 5465 - DNA, 526 bp, Gossypium hirsutum
  Clone ID: uC-gsronu33B178g11b1
ctttgctggaggcatgctttctgttccatatgatatgggtggcatgccaatgcgtgatgcgtcaatttctcagccaattccgataggagccttggcctcagccctagcaaatgctacaccagatcagcagagaacgatgctgggagagaatctttatcccctagttgaacagctggagcctgatgcagcagctaaagttacagggatgcttctggagatggatcagaccgaggttttgcatttgctcgagtcaccagaagctctaaaagcaaaggttgctgaagcaatggaggttcttagaactgtggctcagcagcagcaaactggtggtgctgccgctgatcaactggcttcattgtcattaagtgacaaccttgtctcctgagttttaactgcctgctagagttttctccttgaacaccatcgtagcgtggcctttgtttagattgaatcagttgcttcgtttgaagctggttatgactctatacttctacagagtgttttggaacttcataccgtctgacac

SEQ ID NO: 5466 - DNA, 509 bp, Gossypium hirsutum
  Clone ID: uC-gsronu33B178g12b1
cgtacgcgtgggttttttttttttttttttttttggtttttagacgaaatgcttggataaaagaagcaaaggaacggtggcatatatctcttataacaatagtcagaccattcagtacgcactttaggagtagagtggaccgaagacaatatttcaacactgatccaaagtatgaaaacacaatgacaagttcccttcaagaaaacatgcctgctaaaggtaaaacatttgacgacatacaaaacccataggtatattacacactaaccaccaccatcatcatcatcaacccattgcatacttctgggtccagctgcgggcagtagcttcgtacttggcccgatcagtcttgtacatgtgagcaatctccggaacaagcggatcatcagggtttggatccgtcaacaacgagcaaatagaaagcagaaccttggaaatggtcagtgcagggctccactgttcttttaggatatcaagacaaatgctcccattgctgttgatgcttggat

SEQ ID NO: 5467 - DNA, 357 bp, Gossypium hirsutum
  Clone ID: uC-gsronu33B178h01b1
ccttcttgtccgtagagaagactacaactgagactattgttcttggtgtggcaactgagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaagtttgttttctattgaaagaatggcagttcctttctctttgactaa

SEQ ID NO: 5468 - DNA, 374 bp, Gossypium hirsutum
  Clone ID: uC-gsronu33B178h02b1
attttctgtacggattgttgagggtcaaaagcaggagaggatctctatccttcgatgtgagagcggtgaccaaaaggaaggcggatgatgatgatgaagaagctttagctttgcagttttattgatttctctctttgctgttaaaaccaaaaaaatctgaatagcggaaatagaattagattctgttgaattgcagtaaactctgcccatatggttatttttacagctttttgcattgaaaaacattgtcaagtagtacctcccttgattttatttgtctaggctttaggagtatgtatctagggaaacgtagatattagtacttcaatggtatgttatcagtgattaaaactatctttgaatatgccaacatg

SEQ ID NO: 5469 - DNA, 516 bp, Gossypium hirsutum
  Clone ID: uC-gsronu33B178h05b1
tctctcgtccggaaaattatggcgatgaaagaggggaaaaaacccagttttttgctgggttttgcattgttattgcttctattgatgatgatgataagctcacaatccatggcagatgctgagatgatgaaggtgaaacccacaaaagcaagaacaagaaaggtattggagatggagcaagattacccaggtgaagtgccaagcatcccaagtgattatgattacaatgatttctatagaaggcaaggtgatgttccaagcccaggaattggtcattgatatatatatatatatagatatatatatgtatatgtaaagggtactgccatgcatgattttcttctaattcatatatatggtttatttatagatttttgttttaatcatgtcacatcagtgaaacattagtgaaatttgaagtgatatatattatgtgtatgtatagggattattgtaattgaatatgcatgcttttatgatggatacattaatgtgatttgtgagggtgaatggaat

SEQ ID NO: 5470 - DNA, 394 bp, Gossypium hirsutum
  Clone ID: uC-gsronu33B178h08b1
tactcgatggccatgtattatccaccgtttcttccgttaggggttctggctatagtgcgaggggtggttggacaatcgagcaaggctgctccatccattggcaatggaccttcgtcggctgtgaaaaagagggcttaaagttgatccccgatcagtttcaaacgtcttctttaagagaccatgctaatacaataataagggagggattctaatctgtttgatccgcagctaaataaggataaaaaaaaaaatgaagtaggcaaattacaaatatattagcaatctaatagtatttgtaatacttgcttaggctgcattttcagcttgttttgtttacagtgtgtatcgcagtttttagtggcctacttgtctttgattaatgcaaattttattt

SEQ ID NO: 5471 - DNA, 430 bp, Gossypium hirsutum
  Clone ID: uC-gsronu33B178h09b1
aattccagggctcttaggaggttgaggactgcttgtgaaagggcgaagagaactttatcatccactgctcaaacaaccatcgaaattgactccttgtatgagggtatcgatttttactctaccattacccgtgccaggtttgaagaacttaacatggatctattcaggaagtgtatggaaccagttgagaaatgtttgagggatgctaagatggacaagagcactgtccatgatgttgttcttgttggtggttccactagaattccaaaggtccaacaacttttacaagatttcttcaatgggaaggagctttgcaagagcatcaaccctgatgaggccgtttcataccgtgcttgaatccaagctgctatattgagtggtgaaggtaatgagaaagtgccagatctcttgctcttggatgtcaccccat

SEQ ID NO: 5472 - DNA, 529 bp, Gossypium hirsutum
  unsure (1)..(529): unsure at all n locations
  Clone ID: uC-gsronu33B178h10b1
ttttcgcgtccgcccacgcgtccgcttcattggcgtcccttgttcctcctacgataccgacctctatttctaccattcctggacttccaggtggtcttcaactccctacgaatggcatccctgctattgacacaattggaagtccaagcgaatgcctgttgttaaagaatatgtttgatccaaccctggagacggaaccagaatttgatttggatatcaaagaggatgttcaggaagaatgtagcaagtttggaaaattgaagcatatacacgtggacagggacagtgctggttttgtgtacttacgatttgaagatgcacaaggtgcaatcaatgcacagcggaacctacatgggagatggttcgctggaaaaatgatcaccgcaacatacatggtgccacaaacttacgaggcaaagtttccaagcagcaagagatagttggatgatgttttgttcaaccttaaaatcaaaatctcctcgcaactntaaacatctatagttaaaattagatggcattattgctacta

SEQ ID NO: 5473 - DNA, 493 bp, Gossypium hirsutum
  Clone ID: uC-gsronu33B178h11b1
tttttcgcgtccggcaacgttagcggtgaaggagcggtggttagcaaggagcgagggttgttcgatttcatggggaagaaagaagaggagaagcctcaagaggaggtgatcgtaaccgagtttgaaaaggttaatatcgaagagacaaaggcagaggaagaaggtgaggagaagaagaagcatggtctcctggagaagcttcaccgatcagatagcagcagctccagctcttcaagcgacgaggaagaaggtgaaggagaagagaagaagaagaagaaaaagaaggagaagaagggactggaagaaaagattgaagagaaattagaaggggaaaagaaagaagaggagaagcctcaagaggaggtgatcgtaaccgagtttgaaaaggttaatatcgaagagacaaaggcagaggaagaagggtgagagaagaagaagcatggtctcctggagaagctcaccgatcagatagcatcagcttcagctctttaag

SEQ ID NO: 5474 - DNA, 531 bp, Gossypium hirsutum
  Clone ID: uC-gsronu33B178h12b1
tttacgcgtccgtccacgcgtccgtccacgcgtgcgcgtcaatgcccgtcggagctccgggttggagacggtgacgcttgcaagagcgcgtgtgaggcattcgggagtcccgagtattgttgcagtggcgcgtatagcacacctgccacatgtaagccttcagtttattctgagatgttcaaggccgcttgtcccagatcttacagctatgcatacgatgatgctacaagcactttcacgtgtactggagcagattatacggttaccttttgtccctcttctcctagtcaaaaatcttcgagagatgctacgccagctacagaagctaccccagtgacaggctcaacgtcacaagggtcagggacacagcccgggtttacttattctggtaatggatatggatattcggtttcagggtacggataccctggttcgggttcaagtactgggtcaggatctgggcataccatgttgacagatggatcatggttagctggtttggcaatgggagattcaccaagaacaatacca

SEQ ID NO: 5475 - DNA, 379 bp, Gossypium hirsutum
  Clone ID: uC-gsronu33B179a01b1
gcttctataaataaccagaactggagtggaacatgttacattacactcatagattggtgcgtttctagctgattcttatctaggaagatattggacaattgcttgtttctcgatcatctatatcattggaatgacacttttggcaatgtctgcatcggtcgatggcatgaagccattttgttattcgaaagataattgcaacccgaccgatacgcaaagcgccatgacttttctagcgctgtacctaatagcgctaggaacaggtgggattaaaccatgtgtttcgtcatacggagccgatcagttcgacgacacggactaaagggagtagattcacaagagttcattttttcaattggttctatttctcaataaacat

SEQ ID NO: 5476 - DNA, 506 bp, Gossypium hirsutum
  Clone ID: uC-gsronu33B179a04b1
ggatgtttgttcacatcaacattgtggtcattggggagtggcgactctgggaagtctgcgagagcactggtcatttgatctacaagcttggtggtattgacaagcgtgtgattgagaggtttgagaaggaggctgctgagatgaacaaaaggtcatttaagtatgcatgggtgcttgacaagcttaaggccgagcgtgaacgtggtattaccatcgatattgccctctggaagtttgagactaccaaatactactgtactgtcattgatgcccctggacatcgtgacttcatcaagaacatgattactggtacctcacaggctgactgcgctgttctcattatcgactcgaccactggtggtttcgaagctggtatctcaaaggatggtcagacacgtgagcatgctttgcttgcgtttatctttggtgtcaagcagatgatttgctgctgcaacaagatggatgcaacaacttcaaaatacttcaaggcaaggtatgatgaaatt

SEQ ID NO: 5477 - DNA, 269 bp, Gossypium hirsutum
  Clone ID: uC-gsronu33B179a06b1
gctgttttcaggatctttgcagaaccttctgaaactcgggactaaaaatgtcggtgtgggccgcaactatgccgcgctcgccaaagaactcggcaactcactgcccaaggaaccattactgcttttaaagccgacatcatcttatttggaaagtggaggtacaattgaggatccacattcattgaattcattggattatgaagttgaacttgctgtcgtgatcggaaaaacggctcgggatgtgcctgaaaacactgccatgaactatg

SEQ ID NO: 5478 - DNA, 527 bp, Gossypium hirsutum
  Clone ID: uC-gsronu33B179a07b1
catttcttggctcgccagtcgcctctctttctcctggttcttctacattctgttggctgctgctgctgctttggtggcgtgatttagaagccacaactcaatttcatataaagaaaaaaaaaagtgagatggatccagacgcagtagccaaggccttcgtcgagcactactactccacattcgatgccaaccgggccggtttagccaatctctaccaggaaggttccatgttgaccttcgaaggtcaaaagatccagggctctcagagcatcgtcgttaaactcaccagccttcctttccagcagtgcaagcacaacatcaccaccgtcgattgccagccttccggctccggcggcatgctcgtcttcgtcagcggtaacctccaactcgttggcgagcagcatgctctcaagttcagccagatgtttcatttgatgccaacgccacagggaagcttttatgtgttgaatgacatattcaggttgaactacgcgtgaagacgatgattaatcaagggatgggaatac

SEQ ID NO: 5479 - DNA, 538 bp, Gossypium hirsutum
  unsure (1)..(538): unsure at all n locations
  Clone ID: uC-gsronu33B179a08b1
atttaagactttcgagacaagataagtgagaaatgtgagtttgttgctcatcaaaagggaattcaccatttctgtttcagtaataaatctccttactatgaaacggtcgactttgatgtacatgaaagtcattttacatactatgatcagcatgcaaaggatgagcatttcaaccctttgttagaacaaatatctaagttagaggaagctctttataacatccagtttgaacagcactggttagaggctcagacagaacgtcaggcaatagtaaatgaagccatgagtaaaagagcagttcacaaggccttttacgaatctgcagcactaattggagccagtgttcttcaagtttacctactccgccgcctttttgaacgaaagcttggaatgtcccgggtttagttttagcactgcactgcaatgtttcattagctataggatcatgcagactattgtcatctcaggcacttgatacatacatgaatttatgaaatcagtgaccgtttctggttttaagtctttagatntatcattg

SEQ ID NO: 5480 - DNA, 567 bp, Gossypium hirsutum
  unsure (1)..(567): unsure at all n locations
  Clone ID: uC-gsronu33B179a09b1
ttctcgcgtccgcgttagtccctaaatctccgagataactctcaaaatttgcccccaaatttcccatttccagcaacattctgtctctgcatctttaggttcttcgaccgtttctccttcgtagattgaaatcagatgttgagaacggtttgccttctaaaaaggaaactatcctgaaagtaggaatgtcccagatgcagaaacagtactatagggctttgctgcaaaaagatcttgaggttgtaaatgctggtggagagcgtaagcgtcttctgaacattgcaatgcagctgcgcaaatgttgtagtcacccataccttttccaaggtgctgaacctggacctccatatacaacaggagaccatcttgttaccagtgctggtaaaatggttctcttggacaaattacttccaaagctgaaggagcgtgattctagagttctgatattttcacagatgacaaggctactggatattcttgaagattatttgatgtttcgtggataccagtattgtgggattgatggtaatacaggtgggtgagatcgtgatgcttnccattgagctt

SEQ ID NO: 5481 - DNA, 170 bp, Gossypium hirsutum
  Clone ID: uC-gsronu33B179a12b1
aggaaccacaactgcttttaaagccgacatcatcttatttggaaagtggaggtacaattgaggatccacattcattgaattcattggattatgaagttgaacttgctgtcgtgatcggaaaaacggctcgggatgtgcctgaaaacactgccatgaactatgttggaggc

SEQ ID NO: 5482 - DNA, 507 bp, Gossypium hirsutum
  unsure (1)..(507): unsure at all n locations
  Clone ID: uC-gsronu33B179b02b1
gctttttaaagcaatttcttctcattttcgagaacgggttttttaaaggcttcttgtatatattctttgaagatattaatcagaaaaatggcgctggtttctttcatcggcagggttctttatgcgttagtgttcatcctctctgcttggcaagagttcaatgaatttggcgtcgatggtggtccagcggcgaaggagctgaggccaaagttcaacgtcttctcaaagactgtgtcgtctcacacagggttgcaagtgcctgaatttgatatcaagtatgtagttgctgctgctgtagcctttaaaggtgttgggagtattctctttacctttggcagcaccgtcggagcttatcttctgggtttgcaccaactcggtcttactcccattgnttatgacttctacaattacgacacggaaaagaaagaatttggtcttctttntacaaagttttcacagaacttgacgctgttaggggcatgctgttcttcattggcatgaagactc

SEQ ID NO: 5483 - DNA, 536 bp, Gossypium hirsutum
  Clone ID: uC-gsronu33B179b04b1
agtttttgtcaaagatatattaaacagggcagtgcagggaggcgtctactaaaactgacgggatctgaattccgactccactcagagatggcaacgggaacagctccatcaagaggaagtgctgcagcagcagcaagcctgcgcaggaggagaacaacaagtggtgggggtgcctcgggaggggctgctggtactatgcttcagttctacaccgatgatgctccaggactcaagatctctccaaatgtggtgcttgtaatgagcattggtttcattgcttttgttgcagttctccatatcatgggcaagtttgttcgtagggactaggaagtattccaagcgtgtagcaaacactttttctttttttggtcttaacaggagcaaacacttcccattggttataattttcagttttccttattactggatttgatttcatttgactaacccagactttcctaataatgcaaaataggagaagccttccaagcattatgtagcaggctgatggatatatgacagactagcaaatgact

SEQ ID NO: 5484 - DNA, 354 bp, Gossypium hirsutum
  Clone ID: uC-gsronu33B179b05b1
ccttcttgtccgctagctggccagaccttacttcggggcttgactaacagcggcctgggcgaccccaactctcaccgcctcgaggagatcgacgcttgctccgccgaatgcgaggtcaacattgcacaggagtggctcgagaagcttccgccacgtacctatgatgaggagtatgtgttggtgaggaattcgaggggacgcactctgaacacgcatcccaagcttggaggtcaggccgtgcttacgcctcatctccaaggcatggtcgtcgccggcccccaggcttagccgagggatattccataaatatttgcaggggaaaaagagatgaatgtgggaacatttagtgcatcc

SEQ ID NO: 5485 - DNA, 452 bp, Gossypium hirsutum
  Clone ID: uC-gsronu33B179b06b1
cttctttccgtttaggtgtgtgtatcaggaacggggcgatgcttggaagacaggtgtttcactgtctaaagatttgatggccattgccggaggtgcactgaagaccaatatcactactttgggtcctctcgtgctaccaatcagcgagcagcttttgtttttcacaaccttggtggtgaagaaattgttcaatgccggtattaagccttatattccagatttcaagttggcatttgatcatttctgtatacatgctgggggtagagctgtgattgatgagctggagaaaaacctgcagctgctaccaatacacgtggaggcttctagaatgacactccatcgttttggaaatactcattcaagttccatttggtatgaattggcctacattgaggccaaagggaggatgccggagcgaaaccctgtttggcaaatcgcatttgggagtggct

SEQ ID NO: 5486 - DNA, 482 bp, Gossypium hirsutum
  Clone ID: uC-gsronu33B179b07b1
ttttgctctttattttctgtgttcatcaggttctggttatctcttagaattttatgacagaccctgatcctaaactctcaattatgtcttccaagcaaggtggcaaagcaaagcctttgaagcaacccaaagctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttatcgagtcctgtcttgggattaaaacatctattatgctgatgtctcttgtttctattgtgatagttgggatgatttgatgctctagtttcattctgaatttgctattaaaaacattgtgtgtaatttcgtgacgtataacttaataaattcaagttctacgtttgtgtttttt

SEQ ID NO: 5487 - DNA, 547 bp, Gossypium hirsutum
  unsure (1)..(547): unsure at all n locations
  Clone ID: uC-gsronu33B179b08b1
ttctcgcgtccgccggaagataataaagcgtttgtctcagatctcagaagatggcccgtaccaagcaaaccgcccgtaagtctactggtgggaaggctccaaggaagcaacttgctaccaaggctgcccgtaaatctgccccaaccaccggtggtgtgaagaagcctcatcgataccgtcctggaactgttgctcttcgtgaaattcgtaaataccagaagagtactgagcttcttatcaggaaattgcctttccagaggcttgttcgtgaaattgcccaggacttcaagactgatttgcgtttccagagccatgctgttctagctctccaggaagctgcagaggcataccttgtgggtctttttgaagacaccaacctttgcgatccatgccaagcgtgtcacaattatgcccaaggacatccagttggctcgtaggatcaggggagagcgtgcttaatttccagaagtgtggatcagtcgcttagaagaaactattgtttattttaggcaaatgtattggnttttggtttttctaatcatctttt

SEQ ID NO: 5488 - DNA, 541 bp, Gossypium hirsutum
  unsure (1)..(541): unsure at all n locations
  Clone ID: uC-gsronu33B179b09b1
ctttttctctctctatattttctcatctccttttgcaccgccgttgatctcgatccgtatccccgttttcaaaaaagctccaaaaagatggccaatgctgcatcgggaatggctgtgcatgatgattgcaagttgaagttccaagaacttaaggcaaaaagaacccaccgctttattgttttcaaaatcgaggagaagcagaagcaagttatcgtggagaagcttggtgagccaactgagagctatgaagattttactaaatgtcttcccgctgatgaatgtcgttatgctgtgtacgattttgattttctaacagccgagaacgtcccaaagagcagaatctttttcatcgcatggtctcccgatacatcaaggatcaggagcaaaatgatatatgctagctccaaagacagattcaagcgagaactggatggaatccaagtggaattgcaagcaacagatccaaccgagatgggtcttgatgtcttcaaaagccgtgcaaactgaatacagttcttttaggcttttgcaacggngaagc

SEQ ID NO: 5489 - DNA, 533 bp, Gossypium hirsutum
  unsure (1)..(533): unsure at all n locations
  Clone ID: uC-gsronu33B179b10b1
ttgttggctaaaggcaaggctggtgagtctaatccggatactggtttaggattaggcgagtctggtaattggcttcctggtagtcctagagttctatctcttctatcttctgttctcgaaagatcggtacgagggaacgaaaagttattggcgggatcgaaaattaaggatgttattaccatattccatggttcaagagcaccttccttgaaccttagacagtatgtcgaacgcatcttcaagtactgtaaatgcagcaattcttgctttgtcgttgctgttatatatattgacaggttcctgcaacgaatcgacgcttaccttacttcactcagcgtgcatcgtctcttgattacgagtgtcatggtagctgcaaagtttatggatgaccagcattataacaatgcgtattacgccaaagtggggggaattagcagagaagaaatgaacagattggagatgaggtttttattcgatttggattntcaacttaatgtcacgactgangtcttcaacangtattggcttatgat

SEQ ID NO: 5490 - DNA, 567 bp, Gossypium hirsutum
  unsure (1)..(567): unsure at all n locations
  Clone ID: uC-gsronu33B179b11b1
tgtttaattcatgacagagtatgttgtcacccgttggtaccgtgcacctgagctcctactatgctgtgacaattatgggacatccattgatgtttggtcagtaggatgcatctttgcagagattcttggtcggaaaccaatctttcctggaacagagtgcctcagccagcttaagctaataatcgatgtccttggaagccagcaagaggctgatcttcagtttattgataatcccaaagcccgaaggtatatcaagtcacttccttattctaggggcacccatctttcccatttatatcctcaagccgatccattagccatagatttgttgcaaaggatgcttgtttttgacccatctaagagaattaccgtcacagaagctctcctacacccatacatgtcagggctatatgatctgaggtgcaatccacctgcccaagtcccgattgatctcgacatagacgagaacatgagagaagagatgattagggagatgatgtgggctgagatgcttcattaccacccagaggctgcatctgcaaatgcttagatgacatnngtttaagc

SEQ ID NO: 5491 - DNA, 558 bp, Gossypium hirsutum
  unsure (1)..(558): unsure at all n locations
  Clone ID: uC-gsronu33B179b12b1
ttcttggaggggcttgagaacattctgaagggtggggaggctgataaggaaatggggatgaacggtggaatcaatctatatgcacaaatgatagatgagtgcgatgggttggataaaattgaaaacctgcaaactcatgacaaccatgagatatacgagaaggctgtgaagatcttggagagatactgggctgaagaggaagaagatgaacagaatatccaagatggtgggaatgaaaatcagcaaggctttaattttggggtgaaccagcagccaagtgttccacctggtggcttcaaatttggttgaagtgtttttagtttgggaattgggaccctagttttgtaggtctactacattggtcgcaatgaaatttttaaaagacttgttttttatgtttttgcaatttggtgggtgtgtgccaaggggtcagggtttttgttctggcgcaaaggcttttgctgtgtctggttttggtttattttggaatgtgttgaaagggtttaaactnttgattgatttctatatttcatagaaaaatatttcttgtggtgtgtc

SEQ ID NO: 5492 - DNA, 549 bp, Gossypium hirsutum
  Clone ID: uC-gsronu33B179c01b1
cccatcttccgcccacgcgtccgacggaacagtggtggcttttgctgacatgatgaggaagaaaatctccatgccagcacacttgatgtatgatggccaagatgacaatctttttgataatttctcagctgttgcacagagacttggggtttacactgccagagactatgctgatatactagagttcctggtgaacaaatggaaggtgacggagttaactggactttcagccgacgggcgtaaagctcaggattatgtgtgcggacttccaccaagaattcgaaggctggaagagagagctcaaggaagggccaaggaagcacccagggttccattcagctggatatttgatagagaagtccagctctaaggcttttttaaattttctgaagatgaaaaatggtgatttcaatttcctgcaacagaggtagaagttttcaacatgcaatttctcttttaaaattccccatgtaatgtttgcttgaacaagtttcagtccatcagattcaagtaaaaagtttaaactggataaataatgtttataatccg

SEQ ID NO: 5493 - DNA, 121 bp, Gossypium hirsutum
  Clone ID: uC-gsronu33B179c03b1
attagtgtcctctgtaaatgaaccgagaggtaggggcggctttgacagattctgagctgcgattgtcataaaaaaaacaaaagctgaactaaaaacccaaatgtatctacttgggacgccc

SEQ ID NO: 5494 - DNA, 565 bp, Gossypium hirsutum
  Clone ID: uC-gsronu33B179c04b1
gtgttttgcttcaaggtaagagtcgattgattgttggaaaaccttaaacgaatctgggggtggcggagaaagcaatcgagtcggttcaatgctttggccggaagaagacggcggtagccgtaacacactgcaagagaggccgtggtttgatcaagatcaatggttgtcccattgagcttgtcgagcccgagatcctccgtttcaaggccgtcgagccaatccttctcctcggccgtcagcgttttgccggcgttgacatgaggatccgagtcaaaggtggaggtcacacttctcagatctacgctatccgtcaaagcatcgctaaagcccttgtcgctttttaccagaagtacgttgatgagcagagcaagaaggagattaaggatattttggtcggttacgataggactttggtggtcgctgatcccggaggtgcgagcctaagaagtttggtggatgaggtgccaaggcaagggttccgaagagttatccgtgaagaactgtcatgggttggtttgatggtgctcttaaccgaaatgatctgttatgcctggtttgaattaag

SEQ ID NO: 5495 - DNA, 328 bp, Gossypium hirsutum
  Clone ID: uC-gsronu33B179c09b1
ttgttgctggaactggtttcttctatgtgaagaggaaaagtgctaagaaagtggctgagaaactcgagttccgcaagtacgatcctcgtgtaaatcgccatgttcttttcactgaacaaaaaatgaaataaaggttgaagctggtatgtagcagctattgaaatcaatgttactcctaggttctgtttctcgttgacaatatcaaattttgcaaaagctttgaataaattgacgtgtgtttctaaaaaaaaaaaaaaaaaaaaaaaaaaaaaaaaaaaaaaaaaaaaaaaaaaaaaaaaaataaaaaaaaaaaaaaaaaaaataaaaa

SEQ ID NO: 5496 - DNA, 555 bp, Gossypium hirsutum
  Clone ID: uC-gsronu33B179c10b1
tttttcgagttcttttaggtgattttctgttaggggtgttcggtgatggctccaagtcaacctaaaactggcctttctgtgggcttaaacaaaggacatgttgttaccaagaaggaattggcttcccgcccttctaatagaaaggggaaaaccagcaagagagtccactttgtgaggagcctaattcgggaggttgctggtttcgctccatatgagaagaggataactgaacttctcaaagttgggaaagataagcgtgctttgaaggtggcaaagagaaagctaggcactcacaagcgggccaagaagaagcgtgaggagatgtctagcgttctccgcaagatgaggtcagctggaggtggggagaaaaagaagtgagttgccctgcggttgtgcttaaagcaagtattgagtttttagatttgttaaattttctcttcagttttgttttgagagtttggagtactgattcggatagcattcttttacttgtgttggatatttaaaaaaaacatgaaatttgcatcacttaattgcaatctagattcgattatg

SEQ ID NO: 5497 - DNA, 564 bp, Gossypium hirsutum
  unsure (1)..(564): unsure at all n locations
  Clone ID: uC-gsronu33B179c11b1
tcttcgcgtccggttttgaaggtgacaaacaacagcacaccacacagcagcgcattgtcttgttcttgttcttcttctagttgtttccaatggaaaagctggaacacctcaaatctgccgtcgctgctctttctgaaatcagtgaaaatgagaaaaacggattcatcaaccttgtctcccgctatctcagtggagaagctcagcacatagagtggagtaagatccagactccaactgatgaagtggttgttccttatgacaccttgtctccctctcctgatgatcctgctgaaaccaagaagctcttggacaaacttgttgtcttaaagcttaatggaggtcttggaaccactatgggatgtactggtcccaaatccgtcattgaagttcgcaatggcttgacttttcttgacctaattgttattcagatcgagaatcttaattctaaatacggatgtaatgttccgttggttctgatgaactcattcaacacccatgatgacacattgaagattgtcgacangtactcaaattcaaacattgagattcatactttcaatcaga

SEQ ID NO: 5498 - DNA, 430 bp, Gossypium hirsutum
  Clone ID: uC-gsronu33B179d02b1
aagtctttcagcactcagaccatcatctccggaggggggccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcacgggctataattatgtctctgtctgtgtcttgtgtaatagaagctttgtttgtggtgaaaataatgtataagccatttggttgggagcaaattgtccttttctccaaaggatttttgctgctcattcatggtgacttggtttatggttttatctgttgttgttaaaatcttataaaaatatatatcggttgctgct

SEQ ID NO: 5499 - DNA, 459 bp, Gossypium hirsutum
  Clone ID: uC-gsronu33B179d05b1
ccttcttttccgcctgaaactagaattatggcacaggggctgaagccttcttctgatgcatctagtaggtctgtgttaaatagcacaggaaatataagatctcagggcaagtgttctgcagagaacaagatcaagtctcaggatgctcatgttgaaactttaaagatactggaagaagaaatggctgaattgactaccaaaggaagcagaactagctcaccaaatcgccgttttagtttcagcttaactcgtctgagtagaagtttcagttttaaggaaagttctgcagtcccacaaatgaaccccggttatgtttctgtcaagtctggcccagtgaggtctgattcttctggttttctggatgatatgaacagagataagttgaatggccataccagaactagatccagccccttaagaagggtgctagatccactactgaagtccaggggctaaatt

SEQ ID NO: 5500 - DNA, 507 bp, Gossypium hirsutum
  unsure (1)..(507): unsure at all n locations
  Clone ID: uC-gsronu33B179d06b1
attcctcatagctttaatcaagttccttgagtgattacttgtgggtgcctgtgagtatacagcatatgctgaattctcagggaatcaaaggacctccttacagattcatccatggcaacaacaaggaaattatcaaaatgagaaaggaagctatgagcaaacctaaggccttgacgcatgatatgtttatcaaattgcagccacatacgcactcctggatcaaagaatatggtaagatggatgcatgtttctcactatgctgttaataacttgtagctttaagtaaaaaagggtcaaccctttttgttgttttctacgtgattagggaagaattttgtgtattggaacggtgttcgagctgaactggtgatttcagacgctgaattagtcaagaggttatgaaaaatagtttaaatgtttttccaaaagcgaagccatcagtttatgttagcaacctactgngaaatgggcttgtgatgatcgagggtgaaaaatgggtgaaacatc

SEQ ID NO: 5501 - DNA, 508 bp, Gossypium hirsutum
  Clone ID: uC-gsronu33B179d07b1
tttttcgcgtgcgcggagctactgccgtcgtgggggtcatggtgaagttattgatgtgcaccatggccgtgattggcctccaaggccgatttgctgagcgcatagtggtgatcgctagatccttggacgatggaacacgggacctaccctatggccactggtcgtatgcagggttaaagaagtgccacgagcagggacattcatacggattccgacaagaaaacagcaaaaaaactgtgacggacgggcttggtaaggctggtaaactaccaacagctgatgccgacccgctacaccctcgacggggactcgaaagacgtggctaccgtacatgcactgcagaccaaggacatgaaagtggcgctttgcaaggcgaccaatgagaggactgcagagagtatcaagactggaaagaacaggttggttttatactaagcttaggtattgaggatattgacctttattatagtatctctatttgagaaaaaaaagtgagactttggatcta

SEQ ID NO: 5502 - DNA, 555 bp, Gossypium hirsutum
  unsure (1)..(555): unsure at all n locations
  Clone ID: uC-gsronu33B179d10b1
ttttgtcgtttctatagctgaagaaactcttgaggggctgaaaagagcaaggttttgatcatcggaggaactggatatctgggaaagttcattgtggaagccagtgcaaaagagggtcatcccactttcgtttttgtaagggagtccaccgtctccgaccctgttaagggaaaacttgtcgacaacttcaagaacttaggggtccatttgttgttaggggatatgtacgaccatgagagtttggtcaaggcaataaagcaagttgatgtggtgatttcggttgtgggtcaaatgcagttagcagatcaagttaagatcattgctgctattaaagaagctgggaatgtcaagagatttttcccatcggaatttggaatggacgtggacaagaacaatgcggttgagccagcaaaatcgacattcgcaatcaaggctcaaatccgtcgtgctgttgaggctgaagggatcccttacacttatgtgcctgctaactgctttgcaggctattttcttcctacatngtcgcagccaggagccacctcttccccaagagac

SEQ ID NO: 5503 - DNA, 93 bp, Gossypium hirsutum
  Clone ID: uC-gsronu33B179d12b1
taataataaaacacaaaaaaaaaaaaaaaaaaaagaggaattttttaaagactttttggtgttataaaaaaccaaacatatacaaacaacata

SEQ ID NO: 5504 - DNA, 416 bp, Gossypium hirsutum
  unsure (1)..(416): unsure at all n locations
  Clone ID: uC-gsronu33B179e01b1
cccactcgtcaaccnaattaaattagagagagaggggggtctttataataagtttggctggaaatacacacaatctactgactaggtcaaagtgggttcccacattaaaaaccctaacgttcttaactcatgattaactcttcctcccaagctacggttacatctcaaacgtcgactaatgccctcttcaaggtgttactattaaagctcagcgtcattccaaaaactacaagtatcctttgggatcgatttttaaacccttaactaccatcgtngattagttatacgtacttttccacaattgtggagagtcgattaactccaagtcccctaattctccgccttctgaagaaacctgtctgatgaattcgagcccattgatttcgtctatgaactctattaggatgtcttaaaac

SEQ ID NO: 5505 - DNA, 523 bp, Gossypium hirsutum
  unsure (1)..(523): unsure at all n locations
  Clone ID: uC-gsronu33B179e04b1
ccttcttgtccgcccacgcgtccgcagttcttcagaggattgcaacaatagcaagtggtggaaagaagggaatcccacatgagacgcgtaacacatttttagtagtcacagtgctaattataacagccacatacactgccactttgaaccctccaaagcagcctgataccatttcaaattcccagaatttccatctcacgtatgacatatctttaggttcaaccagcactggacccgtaccaagtcctccacccgctgaagaaaaaaaaatagaaaatatactagacgtgtccacaatgttttggttatacaacactttaaccttttgggcaacaactgttttaacagcgtatctcctacccagcccgtcaatgtccttgtttattctcataacacttttcttgtttgggacctgttacatgcttttggttgctggttccatacggacactcgcacttcagtatttnttctatctttcgactcctggatcccgttcctattctaaactcagcactactaatta

SEQ ID NO: 5506 - DNA, 417 bp, Gossypium hirsutum
  Clone ID: uC-gsronu33B179e05b1
ggttttgcggtgctttcggtttcggccggatctatgggggtatgcaatataagtatgggggtctcgggctacgtactacgttaaaaacgttacggattattggacatgagagagagagagagagagagagagagagagagagagagattattgtttattgatgtgtggttgtaatagatttatgtttcattttgtggggttattggaaactctttgagctttggaccatcctctaaaatttagtgctatagtgttctatttggttcccatttatttctctactaaaatgaaccctgagaaggtattttcccccttaatttaatatccataattgattttttgtactagtgccacgggattattactctcttttgcaaagatttattcgaatagacctctttgagggatttcaatggt

SEQ ID NO: 5507 - DNA, 357 bp, Gossypium hirsutum
  Clone ID: uC-gsronu33B179e06b1
atttattcgggtcatacttgcttttctacaaagtacggaatacctatttgaatacttgtgttttcgactttttaagatgagatgaagagagtgcttattttgtttagttaggaagttatttctgttcaaatttgttataagttagatttgttattcagcttgcaattaagctttgagtgagattgtatcttagtgaatgagttatacttaaataatgttttactttttgagtaagactccgtttacataaagagtttccaaattgtgtatataaacttttgatgtccatttttatttaaaaaaaaaaaaaaataaaaaaaaatataaataataaaataaattatataaaaaaatatg

SEQ ID NO: 5508 - DNA, 472 bp, Gossypium hirsutum
  Clone ID: uC-gsronu33B179e09b1
tcctacgcgtccgcaaacctttcacttctcaactcggtcaaattcaccatgtctgacaagtgcggcaactgcgactgctctgacaagagccagtgcgtgaagaaaggaaacagcatggtcattgagactgaaaagagctacatcagcactgtagtggtcgaggctgtggcagagaacgatggcaagtgcaagtgtggagatagctgcagctgcacaaactgcacatgtggaactcattaagcagacatagaaccatgatgttttagtccatagaactattaggacctaaaactaatgaaattgagttgaataaattggtgttttgttgttgttgtttgagacattgagtgtgttttcatgtctgtctgtcttatgtctgagtctcattgtacacaatgatggaatggccatatctatggacattgtatgattaatgaattattatcagtataaatcttctctttatattcat

SEQ ID NO: 5509 - DNA, 561 bp, Gossypium hirsutum
  unsure (1)..(561): unsure at all n locations
  Clone ID: uC-gsronu33B179e10b1
ttcttcgcgtccgtgttttagttgccataacggcgggttccattacaacccacagtgaggcaacaatatgtcttcactactctcacgttgctcatcctgttttccctcagttgttcaacaacattagcccaatctccggcactggccccggcaccttctggcccgacaaacgtcaccaagatcctcgaaaaagccggtcaattcaccctcttcattcgtcttctaaagtccactcaagtggccaaccagctgctcggtcagctcaacaattccaacaatggtatgaccgtttttgcaccaacggacaatgctttctccagccttaaatcgggcacattgaattcactcaccgatgaacaaaaagtgcagctggtgcaattccacatcgtcccaacatacctcacctcgtctcagttccaaaccattagcaaccctttgagaacccaagctggtgatagtggcgatggcaagntccctttcaatgtcaccacttcggngaactctgtgaatataacaacagggttgacaaacaccagtgtttcccgcactanttacactgat

SEQ ID NO: 5510 - DNA, 563 bp, Gossypium hirsutum
  Clone ID: uC-gsronu33B179e12b1
tggttaagagaaaaacaatgatttctatgctgttggggggttgaaaaggaatgcactcaaacagagctcaggactgcttataagaaacttgccctgagatggcaccctgatcgttgctctgcctcggcaaattccaagtttgtggaacaagccaagaagaaattccaggccattcaacaagcctattctgttctgtctgacgcaaacaaaaggttcctgtacgacgtaggagtttatgacagtgatgacgacgaaaatggcatgggagactttttgaacgaaatgactgccatgatgtccagtgaaaacggagaagaaagctttgaggaattacaggaattgtttgaaaaaatgttccaggctgacattgattcattagattgtagtggtcagtcaccaacatcttgctctgcttcatcttcgtttgcgtcgtacggtgacagttcgggctccaacaaccggagttcctccgaaatgagttcaggggagaccatgccggaaaacatcgatacacgacttaatcatatctttctggggacagatgggaaacacaggagacatca

SEQ ID NO: 5511 - DNA, 354 bp, Gossypium hirsutum
  Clone ID: uC-gsronu33B179f02b1
ctttaatctcagctgctatggcacccatcgcacgggtgcttttgctcgcgcttctgtgaactgcactcacgatttcatcagggtctggggatgggtacaccatcaatggtcgagtgaagatcccccaaggtctgggtacaaaagggtttgctttgcctggaaaaacgtcaaatgtcaaagttatactcaatggtggccaaattgctacttatctgagacctgatggaaatttttcatttcagaacataccaacagggactgatttgattgaagtggctgctattggcgtatagatttctcctgttagagtcgaagttagcgctagaaacccaagcaaggtacaggctgcattga

SEQ ID NO: 5512 - DNA, 155 bp, Gossypium hirsutum
  Clone ID: uC-gsronu33B179f04b1
ttttctttttaatttattcgtgtatagaaatgtgggcgtccgtatgattgatgaaggtgtttctatttattgtgggcatgcatttgctatttggtggataatttggtgtactatgtgcactattagcaataaaagaatctatttgtttcaatgtc

SEQ ID NO: 5513 - DNA, 551 bp, Gossypium hirsutum
  Clone ID: uC-gsronu33B179f05b1
ccttctttttccgacgactcgatagataggaaaccgggggcaaagcaggaaaaaatgcggacttcgttgagatacagtggtgactccaaagctctacgaatccacgccaaggagaagttccccttcgattccaaaacccatttgcaggttcaaggcgagctggacacaagaactggagtccccaataacttctgtgcaatgataaggcactcatatcatgatttgttcacaagccttggtgttggaatgcgctatgataagcgtgataaggtgcggtacacactgcgaggaaaaaaatctttccttgtaaccaacgatgattcagtcaattttgttatcaagggaagatatgatgttgatcaagaattcaaggggaggaagtcagaaggagctgctgaatttatttataaaatcttcaatttccagaaagaccaagatgttagactcaaagttggctatgaagtatttgagcaggtgccatatctgcagattagggaaaataattggaccctcaatgctgacatgaatggtagatggaatataagattcga

SEQ ID NO: 5514 - DNA, 514 bp, Gossypium hirsutum
  Clone ID: uC-gsronu33B179f11b1
ttcttcgcgtccgcttgaaaccgaattgagtcgccgtggaaagcctattgcagctgatgcgggtgggaagttgtacacaattatggagatttgccgtctttttgatcaaaatttcagagaacatttagatggggtgcgtactggtggtgataaggtttacaatgttttcgacaaccaacttcctgctgctttgaaaaggttgcaatttgacaggcaactatcaatggagaatattaggaagcttattactgaagctgatggctatcaaccacatttaatagctcctgaacaaggatatcgtcgtttgattgaatctactttagttactatcagaggtccagctgaggctgctgttgatgcgactcattccattctgaaggatctggttcacaaggctatgagtgaaactccagagttaaagcaatatcctgcactcagaggagaggtgggaaatgctgcgatcgagtctcttgaaagatgagggatcagagcaaaaagcaacacttcaactggt

SEQ ID NO: 5515 - DNA, 518 bp, Gossypium hirsutum
  Clone ID: uC-gsronu33B179f12b1
ttatttcaactaatagccaaaagaaatcggacccgacattgaataaggatgaacagtagtgaagggaagttgaaatcatcgagttccgaattggatttggatcgacccaacatcgaagattatctcccttctggatcttccattcaagaaccacatggcaagcttcgcctgcgggatttgcttgatatttctcccgctttaactgaagctgctggtgctattgttgatgattcattcacacggtgttttaagtcgaatcccccggaaccgtggaactggaatgtgtatctgtttcctctctggtgttgtggtgtggattttcggtacttgattttgttccctatgagggctttagttttgacaataggatggataatatttctgtcatgcttcattcctgtgcactttcttctcaaagggaacgataacttgcggaaaaagatggagagggcgttggtggagctaatctgtagcttctttgttgcgtcctggactggagttagtagtaccatggacca

SEQ ID NO: 5516 - DNA, 405 bp, Gossypium hirsutum
  Clone ID: uC-gsronu33B179g01b1
ccctttcttccgagcaaccaaactctgaaatatgctgggccttattatataacattggggtcgattagtcctcttctcggtatcgctgccatggctgggttcgagcagccaataaaggagagagccaaggagctcaaggttttcttcaagaagggtgtgaagatcgtgggagaatcatgcaagaaaggttggtacaaagccaagcacatcaaaggctgattcttttgccttccatcatcttgcattctttgcgccttccatgtagagatctttgtcagtcatcttgatttggagggttttctataatttatcgaaggatcttatcctgtcttctgctgaggagttttacaagacgctagaagctctgtctaagaaagacgagcctaaagtcacctccggagatcc

SEQ ID NO: 5517 - DNA, 426 bp, Gossypium hirsutum
  Clone ID: uC-gsronu33B179g02b1
gacttttgcttcagaattgcaaatggagattctttctgaacgaccatcttctttctcaactttgaatcccaacgctccattgtttgttccgttagcgtatcggacggtggaggatttctctgatgagtggtgggctctcgtccaatcctgcccgtgtttccgcgactactggcttcaagaacgtttccacgatccccaaaacgacgacgccgatcttctttttcccgacgatcttgatgccgtctttgacgattacgacgactttttcgttgaccctacctgtgaagggaaggaagaagatactcaaaaggaattggtacccggtggagcattcaaatggcggaaggggcgagttgtgagcgagtcaactaggtttcttgagaaagcgcccaagatcgtgaatgtgaaagtgagtcccgggaatat

SEQ ID NO: 5518 - DNA, 405 bp, Gossypium hirsutum
  Clone ID: uC-gsronu33B179g03b1
atttatttaatggttaaaattcatgaaagctatgatagggtgaacagagtgtggggcactccagtcccgatcattcaactactccccattcagagagatggacaagtttccggcgtttcttcttcttccatttctttgtttcttccactctttgtttctttccgacgccgatgttaccggaaattcgtgcgatcctggcctaactctgtacgccgagtctatctgcgcccagcttatcgagcccaatggttatttctgcaccgaacacactgttcaaactaaggatggctatttattagctctccaacgcgtctcatctggttctggggatcttaaagttcagcaaggtcatactggtctgcttcagcatggattattcatggcaggtgatgcatggtttttgga

SEQ ID NO: 5519 - DNA, 446 bp, Gossypium hirsutum
  Clone ID: uC-gsronu33B179g04b1
ccttctcgtccgcccacgcgtccgctttttggcaatcaattttgtaagcaagtatggctaaggacgttgaggttggtggtgagttccaagccaaggactaccatgatcctccaccagctccattggtggacggggaggagttgacaaagtggtcattttatagggctgtaatagccgagtttattgccacgctcttatttttatacatcactgtgttgacagtgatcggatacaagagtcaggttgaccctgataagggcagtgacgaatgtggtggtgttggcattcttggcattgcttgggcttttggggggatgatctttatcccttgttactgcactgctggtatctctggaggacacaataacccagcagtgacctttgggctttttttggctaggaaggtgtccttagttcgagccatttttatatgactgttaatgttt

SEQ ID NO: 5520 - DNA, 512 bp, Gossypium hirsutum
  Clone ID: uC-gsronu33B179g07b1
tgtttccacgggatcatacttgtttatgatgtaacactgagagaaacattcacaaatttgtccgatctttgggccaaagaagtggagctctattctaccaatcaagactgtgtcaagatgcttgtcggaaataaagttgatcgtgtaagtctaatgttctctttccaattcatatctgcattttatttgacatatttatagattatatttgaaacccatatatcataattgcttcttctttttaaaattttagtcggactcgaatatcaatatcgaatataggtatatgttgaatatctaaatgttcaacaattagggttgatgtccgaagtattcataggccaatctttgttttttgatagaatgcctgtaactattcgtaatccctcttcaactcttaaataagaggataatacgcttcaatgcattcaaatcaagtccttctgtactgacaactgagctaaaacttaaccgacttcttcaaagatgttgaattgaatattttttaaaaa

SEQ ID NO: 5521 - DNA, 410 bp, Gossypium hirsutum
  Clone ID: uC-gsronu33B179g08b1
ttttaggacagctctggaagcaggacttaacccatgtcaaggacccacatctctcccagagaagattgacgaaaagacaaaagaagatctcaaggacatagctcggtcagaggcagacgtaagaaatttgaacaaaagggttaatgagctggggacacagcttaatcaccagcctgagcaaaagtctgtttccatgagtgactcatgcactcaacgtgaaccaaatcatcaaacaaaaatgaaggataagacaaagggtgctgaagctcctatgaggtcaagaagcaagaaggaaatgaaagtggacaaagcggaaggtgagaaagggaagaagcaagaatcatctatggcaaatagacataggaaatccggttcagcaggaaatggatgtggacatagccgaatctgag

SEQ ID NO: 5522 - DNA, 473 bp, Gossypium hirsutum
  Clone ID: uC-gsronu33B179g09b1
gttgccacacgtcctcttatcggtgatgtggtcactgctctctcgtatttagcaaatcaagcatacgatcctaatacaacagggaatggccatagaggctctggagaaaccgatgaaaaaagataccgagacgacagaggaggaagggtatcgaagaacgacgaaggaggagtatccggccgtaagggggatttagaagggtccgagaaagagaactcccctagagaaacagccaggatgttgaacagggatttggatagggaacgagctgtagccgaagccaagatgtggggcgagaattggcgagagaaaagacgacaaagcgcacaaggtagttccgatggttcaaacggctaacatcccgattttcttccatcaatgtttatccagatttctcacttgaaccagatgaaaaaaaaaaaacacatatccgagctcttttcgcttcgttctatcaaaaagctcggcccgat

SEQ ID NO: 5523 - DNA, 514 bp, Gossypium hirsutum
  Clone ID: uC-gsronu33B179g11b1
tcctcgcgtccgcccacgcgtccggaacggcctggatcttctcaaaaaattctgcatctcaaacgttattttttcctgatggagaagctgaaaatttcaccatctaaaaagcttgaagtgcttttggctgataaatgaccaaaataacctgtcttctcccccttggaaaaacgttctttcctctgctgtgaaagttctatacctatttttttcacattttcgctgtgaaagctccttcctgttctttgttcctcttccgcagagatgctcttgatgctttgggattggttcggtactgctgtaggagaatgcttatgactcatgttgacctcattgagaagcttctgaactacaacacattggagaagtcggagaccagttgaggaaacatgtagaatctaagggtttgttgcagtttgtttgagcgcctgtcattgattctcagttttgtttaagtggggccgtgtttgaatccagaagaaggggaggaaaggacttaaatagtactagtcta

SEQ ID NO: 5524 - DNA, 528 bp, Gossypium hirsutum
  unsure (1)..(528): unsure at all n locations
  Clone ID: uC-gsronu33B179g12b1
tttacgcgtccgcaaaaatttcatggctcggaaagtctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctcaaggcttgaaggttattgcctgcattggggagactcttgaagagcgagaatctggctctaccatggcttgtgttgctgcacaaaccaaagcaattgctggaaaagtaacaaatngngacaatgttgttttggcttatgaacctgtttg

SEQ ID NO: 5525 - DNA, 567 bp, Gossypium hirsutum
  Clone ID: uC-gsronu33B179h04b1
gtttgtgatttagatgcttggggcattccaacatgggcgaatccccaagtatatgccaaatggtccaaaaaccattccttcaagctcggagactctctcttgttcctatacccaccaagtcaagattcagtgatccaagtgacggaacaatcctacaacagttgtaacctcaaagatccaatcttgtacatgaataatggcaactcactgttcaacatcactaagcctggggagtatttcttcaccagtggggagcctggtcactgtgaaaagaagcagaagctttacatcgccgtgctttcaggcaacggctctgcagcacttgctccttcttacggtccatctgcattaccggacactgcatcgtcaccgtcttacacgactgtcttcggcaacatccctcaaccgccttcttatcgccgtactagggttcccattattcgttacagctgttattgcatcagccacatggggaataatcaatgccatgatatgaagaaggggacatagttactcgctctttactgtcaaattgtcaaaccattccatttggcattttatttattt

SEQ ID NO: 5526 - DNA, 416 bp, Gossypium hirsutum
  Clone ID: uC-gsronu33B179h05b1
ccctctcgtccgctttttgagctttcgtgtttggggggtgaattctttccctcactggctcgaaaaaaaaaatgtcttcaggttgcaattgcggatctaactgcagctgcggtgacaactgctcatgcagcaggaaccttaaccttggatattcggagaagataaccagcactcagaccatcatctccggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaagggctataattatggctctggct

SEQ ID NO: 5527 - DNA, 404 bp, Gossypium hirsutum
  unsure (1)..(404): unsure at all n locations
  Clone ID: uC-gsronu33B179h06b1
gtttctggctcgcttgtgagagtatttaccagcctggaggaaaaagcaccagcaatggttcttttgggctctgtacttggtattgcaacaaatggcgcagtcctgagtcaaattattctgtattggaattcacaagtcccgaaggagaagaaagcagagtaaattgatatcatgtcagggtcagaagtaggaggaggttaagattggtgcagtcggtgatcatcggattatcatcaacttatagttgacactatgaattggcaaatcttgtagatgattcattttagatattagtaaatgggattgttctacttttatgtgctttctttagtagttgacatgaatcatgctgcatttgcctgttggttagtattattttcattttatgttgaatatttggtnna

SEQ ID NO: 5528 - DNA, 340 bp, Gossypium hirsutum
  unsure (1)..(340): unsure at all n locations
  Clone ID: uC-gsronu33B179h07b1
ccttcgcgtccgcccacgcgtccgcccacgcgtggggcggtgacaactgctcatgcggcangaaccttaaccttggatattcggagaagacaaccagcactcagaccatcatcttcggagttgcgccagtgaagatgacctttgagggaccagagatgagcactactgaatcaggacatggatgcaagtgtggatcaaactgctcttgtgatccatgcaactgttgaaaagcttgatgaaagccatagattatgaaaaaaagaaagcagcaaaaataacaggcctctgtaatgatatattgtcaaggatggatgcctgcaaggtctataattatgtctct

SEQ ID NO: 5529 - DNA, 593 bp, Gossypium hirsutum
  unsure (1)..(593): unsure at all n locations
  Clone ID: uC-gsronu33B179h09b1
tgctagggaagtccttatcggtctctacaacaggggtctgaaggagatccaggccgtacctgaagacgagggttaccgtaaggccgttgaaagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggatccatggggtgttcctgatgactatgaatgtgaggttatcgaaaatgatgctcctattcccaagcatgttcctcagcaccgacctggtcctcttccggaggagttttacaagacgctagaagctctttctaagaaagacgagcctaaagtcacctccggagatccacagataaaggagtaatgtgacgcagacggttggctgaaatttgcattggtctttcgttcttatttgntgatcttgtattgtgcctgtttccgttgatggaattgagctttaacctatgataaaaagctggaccggaacctttagttgcataataatattgaatgccagtggntataaattttgtggcctt

SEQ ID NO: 5530 - DNA, 159 bp, Gossypium hirsutum
  Clone ID: uC-gsronu33B179h11b1
gtcttcgactttttctgcttgagacccgcacccgagccgacggggggggtagttcaccttggcgcgggtggccttgttgtaggcatcggcccacttcgcgtagaccggagccgggaaggtcgcgcctgcaccggtcacatcctgggccgaagccatgga

SEQ ID NO: 5531 - DNA, 515 bp, Gossypium hirsutum
  unsure (1)..(515): unsure at all n locations
  Clone ID: uC-gsronu33B179h12b1
tctacgcgtccggaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggtgccggaggggtgagagagtgctcggtggaattttgagatctgttcttggaatccatccgagcgccaagcttcagtttttgaactccgaaaatggattcactgaagaaacaatcatcagccgtatccgatgtgggagcttgggcttgaacgttgtangttccgttggccttattatggccaacaagcagctcatgtcncttgccggttatgccttcgtctttgcgactacattaactggattccacttttctatgactgccttaatcggtttggtatcaaatgctacgggtaactcaacaagaaaaaaagttcctttatgggagcttctttggttctctgtcgttgccaatacttcaatcacc

SEQ ID NO: 5532 - DNA, 226 bp, Gossypium hirsutum
  Clone ID: uC-gsronu33B051a05b1
tcccgcacttgatatttcaaccccgcgcccgcaaaacccgggggcggggcaagattaaacagcaacaaccccccacaagcaaacaaaccacaacaccggccccgcgaaccccccccaaaaccccccaagcagacgggaaagaccgccaaggcacacaccagggaaaccgcacgccaagagagaaccagagccaccaaccagagcgcacaacaccaggggccgacgg

SEQ ID NO: 5533 - DNA, 166 bp, Gossypium hirsutum
  Clone ID: uC-gsronu33B051b05b1
cttgtgtttctcccacaccccaaaacaccagagatgtttggtgataacatactcccttgatggcgaacccaataatcaacatcgacctaccatttgctataggtctataaagccatctgattcagagaccttagaacgaaaccactgcgacgcatttcctacaagg

SEQ ID NO: 5534 - DNA, 467 bp, Gossypium hirsutum
  Clone ID: uC-gsronu33B051b08b1
cccattcgtttgtcgtttctcattgcatcttccgtagagagctccaaagcatgttctttgcattaggcctactaatatcacagttcatcaatgaattcatcaaaaaatccgttcaacaagcccgccctgaaacctgtgctcttttagaaatgtgtgattctcacggctgggctttaagtgactctcaatacatgttctttttcgctgctgatttcacccttttgacatgcaaagggatcggcgggatttggaatgttagaaccaagtgggctgctttgtttttaccttggcctttggctgtcttgactatgtattctagggcttatttgggttaccactacggtggccccggttcttgctggagcttctttggggattttgcttggggggctctgcttttgggtggggaaatctatgcccttctgttattaccctttgattgaagagaggtcctttgggaggttttt

SEQ ID NO: 5535 - DNA, 306 bp, Gossypium hirsutum
  Clone ID: uC-gsronu33B051c08b1
tttacggcttttggttatcaaccccccgcaagaggaccatgaggagcggcattgttaatgactcccaacccacaatgtcagctaaagaaggaaaatgcactaaagcgtgaaggtgaaaaaccaactaaaaccgcttctttaaaagggtattacctctgcaagaaaatatgtgccaccatatcattgactggtggcaacacctcgaacaccatatgtttgggactagacctatatctatctagcgataataaagaaacagtggcagctctgctgagactgcaactagctagggcactgcttttgagg

SEQ ID NO: 5536 - DNA, 410 bp, Gossypium hirsutum
  Clone ID: uC-gsronu33B051c09b1
gctttttgtattccatatacctaaggcgacgcatagggaacatctttgttaacgcttaacctataccaaacttgaaagaaatgactgacgttgcaggaggccaatgtggtaaccaaattggaacacatgttcggttcaaagggctgtgcctaagaaagaaattatcctacaggaaagtacaatgcggagggagaatcatgaacacaccacgtgtggcgctagattgagaattattacgagattttcagaggacggtgcttgccttgctgagacttcattgaggttgagcctggctctagaggaaggatgagacttggtccctacggccagagctccatgtgtgctaatgaaccgtttggacaaactggggctttaaacaattgggccaaaggtcattacacttaaagggc

SEQ ID NO: 5537 - DNA, 371 bp, Gossypium hirsutum
  Clone ID: uC-gsronu33B051d09b1
ataggggccccaagtttcacacgcgcgcgtgtgaaacgatatatcttttatatgggggcccctatttaaaatacagtgcgcggttttacacaacggcgactgtgaaaaccctgtggtgacccccaactaaagcgttttggaacacatccctttttcgagaggtggtgaaatcgcaaaggggcccacacctatcgctcttcaaaacaattgcacactctaaagggaaagggacacgccctgtggcgcggcacataacgcgcggggggtgtgggggacacgcacagtgagacctacacttttgcgagcgctatagcccccgccttttgggtttttttctttcttttttgggacactttccgggttttcccccc

SEQ ID NO: 5538 - DNA, 88 bp, Gossypium hirsutum
  Clone ID: uC-gsronu33B051d10b1
ttttccttatcaaccgcggacacgagaagaccaacaaggcaaagccttaaaggaccctctccatccacaccccacaaacaccaacaca

SEQ ID NO: 5539 - DNA, 53 bp, Gossypium hirsutum
  Clone ID: uC-gsronu33B051f04b1
ctatgtcgttctaccccacaagcaaaaccaaaaggggcagggacaaataagaa

SEQ ID NO: 5540 - DNA, 380 bp, Gossypium hirsutum
  Clone ID: uC-gsronu33B051f09b1
cgttttcgtttcaaggatctaggaatgctacaggaccaaatgccattgtatcaaataacttcgtaactatgaagagaccacgcagcagtcaaatccaaaactttccagaatgaatgtcttgaaagagccccaaaagggtgatcatgaaagcttcttgtgaaaacagagaactcatagataatgatggttcttgctttagtccaagaagcctatttgctttgccttctgatcgaagctctctcatgctggattctcttcattttgtcgatgaaagttccgaccaagaattggtgctggatgtgccttgcaatggatcattcccgcaggcagaaactgcttcatcctgctttaagttttgggccacaggcaagcaccagtag

SEQ ID NO: 5541 - DNA, 129 bp, Gossypium hirsutum
  Clone ID: uC-gsronu33B051g06b1
ttttttatccagtccttaagtacaaattgagaatatttgggcttttggcagatccttgttgtttataccatttttgtaagataaagcttcattattacagtaataatttgatggatgaaagttactttt

SEQ ID NO: 5542 - DNA, 342 bp, Gossypium hirsutum
  Clone ID: uC-gsronu33B051g11b1
cttataattttgtccttaagtacaaattgagaatatttgggcttttgtcagatccttgttgtttataccatttttgtaagataaagcttcattattacagtaataatttgatggatgaaagttacttttaaaaaaaaaaaacaaaatacaaacaataactataaatagaacaatatgggcgtacattataaattgatcaagcttaatttctcactttatagcattttctagctccttttttagggaacctaaactgcattccgtgggccctagtttaaaacattgattctgggataacccgtggttttacccatcttatattctctttcatacattcccctt

SEQ ID NO: 5543 - DNA, 238 bp, Gossypium hirsutum
  Clone ID: uC-gsronu33B051h02b1
ttttgatttatataccaaggaggctccttcaagaagcgggtacctacattcttgcattttggtcctagaagtcggataaagattacaatttcctcccttttttttgccaaaaagggctacaaattctaattagcatagtttttctttggtcatattgagtatgctttgtccacgaattcgccttagctttaaaattttttatatgggttatattatttggtaatagaatgttattaaa

SEQ ID NO: 5544 - DNA, 463 bp, Gossypium hirsutum
  Clone ID: uC-gsronu33B057a07b1
atgatagaccaaaaagaagaagagcccggggggagtattacagaggtctgtttcgttttttagctttctatcactgctccaacggacttcttcttttgtggtgctctttacccagatccaggcaatctaagaggactaagatgaatcctttgatgcgcttttaagattatgatgttttggggttactgttcacaccttagtatcatcttgtcatgatttcggatatcgtgatcttcgaggtgagtgttgctgtcaaagttcaacaactacccatgaaagtcttatgtttgaagggtctggatctcaaatttggatttgataagagctttgtgaacggagagatatatatatcaaaacttttgacatttaaatttgacaaactgggttttttggggaggattctaagtttgtacaaactgccaaaaggcaaaaacctaaaaccatttttgatcggttggacttg

SEQ ID NO: 5545 - DNA, 286 bp, Gossypium hirsutum
  Clone ID: uC-gsronu33B057a09b1
atccacgcgtatttttttatgaaggaaatgaaaagaagcctgaaagggggggggtaaaaaaaaattatgaaggggtgattaaaacttaaaaaaagccaaaggcacttaagctatgcttgtgacaagccattgaaatgcaccctaataagctgaaggcaaaagacttaggtataaagaacttctgaacacaattattggtgaaaattagaaagatatagcgaattgtagtgaaaaaaaaaaaaaaaaaaaagaaaaaaagataaaaaaaataaaaaaaggggcggcc

SEQ ID NO: 5546 - DNA, 586 bp, Gossypium hirsutum
  Clone ID: uC-gsronu33B057a11b1
tcgggtttatagaggagggtgggagagacacacgaagggagaaggtttagaatgggtaaccttaaacaaaagtggacggcggaggaagaggaggcgcttctggccggaatcaccaaacacggtcctggaaagtggaagaacatccttaaagatcccgaatttgcccctttcctcactcaccgctccaacattgacctcaaggataaatggcggaatttgagtgtcagtacttctactcaaggtgccagagacatatcaagagcacccaaggtaaaagccattgttgcttcccttcccaacactcccaattcttttgctccagttgcgtctcgtgctcacaatgtaacttctggtactgttgtgggtgattcttcaaacaacggtatagacgggaagaatgctcctaggtataacacaatgatttttgaagcccttttaaccattaaagatacaaatggatgtgatataagtgcaattgtaagctacattgagcataggcatgaagttccaccaaatgtttatagggtactaaagttcaaggttgagaagacttgttcacaaggcaatctggaaaggtcaaaatttg

SEQ ID NO: 5547 - DNA, 207 bp, Gossypium hirsutum
  Clone ID: uC-gsronu33B057a12b1
tcgggttcgcgtgggcaaaatatgcatagagctggggggacagaaaccaaattggctgaagttgctgacaaagagggtaagactttttgcgtcactcgtattgaagttggtttagatgcagttgctctccgggaagcggtttcacttgttattcaacaaaagggaatgccggttatggatttcagtattgacgaaaaccacaaacaa

SEQ ID NO: 5548 - DNA, 487 bp, Gossypium hirsutum
  Clone ID: uC-gsronu33B057b04b1
catttcttttagcctcgattgttttcttcacgcaggcctagtactgctccgatggcaaccaccaccaccaccaccactggcgcctattcattggaagaagaaaaccctaagaataccctggacgctgcctcaccttatatggataagtcagatcctcctagcgcttcaacactttccgatgctgaggtttatggaaaggagggcgagggtttgaagaccactgggactgctgtgggcttggccgctggggaaagcagcggtcccgccgacgatatccagaagaagattcgacgagctgagcgaatcggcgtgcccattcagttatttgagcaagaaaagcgtaattctagggccgaaaggtttggcactgcacccagctcaaagggatcggaagaatctaagccatcggaggagctgaagaggaaggctagagagcatagaggtttgggattgctgacccactacagcaactgatgaggatgcaaag

SEQ ID NO: 5549 - DNA, 520 bp, Gossypium hirsutum
  Clone ID: uC-gsronu33B057b09b1
aaaaaaaaaaggggggttaataaaaaaagaggagctaactaaaacagaggtgaaaactgctaatgcagaaggaaccttaacctaggaaattcggagaagacaaccagcactcaaaccataatatacggagtcgcgccagagaaaatgaacctttgagaggaccagaagaatgagcaaatactagaaatcaaggaacaatggaatgacaagaagtgggatcaaaacatgttaaattgaagaaacaaatgcaacaaggttgaaaaagctttgaatgaaagcccataaaattattgaaaaaaagaaagcagcaaaaaaaacaggcctcaggaatgaaatatagtcaaggaaggaagcccgcaaggactaaaaaaaagtctaagactggggattggagaaaaaaaacaaagttcgtggggaaaataatggataaaccaaatggatgggaacaaatgaacatatttttaaaggaataaaggagactaattaaggggaacatggaaaaggataaaacggaggtggt

SEQ ID NO: 5550 - DNA, 186 bp, Gossypium hirsutum
  Clone ID: uC-gsronu33B057b11b1
ttcgtctttgcgtccgtagattggcccaattctcgggggggttctaatccctaagtgggccctaaaagaatcagcagacacggtgaaaactgattgtcgaggtaacatacatctgacgcttttctcatttgctgtatcggagcggaaaattcatgatctgcagccttccttcataaactaaaaatt

SEQ ID NO: 5551 - DNA, 377 bp, Gossypium hirsutum
  Clone ID: uC-gsronu33B057c05b1
aacaaggagcacaccctctactgttgggaggagggattcaatctttgccgtgtgagctaatgttcttgttgaaatttaacatgtttaaaagtgtttggatgatgaaaagagtttttaccaatgttggaagaactatgttaaaaacttatttcaaaagcactctagcatttctttggctgattgttctttattgatgatttttcagttagcattttgcattgtcatctaacattacctgctgtgtgcctacaatttaatggtgaattggactactccaatttgcctaattttgatttcttttcgtttatataagttaaaaccttttttttctttctcatatttaaactttttctgttctttttctcttttacttttta

SEQ ID NO: 5552 - DNA, 387 bp, Gossypium hirsutum
  Clone ID: uC-gsronu33B057c06b1
actttctttttcagaactatgaagagcggctgctcagagggggcctattgctcagatctttctctcagttcgaaacgatggctacggctggcgaagctgcttgttcttacgctgctttaattctctatgatgatggcattcccatcaccgctgagaaaattgcaacaattgttaaagctgcaaatgtcccggttgaatcttattggccaagcttgcttgaaagcttttcgaaaagtgcaacattgaggaacttataaccaacgttggtgctggtggggctggtgctccagttgccgtagctgcacctgttgctgctggtggtggtggtggtgcccctgctacaccttctgcttgaggaaaagaagacggaagaaccagaggaagaga

SEQ ID NO: 5553 - DNA, 244 bp, Gossypium hirsutum
  Clone ID: uC-gsronu33B057c10b1
tcgtttttttgttatctcttacttctcaattgtaattgggaattttgagtcactttcttcatcctttctctttttaagattttgcatcattgcttgtttttgaaaacttttattgtcaaatattcatattatatttagattaaattcacagttagattaagtattctttttaaaaatatcaaattttaaaataaaaaaaaaaatcaaaaaaaactaatcaaaattaaattaaatatcactaaac

SEQ ID NO: 5554 - DNA, 481 bp, Gossypium hirsutum
  Clone ID: uC-gsronu33B057c11b1
tctgtttatgcgtccgggaaagggaaactatgacagacggggttctagaacatggtatgtgtcatggttacttggtgttggtacaagattgtgtcgttgctcaaatcaggcggccaccgtgtcactccctaggatcttggtgccagtggaatcaaccccaagaccatcactgacttggcttccttgcccgattatgcggagccattaacggcattaatggcctctttgcctgaagacgagaaagtgatactagtgggacacagttacggtggtgttatcattttcttagccatggaaagcttccccatgaatgtattggccgctgttatttcacagttttatgccgaatcatgattcttctattgcgactggagtagctgagtacttcagaagggttatggcggaacccgttatggatctccagaaatctgtttgaagatggggtcggaaattccaccacctaatgccttatttggaccaa

SEQ ID NO: 5555 - DNA, 362 bp, Gossypium hirsutum
  Clone ID: uC-gsronu33B057d01b1
acttattttcacttccagggaaattcagaccgctggtaggcttgtactacctggtgagcttgtcaagcacgccgtttctgaaggtaccaaggccgtgaccaagtttacttcatcttgaaaaggctatttgttgatctgtagttggggttagggttaggaggcttgtttttaaattagatcggtgtggcttttatgttttatttttctgaaatctccgcatattcattttgatatatggtttgcattatcgagatggatctactcgatcctgatatggctattgtagaaattaatgctattaacgacaacttaatttcttggaaattccataactaccttttatactatttctttttttaatt

SEQ ID NO: 5556 - DNA, 548 bp, Gossypium hirsutum
  Clone ID: uC-gsronu33B057d02b1
ccttcgtttccgcccacgcgtccgctcactggagactgcggttcgtctacgatagaatgctctggtgctggtgctatccctcctgcaacccttgcggagattacattgaacggagcttcgggattggatttttatgacgttagccttgtggatggatacaatttaccaatgatggtgtctccacatggtggtaaaggaggtaattgtagttcagccggatgtgctgcggaattgaacggtaactgtcctttggaacttaaagttgttgataggagtgaaggagtggcttgtaatagtgcatgcaatgctttcggggacccgaaatattgttgcagtggcgcttattcgactccgaatacgtgtaagccgagcttgtcttggaaattttcaagggaggccggcctacttggtatagctatgcttatgatgatggaaccagtcccttacttgtgctggtgctgattatgtcattactttctgccctactacaccttccacagtctcaagacttctgacccatggcggcgatatctcagctagttcccggt

SEQ ID NO: 5557 - DNA, 401 bp, Gossypium hirsutum
  Clone ID: uC-gsronu33B057d07b1
gatttacgaaacatctgcttcattagtaacgaaagggatgaacaaaaaaggactgccgaaaaagcaatgcaatagcattctagaaagcattgaaatttgcaggcatagatgttggggaagcagcacgacaccttcagcagaaagacacgaacgcaaaagaaaccatctaaacataatctaacaacgccaaaccgaccataattctcaaggcctggggagatacctccacttactaccacatacacaacaggactgccccctatgccaagcattccctgagaacccacaaaaccaactgaaagaccaccctaaacctaactattaaacgccaatgccaattttccctaaaataccaaacaatggggagcagcctccaattacaaacacattgccaagaggac

SEQ ID NO: 5558 - DNA, 379 bp, Gossypium hirsutum
  Clone ID: uC-gsronu33B057d10b1
cgtatatgtttgtggagtagactccatggtctcaagggtggcgtctatgcatacaaagcctcagtagcattgccctgtaaatgactgatataagtaacggtaatattagtatccgtcagtatgtcttatctctggatttatgccatctgctagaacgggtttattccaatcctggtttatgcagccacctttaaaaggctgcatttagtagctttagaatttgaatctcagcatatgaacctcttttttcttgggcaatgattttcattgtaccaaagaaaaggggtgtatgctagagatgattattacttatttgtgttgtaaccaagtgttgtgatgtatatcagtctacctatatatgaatttggaacttggtatt

SEQ ID NO: 5559 - DNA, 448 bp, Gossypium hirsutum
  Clone ID: uC-gsronu33B057e04b1
ctttcgctttgggaaaaataagtcactgtgtttgtggggggttttttgacacaggtcagttcgtttatcacatagacttgaatgacttgctagagattttcgtcttattcggccatcctaaggctttcagttcttcgtttttttctgcctgtgccgtaagtactttttcacgatttaaatatcatttgcctaatattaatgctcaatattctttgtcgaaaaaaatagacttcggatcgcattgtttttatgatactgcatcacttttcccgattctttgaaccgtcggagaaaatgttttgttgcccttttaaacgaaaaatacatgcatcgtctgattgaaacaacattatacaatttcgagacggaagacctttggctgctcgttggtttaaagggagttcgaagaaagattaccttctgagttgtccggaggaatgaagaaact

SEQ ID NO: 5560 - DNA, 515 bp, Gossypium hirsutum
  Clone ID: uC-gsronu33B057e06b1
cccacgcgtccgaaaaatatagagttggcttgtggactgagatttgagggtatttttttcaacttttcaccgcttagtctttcttggcctccatacttttctttttgtttgatttttatttgtagttttgaatttttttctcaaaggattcatcctgatcctgattcaccaaataccagaaacatgagttttagtctaaagcaatccgctttagctgcatgcaatgatgtttcaaattcagttcttcagcgaagatcactttcttgcagatcttcaattttacctcctttggttttccaaaacaattcgaaaagaacaaatctttcactgtcaaagcctttgcatgtttccgctgttgagattattgggaaggataaagaacccgtgatcaagtgcagggcttatgaagctgataagttccagcctattgaggctgcagctgaggaagtgaaatcagaagctggaaaaaggggtgaaaattggatttattttgcaacttgggggctttaaatgtt

SEQ ID NO: 5561 - DNA, 359 bp, Gossypium hirsutum
  Clone ID: uC-gsronu33B057f02b1
ccctctcttttcgcccacgcgtacggaaaagtcaaaagtgagagttcatcttttgacaaaaaaattatgtttctctaatgaaattatctgcgaaggtgtctgaagcatctgcgagcagaaaccgcagtaccagggatgaagggtgggcagccttcaggaacatattggcagagatcaatgaggcatcaaggcttttcttattgccgaatcagcagcaaagtttctgaacctccagaacgtcttgttgggctttcagatgatgtaggggcgggatttatatctggacacaaccagtctacctcaacttctgaattgcatgtagatagaacagtttgaattgccaccacacgatgaaactg

SEQ ID NO: 5562 - DNA, 544 bp, Gossypium hirsutum
  Clone ID: uC-gsronu33B057f04b1
ggttgaaattagaaaaagaaaaatggttctctgataaaaatttccgtttgtttcctgagcaaatctcgggaaggaataccctttttttccccctgttgttaactcgttgtgattgtgaagctttctttaaaagaatcctagttaactcgacgcgtttacccagaaagaggtgaagatgtcaactcctgcaaggaagagattgatgagggattttaagaggttgcagcaagatccttctgcaggaattagtggtgcacctcaagataacaacattatgctttggaatgctgttatatttggacctgatgacaccccatgggatggaggtacgtttaagctgactcttcagtttacggaggattatccaaacaaaccaccaactgttcgttttgtatcccgaatgttccatccaaatatttatgctgatggtagcatctgtttggacattctacaaaatcagtgcagtccaatttatgatgtagctgcaatactggcatctattcagtcattgcttttgtgatccaaatcctaaattcccttgcaa

SEQ ID NO: 5563 - DNA, 537 bp, Gossypium hirsutum
  Clone ID: uC-gsronu33B057f05b1
tttttgcttttcgtttcctttcaagatctcgcagatgctcaccttaagtaaatttaatcccacatgaaatttagcagatcgaaagattttttcttttctaaaaatggcggaggagcatagatgccaaacgccggaaggccaccgtctttgcgttaacaactgcggctttttcggaagtccggcgacaatgaatctttgctctaaatgttatagagatttccgtcttaaggaacaacagggagctacttccatcaaatcatctttttcttcctctccttcgtcttcatcagtcgttgccgaatccgtttctcaggttccgctgttcactctgcctgaattcattggagaatcgtcagtttctttcgtggaggttgccctggtggctgagcaacgggccgaacaagcaacaaccgatttgatgcatggtttgcaggaaaacggtcgggttgacccgggtcagatgcaaatgcgagattacattttgcgggcccataggtatccagagaaatacgggtgtacgttcgatttcagaaggtt

SEQ ID NO: 5564 - DNA, 541 bp, Gossypium hirsutum
  Clone ID: uC-gsronu33B057g01b1
ccttttattaggagaaaaaggtagtcctttagttgaaggtttctactttagcctcaactgagagtcgaagattttccggctgaaaatggaaacaaataatgaaaccagcaacccatctcagattaagagctttcttgagaagtcgatcaacattgttgatttgaacaaaaaaaggaaattagagcctgaacaattgggcttgcctttatcaaagcatcaatgttggaagcaaagctcatctttgaagccttctacgtttggcagtatcacacaagtagaggggttcagtccatgcactttccaaggaaagacaatgggctgtttttgatgtacttgaaactggatcggcaaaagatagtaatagctttgccgatgattcggatactgcaatatctgtgcatgccgatgctaagtatttactatatgacagagcttcctcctcatcatcacctaattggggatccagctcccaacattgccattctgatggacaactgtagcataagcagtgccgaaaagtagtatcttctcctgggatgag

SEQ ID NO: 5565 - DNA, 434 bp, Gossypium hirsutum
  Clone ID: uC-gsronu33B057g04b1
aattcctacacctttcattagcaaaagtgatcagggcgggctttaaatcaaacggcggataactaagcttgtccgtaatggaacaaatgccattgatgaaatccgtggtgtatgaatcgtttcgtatcgacccgccagttcaggttcaatacggaaaggcgaagaaagatcttttgattgaaagtcaccatgccgtatacgaagtgaaagaaggggagatgttattcggataccaaccgtttgcgacgaaggatccgaacatatttgacagagcccaggagttttgacccgaccggttaatgggtgtcgactaggagaagttgtttgagtatgtgctttggtctaatggacccggagactgagcatcctaccgtggcggattaaccaatgtgcccggaaagaattcgcgatgatggtgtctaagctttttgtgg

SEQ ID NO: 5566 - DNA, 449 bp, Gossypium hirsutum
  Clone ID: uC-gsronu33B057g05b1
gtttaagtttcacaatcggatcgagaatggagagggcaagttacaaaacattgcccaatttcttagttatatacatgggcaagcccttggtaaagcctctaccagtatgatttctacctaatgcatttcaaaaaaaaaaaactaatcataatacttggaaaatttaacatacaactatcttaaagtgaccaaaaatagaactttggcatttacttatcatctccttaggcatcctcaaccttgtatgtagatctactcattggagaactaaaggtaatctacaaatataaatagaaagttaaaaaatgaaaaatatacacaaaaaaacatataaaaataagtaatgtttaattaaaagaataaacacacaaatgggaaacaaaaaaatcaataatatatgggatgggcggtcgaatgaaaggaaacaagctaacgaacgcatgcaagca

SEQ ID NO: 5567 - DNA, 231 bp, Gossypium hirsutum
  Clone ID: uC-gsronu33B057g11b1
tttccacgcgtccgctaaaacactatccactggagaggttttgtttgagcggtcaatccaatcgcttggataatcagaagagaaaaatgggcgtattcacaaaaagaagcagcgggtagtaccccactgccaccagccaaggcttttcaaggcctttgctggagatattcgagaacctatatgcccaaagctgccccacatacagtcaagagcatcgaggccattgaagga

SEQ ID NO: 5568 - DNA, 201 bp, Gossypium hirsutum
  Clone ID: uC-gsronu33B057h02b1
gttttcactataaggccatgaaggtgggcgatctgggagggttttactacaagggcgccaccgatcgccgagacgtgggggtgggcagcgtggttaaggaatggaacgcagcggagggcggagataaaaacagcgaggaggtggtggatgtgaaggcggtgggggagatgaggaggcgagtggaattaaacgacatgtaac

SEQ ID NO: 5569 - DNA, 490 bp, Gossypium hirsutum
  Clone ID: uC-gsronu33B057h04b1
ggcccgacccacgcgtgcggatgtttttcagaccaatgccaacagcaccgaaagggggggtttatatgaaaacatcggcgtttaatcctccaatatcgaatactcatgtcagaacgagaacgagatcactggtgctcacagttgctccgactgcaacgggagcagtaattatgacacatatacagatggtaacacactgattaatgccgaccctttttcatcgaatcatgaagtaaaagaaggtgaaactggtttgggaactttgccaggtgccacaagtgagggaaataaaagttgagaatgcaactgctgaatgaaattgataatggtttgagatttcagtatattgaactaattactgggactaaattttggctttttttccttcctgaggtgggatgaagaacactgtatgttcctggctacttgggctttgatgacatactagtgcctgaaaaattccatattagttaggactcgaagattttta

SEQ ID NO: 5570 - DNA, 235 bp, Gossypium hirsutum
  Clone ID: uC-gsronu33B057h05b1
actttgtttccgtgaagggcaagtttaggttcttgggtgggttaaagacaatatatctggctggttccaaatattagttttaggattatgtgaaaaggtgtattgactactccacgtcaagacgaaatgtacaccaaattggacggataaatgcccttgtataaaatgctatccgatactaataatgaaatattccctattctgactgatgtggaagaataggcatttccttgca

SEQ ID NO: 5571 - DNA, 440 bp, Gossypium hirsutum
  Clone ID: uC-gsronu33B057h06b1
atttcatcaccgataaagtcatggcactgatcaacgttgcactattgtgcacaaatcccacttcttcaactaggcctgtaatgactccgggagagagcatgcttgcaggcatggctgatgttcaggaatacctcacagagtcaagcatttcttcaaatcgtcaaatgcgcgcagagattatgaaacagttgtctcggaaacttgaagaagatgatacacatgctagccaaacaaggagtattgaagctgatgggccatggaccaatacttctacatatggtgctgatctgtatccagcaggttcgacttctggatattggcagaatagagagtccacaaactagaaaaaaatgtggatagtgctcgcctggtttctccccagagaattcgtattcctttgaaaccaccgcttaattagctcattcgattcaggcaaaaac

SEQ ID NO: 5572 - DNA, 87 bp, Gossypium hirsutum
  Clone ID: uC-gsronu33B057h08b1
tcttttttatgagagctaaggttacatatcttggggggcattaattaaaaatgccgtctcgttacaaaaaacaaaaattatacaagg

SEQ ID NO: 5573 - DNA, 415 bp, Gossypium hirsutum
  Clone ID: uC-gsronu33B057h10b1
cccacgcgtccgggttaagctacagctcaccaagggctgtatgcgcactgggcctcttgatgcctaccatttccttcttgctttccatcattctcaggacagcaaggctggattggagaagcacaagcagccaagccaaaatgattggaacttttatatcaatcgcaggtgcaatttttgcagaactatacaaaggcccgtttacacgaccatcacctgtttcacttgaccaccaccttcaagttataccaaaactttttggattctactcgacgccagatcgttgagctcttggaggtattatgcttgcggctgctaccttgtcgatttcagcatggaatattgttcaggtacaaggtttcggtccacaaatagactaagctcactttttggtttttgtgccttgaaaccttgt

SEQ ID NO: 5574 - DNA, 298 bp, Gossypium hirsutum
  Clone ID: uC-gsronu33B060a05b1
acacgtgttgcggtcgcatgcccaaatgcactcaacatgatgtggctatggggaaattcagctttcccatttagcagagaaaaagaagacagtttttggacagctgaagcttggacccttgagcttctcgttgatcgcctcgagccaaacttatctacttgggcgagccaacagaaagtggcatggttctatggcggtgtacaaatggaatggatcgtaagtttcgctacccgaacaaatggtgttgcgatggctctcgacattggcatagaaatggtttatgctggcaaaaacaatg

SEQ ID NO: 5575 - DNA, 489 bp, Gossypium hirsutum
  Clone ID: uC-gsronu33B060b02b1
cgcttttatcatcctgatattacgtgcatcataccccctcttgagttgggaatgctattatcttctaaaaggctgtcgcttgctatcaaccggcgactcaagggcaagtgataacttgcagggccgcacgggcttatgagccgcacaagccactgcacattgaggacgtacaggcggctgctgcacaggccggggaggactgtggcaagatcctctgccctgctctctggcacactgatgcctacagctagccgcgagaaggatccaccacggtcctatgcccggcgcatattctggacatagaagcctgatgcaagtcgacgaaagtgtagtgacaagtggataacagaagccgcacctctatgagccatggtaatccgttgtgaccacagcactagagcccccgaacgcaggatccagcgaagcagcgagagactaacctatgcggcaaagttaggacagctcctggagctggagtcaagatgaatg

SEQ ID NO: 5576 - DNA, 526 bp, Gossypium hirsutum
  Clone ID: uC-gsronu33B060b03b1
ctctatctttaacggacgccctttttttttttcttttggaacccgattcgaccagcccatctacaaggcaatgccgagatgagttcgtgaagcatgtgaaacgtccatttacaacatttggagtttttgatacttgctttgatgctacagtatttgctgaggcacctttaataacatttcattttgaaggcttgacgatgacattgcctatggataacagtttcttgcacaccagtgccggttctcgtgcatgcttggccatagcacccggtccccaacaatgtgaacgccgccctgaatgtgatagccaatttgcagcagcagaatcatagtgatttttttgatgtgatcaattctcgcttgggaatcgcttgtgaagcttgcaattagttacttattggctatatcttggtttggttggtccttgtctgctttcttgtctttatgcctaagctctatttttaggtgttttatttgatgaaaaataggtttaggttattaacattctaaaaataaatcaccattt

SEQ ID NO: 5577 - DNA, 438 bp, Gossypium hirsutum
  Clone ID: uC-gsronu33B060b05b1
gcgatttttgggtgttatctacacgcgatcaacgatgatgacgaaacccatttaccaaaaccagatatcatgttgtgaataacggtctgatataaccatttacagattagccataggatgtattcatcttctgtaagggatctgtacgttgctttgctttcgctgcgaaatggagggcttctagtatgacaaggtgctcgtggcgacccgtgaacctggtgctgatgctcttgttaccattaatggagcacagtctttgaactactggacccggcccatgagggtggacttggccaaggtctcaaggctcttgcgaaggacagcttggtgcggctgatcatgttgtgtgcagctggacaggctttctgttgaggcgtggatttgacggttgtacaagatgttgtgcaggttcgacgttaaggacccggagaccgatcc

SEQ ID NO: 5578 - DNA, 377 bp, Gossypium hirsutum
  Clone ID: uC-gsronu33B060b06b1
gcttttcattccttcaatccatcgaatgattaatagctgaaccagaatacttcaagatgcataactatagtacccagcactaacgaggccgttagggtgtgccacacagagggaaaacgccccgatgcaaataattaggacagattcttcaggaatgtaatgtagaatcaaccaactgctgtctgacgctgagtgcaggtaagacacgactacatgctatactacacatgcagaaaggctctattaaaagaagtgttccatgtgacgtgatagctatattttcatttaaaataaattaaaaaacacctatttaataagctatattttatgatgttaatgcataaagataggaccttgtgtacctacccttttgggtt

SEQ ID NO: 5579 - DNA, 564 bp, Gossypium hirsutum
  Clone ID: uC-gsronu33B060b08b1
ctccatgcgttcgacagaatcaactagctttaacctaaaacaaactatacataagactaacaggcaaaaaagccaactccttttgtcttttattccttccattcccatgtccattacctcaacataagctactctactcatcatttatacacaatcagtccttttatagcttacccaattttctttcaacctccaaatccagcctcccagatgtctgccggaatctttgcatcaccaatcgccggctctggatttgatggcctgaaaaccaatgtttcaaagctggttccaactaatgattctatttcatggagccggagaactgtgtccaatggttcaagaacccactgcatgaagacatggaattcaatcaacaacaagaagtttgagacgcttttttaccttccacctgtctcagatgactcgattgcaaaggaaattgattacatgatgaaaaaagggtggattccttgctttgaatttgatgaggtggaggctgtccacaggagaacagcagcattccaaggtactatgatggagggattgaccttatggaagctgccg

SEQ ID NO: 5580 - DNA, 258 bp, Gossypium hirsutum
  Clone ID: uC-gsronu33B060b09b1
tccatctccgaacggggcgttgagagactatggaggaccttcaaccgattggcatgtggtacaattgggccatcgctctacagggagcaagcttacacacgcaggcatgcgacttctgaacgttaatattgggaagcatagatgaagaaactgctgcagaagaacacaacaaaataggctgcatatgccgagaagacacgcaacttaaaggtatggcacagatccacgtatgagcgagcacattaccaattgataaag

SEQ ID NO: 5581 - DNA, 324 bp, Gossypium hirsutum
  Clone ID: uC-gsronu33B060b10b1
tcattggattatgagcaacaaaagcactgcacagaaagatcatatggatatactctaggggaacttggcacataaatgggaagttcgagcacataactaaagaactcattgtaaaaaccttaacatgctgatgacctactgctgtgaagtgctgatgcccgaacagactagtcatagactatgtctgaggctaacaagaccaaggaagacttggacagatgacagccacatctgtcatgtgccatgtataagagactgagtgtagcaccattcacggcctccatctcccagagtgacgactgcgagataaactgtactatcacc

SEQ ID NO: 5582 - DNA, 190 bp, Gossypium hirsutum
  Clone ID: uC-gsronu33B060b12b1
accgtctagcagcgtgttccctccgcaggggcactcaggataggtggagcccttaacgagcccgatggggtaaagccaatgattggaggcctcggagacgcaacgcccctcgacgtatataaatactgacaaataggtagtaccgcgcggaggcttctttgatccacggccacgagaccacagctgcaag

SEQ ID NO: 5583 - DNA, 437 bp, Gossypium hirsutum
  Clone ID: uC-gsronu33B060c03b1
cgttttctttcgcaagtgggctcagaagaccgtaactctgcctcctcttcggaggggctgccatcttgctacgtctcagatattgaaggaaattacgccagatttatcagaagttaattgtggccttgctcatctattcctgcaacacacgagttgcttctcttactatcaatgaaaattatgactcggacgttcgtgacgacaccgagacgttcctcaacaaaataattcctgagggaagatctgcgccttgcaagcatacgctagaaggccctgatgacatgccagcccatagcaaatcatcaatgtctggctgtgccctcacgattcccattacagatggacttcttaacatgggaacttggcaggggatttggctttgagagcatcggggagcaccaacagcttcgaaggtggtggtgacccttaatggcatc

SEQ ID NO: 5584 - DNA, 109 bp, Gossypium hirsutum
  Clone ID: uC-gsronu33B060c05b1
gccgcccgccggaccgacccggaactactgtgccgatcgaaccacgcgtcctatttactatgcgcgctctgaaagacccagacagataatggtgagagctggctccact

SEQ ID NO: 5585 - DNA, 250 bp, Gossypium hirsutum
  Clone ID: uC-gsronu33B060d04b1
gatcatagagattctatagagtgaaccaaattgatgtaagaggcccttattatacaacgaaccgactggtgaaacattgtctaaatcctaaccaaatcaccttgggtgacaggcctctctatgcagcaggtctaatagcacaagggccccacccgatagtgctttctaccagaggctcattctgaatggcaaatgggacgatccctgttgcggagcattaaacgcggaaagtgtgcaggttacgcaccaa

SEQ ID NO: 5586 - DNA, 454 bp, Gossypium hirsutum
  Clone ID: uC-gsronu33B060d07b1
agatcatgagggtcagaaaccgatcttcagtgtgaaaagatcgtccataatcggacggtgcgggatgacagtggaagtgttcaacaatccagggctggagtaccagatagaaggggaatttcggacaacggagctgcacgatcttcaacgcggccaaggaatcagtggctgagattaaacgcaaagttgatgcttccactaacgtggtgcttggtaaagacgttttcttgctttctttaaaacccggttttgatggggcctttgctatgggtttggagctcgttcttgatcaggttaacggtggtgattacgttgaaaatgatgaggcggagatgatccctaccacagaggattaatgtgctgtgcattttattaatttcttaaacgaagagatgtggtaaaagaaagctgtttgtatatttattcaaaatgtattattagtttccttttgaag

SEQ ID NO: 5587 - DNA, 424 bp, Gossypium hirsutum
  Clone ID: uC-gsronu33B060d09b1
tttttatacaaagagtgtgtgggttaaaaaaaaaaaaagaaatgatgaaaaagaaaacgcttatcctacataaagatgtatgaaaaaaacaaatcacaattatacatcgctcatatctactgcttttccgtttttttcccactttttctttgttgctttacaacttctatttggggccggcggttttagcgggcccagttttctcttccccgtcttgtccaccttgtgttttttttttgggcccccctgattccatttcctgggccgctgttttccagtgttggcttgggaaaacccgggcgtgtccccatttttttggtctgtcattcattccctttttttccgggggggttattggtttgggggcccccccttttggctttttccaatggtgccccttcctttatgggggtgggcccccccc

SEQ ID NO: 5588 - DNA, 326 bp, Gossypium hirsutum
  Clone ID: uC-gsronu33B060d11b1
tcttcttgtgggccgatcattttacgttaagttcaaggaaatggctaatcctgtgatcactcttgtgcacagaatccgtcagcgttgcgatgagacccttattgcccactggtacgcgattttggtcttgctctaacggatcgagggcacaggaaacggacatctgcagcaccatcaacttattctagagtatgcagctatgcctgaagagaacagaaagaagctcgctgatggtgcattatccgaggtattgaaagctagtcaggaagcgatcgagttgcctccatggcctgcacttgctggacgtgcacgcctggagcttggga

SEQ ID NO: 5589 - DNA, 441 bp, Gossypium hirsutum
  Clone ID: uC-gsronu33B060e02b1
ccctcgcttccgtgcaaccaatgtaaatgatgaagagaggatttgatcctaaaatccaggaaaacaaggaaggactagaattgttgaatacagccattgcttaagctggtttccctgccaaaggtgatatcgtaatggaggttgccgccctcgagtgggctggcgcatatgggacccacgacctgtactttggggggagaacaatgacgtgttacaggggatcccaggagatgccctgagggatggtttcttgacacgtctggccgggtatacacttgggttaaaccaagatccttttgaccaagatgcttgctagtactacggctggcttacacaaggaaatgggcgaccccgttccgtttgcctgaaaggatcctctggtgaccggcccagagagggcttcctaaggctcttgcctaaaaaccttgggttggccttttt

SEQ ID NO: 5590 - DNA, 306 bp, Gossypium hirsutum
  Clone ID: uC-gsronu33B060e03b1
ccgttatttacgttatataccaatgagaacaccatcaccgtggatacacaacatgcattgtatacataaaccacaataaaagtacgggtgaacagtgccgtcctggttagcacacttcattcagcacgagagtcgcataagaatcgatctctaccaggtctggagaggtggataccaacgtcatagatttgagccccaagggcggacttgctttgtcccttaagccttgagagcctagataaaagagaaagaagttgctaattttggaaagggtttgattagacttttaaagagttttgaattttc

SEQ ID NO: 5591 - DNA, 66 bp, Gossypium hirsutum
  Clone ID: uC-gsronu33B060e06b1
cgcggcctttgtttatgaaaaggggaagggagctgtcgtggacgggtaatcagagcattagacgct

SEQ ID NO: 5592 - DNA, 447 bp, Gossypium hirsutum
  Clone ID: uC-gsronu33B060e09b1
ttacaatggagatcaacccggagaaccccatcatggaagagctgagaaagagagccgatgcagagaagaatgataaatctgtgaaggaccttgttctccttctcttcgagactgctctcctcacctctggcttcagccttgatgagcctaacacctttggcaacagaatccacaggatgctgaaactcggcttgagcattgatgaggatgcaggtgaaggtgaaggtgatgctgatatgcccccattggaggatgctgatgccgaaggcagcaagatggaggaagttgattaagcctaacatgtttttataagatcagtagatttatcttacttttgaagcatctgttagcttgttttacattttgtttggtgcttttgcttttgttatggtgtcgatagttattgtcgagtactcttaaatgataagtgctgcttttttctgggct

SEQ ID NO: 5593 - DNA, 269 bp, Gossypium hirsutum
  Clone ID: uC-gsronu33B060e11b1
tttttatttacaagggcagtgagctaacaatgagcaggcatacactatggactgaccactgtacaggttgcagaacctagagcagtgacactaatcatgtcaccaggaacaaggaggatgtacagagccctcacaggataacaaatgatcatgctgaggcagaaatacttcaaaaggaagggtagtatgttactgccacatcactggagtagcagtgataggctagccgtgcatattgaaatgtgtacctcaacagagctgccggaggc

SEQ ID NO: 5594 - DNA, 278 bp, Gossypium hirsutum
  Clone ID: uC-gsronu33B060f01b1
gctgtatttaacgccaccaggtcaggactgactctagagtgagtaacactggttgagaaaacatgaggtagaaaggaagaggctggcaccagagagtacaccattaacctggacaggcgccttcatggctgcacattcaagaagaaagctcccaaggctatcaaggagatcaggaagtttgcagaaaaagccatggggacaaaggatgtgagagtagatgtcaagctgaacaagcacatctggagcagtggccaacgactagtgcctggaaggattag

SEQ ID NO: 5595 - DNA, 93 bp, Gossypium hirsutum
  Clone ID: uC-gsronu33B060f02b1
atgaattccatagcctagtgaaactcatctgttattaccataaacctgtgtccatggacagaggaatcccaaactatgacgacgggggcagct

SEQ ID NO: 5596 - DNA, 340 bp, Gossypium hirsutum
  Clone ID: uC-gsronu33B060f03b1
tagttatttttaaatacactagagatagatatatgctcttaagtaccataagaagactgaaacagaatccattggacagaggagttaattgaagctgtttaataacattgtgtcggcttttcttggggaatattatttcgttgtgtaatttaattggcgaagctccttattattttatcctggcttgtcctttttcttttttaggcggcattgtttgaacatggggttgtgcgcccgacaattctagtcaaatatggagactttttgtttttcaagttactatctttggtaatgttacttttttaaacgcttatatgctcatttgcgaggctttctgatg

SEQ ID NO: 5597 - DNA, 457 bp, Gossypium hirsutum
  Clone ID: uC-gsronu33B060f06b1
agttcttttttattggtagaggtctatccgggcagccatcatctactataccacttgtttctggaagtgtggcttctgataacggagcccttggtgctgtccctactgcctctgacatggcaaaaagaaatattttgggagttgatgagagacttgggaatagtagcatgaagcaatctttgacatcacctattagtaacagaatgatcttgcctcacgcagccaaagcaaatgatggaagtgcacctgttgattctagtaatcctaatgagtctagtggactacctggcagagcattttctccttcaatggtttctgggatgcaatggaagcctggaagttcgttttaaaatcaaaatgagctggtgcagttttcgggaagaaccgagatagctcctgatttagggaaaagtttttgaaaccggttcagtaagtgcagcaacaaggccataatcac

SEQ ID NO: 5598 - DNA, 301 bp, Gossypium hirsutum
  Clone ID: uC-gsronu33B060f07b1
taaaataaaacagtagcataggcatgctaagggggggttttatatttgacttccgcgcatttcttataaaaaaaagagatgcgaaacgcgtagttgagagtttcaaggaagcgagccccaactgcggagctcacgtagacagaaaggcaccaaggttacaaaggtgaaacaacaagagcgtggtgatgagaacagggacagaacctagcagagggtgggtaaacccaaaactgtcacatatgaaaccaagactgacgtccatgcccctaaagggtggaagaggctagtggcctggcggagg

SEQ ID NO: 5599 - DNA, 429 bp, Gossypium hirsutum
  Clone ID: uC-gsronu33B060f09b1
gttacttatccaagggagagtgtgatctggtcttctttacttcattccactaacccatggctgtatccgtgaagaaaaccgccgccggccgtgagtgcaaggtcaagaaacattcatcaagcagacctaggacggctagaaatcgactcggtcgagctcgtaatgcccggcctcatggcttgccgagccgaggtcggccctgtccaacctcttatgggagccaaaatcaccgggtcttattacatgaccaatccagaccgatgatctcatcgaaacccttaccgcccttggagctgcagcccgccggagctactgctatatcttatctacccaagaccatgccgccgcccccttttgcccgggactcgtaagccctgctcacctggagaggtgagaccctccaggaatactggtggacgaccgaggagt

SEQ ID NO: 5600 - DNA, 368 bp, Gossypium hirsutum
  Clone ID: uC-gsronu33B060f11b1
tcctcgcgtccgtgaagaggagggtggttgggaccttgaagatttggaacttccccctgaggcagacaccccaaaggtttttggcaatgcccgttctatttttgtggcaccaactcccggtatgcctttaagtcagatgtgggtacagaaatcttctgttgctgctgaacatgctgcagctggcaattttgatacagcaatgcgtttgctgagcagacaactgggcataagaaactttcctcctttgaaatccttgttccttgatcttcacactggcagccatagctatctttgtgcattttcatccgttccagttgtgtcgttggccgttgaaagggtattgcattttgacttgctatgctttattt

SEQ ID NO: 5601 - DNA, 169 bp, Gossypium hirsutum
  Clone ID: uC-gsronu33B060g05b1
ccgcgcgacctttttatggtgttgcaggaagcataatggatgaccaattgatctatgtaatagcatatatatatatatatataaatgtgactatggtattggttacattagaaaataaggtgtgtgtttcaattttgtgctgggatgatgcacagggtgctgaacctat

SEQ ID NO: 5602 - DNA, 352 bp, Gossypium hirsutum
  Clone ID: uC-gsronu33B060g06b1
cccttgcttacgcacgcgagaacgctacccatacagatagcatttgttgccatgagcactccttgccgacgcgacgaaaaggtctacactggtcaagcttgtcgagcaagtcgagcgctaggaggagatggtcaagataatgaggaacgtcagatgggtcggacccgttgacgacgaactctaggtctgggaacgcaacctaatctatggcgcctacacgaacgacatcggagcccgccgtgcttccgggaggattcgaatgctgcatcgagcacaaggaggaaggccctgactgcgccgaccacgttttcgtgattcgtgactacagggccaagaacgaggccgaggttgt

SEQ ID NO: 5603 - DNA, 544 bp, Gossypium hirsutum
  Clone ID: uC-gsronu33B060h04b1
ccctcttcttgcgatggctaggatgtttcgggctctcattgttactagctctaaccctgcaactagccattacgagtgcacaaacaccagctgcctcagctaccagtacgccaaccaccaccaccaacactcaacctgcaacgtggacaccacctacaacttgcgcaccacgtacttgaacaacccctacacctacaacttcagcaccacctacatcaacagcgacgcctccagcttgcaccacgcccatcgcgccagctgaaccacctgcaacaactccccctaccactgatggaccagctacaagcccaaccgttccaccgtcacaaactccaccacctcaaccacctcaaactgctccaaccacagatccagctgaaccgccagcattgccaccaccatgaccaccaccagtatctcctgcaccagcgccagctcagaaaccaccagctcctgcaccaggaaagctgcccccagcacctgcacccattactttgccaccggctcctgcaccagctgccacaagcacatgagaagcacagca

SEQ ID NO: 5604 - DNA, 539 bp, Gossypium hirsutum
  Clone ID: uC-gsronu33B060h05b1
ccacgcgtcctttcttcgtccacactcgcgtaccaccacgcggacgctcttattctaaattctgtgctgagcattatcaaaatcagacctagtgtacgcgaggggtcacatttatcagttatcaaactctcttacacgcaagaagctaatcatgagatggatgatggtggctgactatgagtgtaaccaatcccttgatgacgtatttctatacagatcaatcttgtgcaggagagttgctgacatcgatgaattaagctctgtgggtggagaagaagactcattttggctacttaaaatgggtgttccctacttgaatgagttcctaataaaactcatggcacttttttgttggggaaaccctgcaacaaccattgaaggctggcagtactacttgtttgttttggccacgtgtggccgcctctataacccatttgaaaactgacttaattggggttttcttggcgtcttcattgtcccaaaagtctgttctgtttattccccatgtaactgttccggaaaatttgaattcacgtttc

SEQ ID NO: 5605 - DNA, 346 bp, Gossypium hirsutum
  Clone ID: uC-gsronu33B060h06b1
accttgctttacgaacgaccgtgcttgcgcccatgcgggggctttaattacaaaacagcctgcttttcatcaacggaggaacactccctacagacggggattcagtttcaatgaacataacagagctagtggaagcaggcaagcatggcacggaagatgctggatgatggaaacttaaaccacacgaattacgaggcagctgaatatgagtatcacttgtttgtcatccatgctggtagcggaggcgttcgcgctgccaggttctccgctaaccatggagcaccggtcgggatgtgtgagctcccattttatccaaacagctcagaagtcagtggacgtgttggtg

SEQ ID NO: 5606 - DNA, 136 bp, Gossypium hirsutum
  Clone ID: uC-gsronu33B072a11b1
ctgacttctcccccaaaaaagtttcttttctctgtatctttggagctctatacccattcttccacatttacactctcaaagctcctttgtctatgctcctcatatcccaattcctccatattctatttcataaacc

SEQ ID NO: 5607 - DNA, 358 bp, Gossypium hirsutum
  Clone ID: uC-gsronu33B072b01b1
tccacgtgtccggagagaataacagagggaaagcttaagcaatggcggccgaggaggacagcggagagttttacctccgctactacgtgggccacaaagggaaattcgggcacgagtttttggagttcgagttcaggccagatgggaagctccgatacgctaacaactccaactacaaaaacgacaccatgatccgttaagaggttttcctcacttcctttcctcttaaggaatgccgtcttattatcttcttcagttttattattatttctttttttttcaattttttttatcttattctttatcttttttttctttttttcttcatttttcttctttttcttttattttttttttt

SEQ ID NO: 5608 - DNA, 105 bp, Gossypium hirsutum
  Clone ID: uC-gsronu33B072b07b1
tcgttcagccttactccggatccccggccaacttggttgctttcacggccgtcctccagcctcatgataggaccatgggactcgatttgcctttaggcggacatt

SEQ ID NO: 5609 - DNA, 114 bp, Gossypium hirsutum
  Clone ID: uC-gsronu33B072b08b1
atcacgcgtccgcccacgcgtccggaaccctgggtgccgctcttcattcttcttctctctaaggaaagctaaatacgggatcccaatttcagctcaaaaatgtcggtagaggtc

SEQ ID NO: 5610 - DNA, 90 bp, Gossypium hirsutum
  Clone ID: uC-gsronu33B072b09b1
gttacttcatttgttaagttctccttgtgctcagagataaatcgattcttgtttttccgaaccccgcaattctgagaaacgctcttgtat

SEQ ID NO: 5611 - DNA, 151 bp, Gossypium hirsutum
  Clone ID: uC-gsronu33B072c02b1
tcgctcacgcgtccggctttactctgccgtatctctccttctaaaaccctacttatcttctcctcgcaaaaccctagccccttccttttttctttcgtagtaatcatccatggagttctggggtattgaagatcactcctctcatcccttc

SEQ ID NO: 5612 - DNA, 198 bp, Gossypium hirsutum
  Clone ID: uC-gsronu33B072c06b1
gtacgtgtccgtccacgcgtacgttcagaaagaaatgtgaagtcgtctcccctttcggtaaaggatcaggaagagaaggcaaaaagatgcgagtttgttcaagggctgctgttgtccacaatgcctgatgaaattttataaaacagcgttctcgggttcaaatcggttgctgcaatggaatcgtgaacctgtatccca

SEQ ID NO: 5613 - DNA, 257 bp, Gossypium hirsutum
  Clone ID: uC-gsronu33B072c10b1
atacatttaaagattttccagcatcatcgctggctttcattgacactcttcttgcaattgatccagcggaacgtctgactgccacttctgcactgcgaagtgaattctttatgacagaaccttatgcttgtgaaccttccagcctccccaaatacccacccagcaaagagatggatgcaaaacgacgagacgatgaagctcgaaggctcagagctgctaaataaagctcagggtgctggtgcaagaaagatcatgga

SEQ ID NO: 5614 - DNA, 145 bp, Gossypium hirsutum
  Clone ID: uC-gsronu33B072d09b1
atggaaaagagcctagctgaggcatttcaacctttgggcatttcggattggaactcgctcttttggatcgctcaccccggtggtccagccatattggatcaggttgaggttaatctcgtctcttaaccccaaaaactcctagcca

SEQ ID NO: 5615 - DNA, 185 bp, Gossypium hirsutum
  Clone ID: uC-gsronu33B072d12b1
tcgctatgacccaaatacaatcaaggaccgagaaacacacagtgattgccccccgtaccaatatctgaaccatgttcgaacttatccgacattcatgttcggcggatctctgggagcacatgttgctactgtcgcattcgtacggaactaaaggtaactgaaggctaggtctttgggattggtgg

SEQ ID NO: 5616 - DNA, 371 bp, Gossypium hirsutum
  Clone ID: uC-gsronu33B072e04b1
cggtaccggaactgaagtttcgagccaacccacctttccgtgatctcgtcgattttaccaactatgggaaagattggataaaactgaccttatatgggtaaaacacctactggcaaggagctagctcgcgagttacttatcgcaatatctagttctgtacccgatactgaactgaatgcagaacatgcatctaaaaatatagaagctacaaatggtgctgcagtaacaaagtctgatggagctgaaaaatataggtctgaactgatctctatatcctatgcccagactcctgatgatcaagtgcccctggttgtgctcaggaaccatgtggggtaagtgaggactaaactgacatggtatatttaataaaa

SEQ ID NO: 5617 - DNA, 52 bp, Gossypium hirsutum
  Clone ID: uC-gsronu33B072e07b1
ggaccggaccggaatgcccgggccgagcgacccacgctttcgtcacgcgccc

SEQ ID NO: 5618 - DNA, 201 bp, Gossypium hirsutum
  Clone ID: uC-gsronu33B072e08b1
tgccggtaccggaacggacactgtgccggcccacgcatgcgttcattctcccaccccgaccgattgattttgatcagacggtaatcatgccgatcagaaacatagccgctggccggcctgaagaagctactcatccagatgctcttaaagcagctttagctgagctcatattaacgttaatccttcgctttcgctcgtttc

SEQ ID NO: 5619 - DNA, 118 bp, Gossypium hirsutum
  Clone ID: uC-gsronu33B072e09b1
tgttgcgagatacagaatttactcggcagaagaattgttgagtcgcctcttttaccgaggatgaaagccgataggatagtcaacatatagcactagtacatatttaaatactatcata

SEQ ID NO: 5620 - DNA, 110 bp, Gossypium hirsutum
  Clone ID: uC-gsronu33B072e11b1
tatcttcggccggcaagaagacgaagaagacccattaaagcatcaacaacaggttggctctcgccacgaagagtggaaaatacactcttgttcttacaaacctgcatttc

SEQ ID NO: 5621 - DNA, 114 bp, Gossypium hirsutum
  Clone ID: uC-gsronu33B072f01b1
ctcactcgtccgatctaatatgaaagggatcaaattattaggggatctaggattcactaatgacattataacaataatagagggatcaaattattgctaatttaatgcataaaa

SEQ ID NO: 5622 - DNA, 500 bp, Gossypium hirsutum
  Clone ID: uC-gsronu33B072f02b1
ggaccggccggaaaacgggcgacccagccaacatatttccaccacaaaaaaaaaaaaaggggaaattaaataaaaaaccccaaaaccccacaaccaaaaaaaaaaaaacaaaaaaaaaaaataaaaaaaaaaaaaacaacaacaaaaaaacaaacaaaaaaaaaagaaaaaaaacaaaaaaacaaaaaaaacaaaaaacaacaaaaaaaaaataaaaaaaaaaaaaaaaaaaaaaaaaaaaaaaaaaaaaaaaacacaaaacaaaaaaaaaagaaaaaaaaaaaagcaaaaaaaacaaaaacaaaaaaaaaccaagaacaaaaacaaaaaaataaaaagaaaccaacaaacaaaaacaaaacaacaaaaataacaaacaaaaagaaaaaaaaaaaaacaaaaaaacaaaaaaaaaaacacaaaaaaaaaacaaacaaaaataaaaaaaaaacaaaaaacaaacaaaaacaaaaaaaaaaacaaatacaaaaagacaaaaa

SEQ ID NO: 5623 - DNA, 128 bp, Gossypium hirsutum
  Clone ID: uC-gsronu33B072f06b1
cggaccggaactgccggcccgacccacgccaccggtcacttgattcggcacgcgttcagaaaagcagaataggtctgacccagagcatacaagggaccgaaacacggcggctcaggggtgaccaaaag

SEQ ID NO: 5624 - DNA, 366 bp, Gossypium hirsutum
  Clone ID: uC-gsronu33B072f12b1
ttcacgcgtccgattttaccaactctggaaaacaaggaaaaaactgacattatatgggtaaaacacctactggcaaggagctagctcgcgagttacttatcgcaatatctagttctgtacctgatactgatctgaatgcagaacatgcatctaaaaatatagaagctacaaatggtgctgcagtaacaaagtctgatggagctgaaaaatataggtctgaactgatctctatatcctatgcccagtctcctgatgatcaagtgcccctggttgcgcttaggaaccatgtgggttagtgaggactaaattgacatgggaaatttaataaaatacagtgtgtagtgaatgctcttgtgaaactctttg

SEQ ID NO: 5625 - DNA, 301 bp, Gossypium hirsutum
  Clone ID: uC-gsronu33B072g10b1
gtgaatatatgagatcaagctccatgcctataccaaatagaaaccagggtttcatagacatggacacagaaaaaagcctggaaaatatcgtaaagcaaagtgggtggtggacaaggagcacttgggcattcttgaatgaacctccagttcttgaccgacctacaaacaattaccaaccacagttccatgttgccagcctcgctacttcaaagtttaacaagaattctggaatcagtgccaattagtgtttttaactcctaatggtatcttatgtgggtgtttttattctctttattttttt

SEQ ID NO: 5626 - DNA, 151 bp, Gossypium hirsutum
  Clone ID: uC-gsronu33B072h10b1
tttcgatactctctgaaagagaggagagggcagtcttgttttttttaaactcccattctctaaaccccacctaaaaaacttatcttctatattatcaccatcatataattcatacaacatctcactcatcaatcatcaaccacccttcata

SEQ ID NO: 5627 - DNA, 72 bp, Gossypium hirsutum
  Clone ID: uC-gsronu33B073d03b1
tcactatagggataagctagagtacgctctgcagagtacccgagtccggatattcccagggtacgactccac

SEQ ID NO: 5628 - DNA, 97 bp, Gossypium hirsutum
  Clone ID: uC-gsronu33B073e08b1
tctttttcactcccacattaaatattgttgctgaaacaatggcgttttcagctctgacaggttagctagaggcagatgttgtgattaaagatattta

SEQ ID NO: 5629 - DNA, 61 bp, Gossypium hirsutum
  Clone ID: uC-gsronu33B073g03b1
aggtgccagccgcggcggaacccccgggtcgtcccacgcacgtttttttattctgatgaaa

SEQ ID NO: 5630 - DNA, 516 bp, Gossypium hirsutum
  Clone ID: uC-gsronu33B073h02b1
ctttctcttgcagaccatctatcctctcatacttcactctaacagttccctttgaggttctaggaaaacagcttagaaattaaggaatgttgaccttcctattttactttttttttcttttattttctttattatttttcttttatttctattattttaaattttctttatctttattttttttatttttcttcatttttttttattctttttatcttttcattttttttcttatatttttttatattattttttatattttatattttatttatattttttacttatcttctatctttttattttttattattttttaatatttatatatttttaatctttatttttcatttctttttttttcttatctcttctatttttttttattttttttaatttcttttatattttatttaatctattttttttaatttattattttttatatttttaattttttttttttttctattatttacttattattttttttctcataatatttttcacatttcc

SEQ ID NO: 5631 - DNA, 118 bp, Gossypium hirsutum
  Clone ID: uC-gsronu33B073h03b1
tcttattttaaagaaataaataataaaatgctaaaatgcgtttaatttaataaaaaaattaaataggtcgctctttttagaggtgcctagcgtttgttcgttcgtatgtttttttttt

SEQ ID NO: 5632 - DNA, 324 bp, Gossypium hirsutum
  Clone ID: uC-gsronu33B074a04b1
cagatggaaaaaaagaaaagaaaagagaagaagctttaatggctggttcgacgattctctctagattatcatcatctcggttaaaggctcttcctgtaaagcttaaaagcagcaaaccagtgttacccactatttctccattgaaatcgagctctcagtctcagttttcttctgcttcttcttcttcttcttcttcttcttcttcttcactgaagcgcatttccgggattccaagattaccagtggagctgagctgcttaatctcaatgatgcctttgcacagtgcggttgtttttgtttgtcttagatcattacttgctttga

SEQ ID NO: 5633 - DNA, 214 bp, Gossypium hirsutum
  Clone ID: uC-gsronu33B074a06b1
ttcatttctattatctcacattttcgtgtcatggcaacaccttctagcatccctcttgcattcaccgttcgacgatgcaaacccgaacttgtcgctccggccaagcctacaccacatgaacaaaaactattatcagacattgatgatcaaaagagtcttcaggtccaatttccagctgtccaattatatcggttccaaccctacatggaatgga

SEQ ID NO: 5634 - DNA, 587 bp, Gossypium hirsutum
  Clone ID: uC-gsronu33B074a08b1
ctgtttcgtgggagccattgcaacagcttaaaaaatggaagttaatctacaccctaaaagtccttaaccatatctgtaccaacctggaaatcttatcgttgtaattttggaccacttcattaattgttgggggtaatattattttctatttcttctattgtcttttattatattcttttatctattattttttctttcttatttttttattttttctttctttctttatttactattttttatattcattttttattctttatatttttttattttcatattttacttttcctttatattatattcctttttattctattcttatcttaatttcttattcctcttctttttttttttttattttttcttctttattattattctatttaatattatttttatttgtaatttttttcttatcctattttctttttatattttttcttttactttatcatatcattttcttttctctattaaatatttctatttatctattattttttttctattttttatcaacttttttctatttttctatctatttatatttttttcattattttattcttttatttttttctatc

SEQ ID NO: 5635 - DNA, 623 bp, Gossypium hirsutum
  unsure (1)..(623): unsure at all n locations
  Clone ID: uC-gsronu33B074a10b1
ttcagatccacccattccgacggcggaatgaagatccctcaacgccgtatgcgacttttttcgcatgtatgaaagtcgtggaggacgtgcgcaaagtgctgaacgtggggcgatgttgaggcgtgggtgagtgttgtttttttttttttttttattttttttttttttttttntttttttttttttttttttttttntttttttttttttttttttttttttttttatttattatttatatatttttttttatattttaattatttttttattattttattatatttttttatttttattattttttttttttttaatattttttatttttataatattattttttttattatattattatttatattatatatattattttttttaagtatttattaatttattttttattttttattttttatttaatttttatatgtatttattgttttatttatttattttttaaatattatatattaattattttattttattattatgtaattattattaattattttttttttaagtatattaatatattattcattatttttaattattttttattattttttattatttttatatatcaatattaattaattttatattatata

SEQ ID NO: 5636 - DNA, 603 bp, Gossypium hirsutum
  unsure (1)..(603): unsure at all n locations
  Clone ID: uC-gsronu33B074c08b1
gtggtctggtgtnagaggttccttttattttattttttttttatttttacatttatcagtacttggagttgaaattntacattccaattttattattattcggacatgaatttggttttgtctgttttgatattatttattttatatatctatattctttattattatcttctattttttatattattcttctatttacatattaattattaatttattttatttattttttttttttttaattatatttaattttatttctgttatatcttttttttatttttctatattcatttttattatttaattttcattatttctatttcttcattttttattttattttttcatttattttttatttttaattattattatttatttattttttttattatctttttattctatttcttatttttatttataatatatattcatgattattttttttatttctataatataacttttttttatcttattattataatttatattttttctttttctattattttaatttttatatatcattacttttatatatattttataatattatttatttatctaatttttttatatttcttttatataatt

SEQ ID NO: 5637 - DNA, 213 bp, Gossypium hirsutum
  unsure (1)..(213): unsure at all n locations
  Clone ID: uC-gsronu33B074c10b1
cttgcaccggttggctccgccatttattttccggtgatccacagattttatcttacagtattcacaagtacctactatgccaatccgcattgtctacagttctttgttatttttcatagtcttatgtactctgtacttgattgagaatatatgtgatgttatttacanaaaaaaaaaataaaaatttaaaaaaaaataaaataaaataaaaat

SEQ ID NO: 5638 - DNA, 576 bp, Gossypium hirsutum
  Clone ID: uC-gsronu33B074d07b1
gggtaatggtgtggatgaactggctcataaattaaaagaagagtttggccttgaggatgttgttttaatttaataatatttttattatttattttattatatttatttttttttttttttttatttttttataatttattttttataattttattattttatattattttttttttatattatatttattttatatatattatttaatttttttttatattttttttatttattttatatattttttttttttttatttaaatttttttttatatatattattattttttattattttaaatttaattattatttttttattattttattatttttgtaaattataatataatattatttattttttttattatattatgttatttttattttattaataataatatattaattttatatttttttttatttatatatttaaatattaaaattttaatttttatttaatttattttatgtttattaaaattatatatttatatttataatattatttattattattatattaatttgtttttattaattaattatattatatatattattaaaatt

SEQ ID NO: 5639 - DNA, 160 bp, Gossypium hirsutum
  Clone ID: uC-gsronu33B074d12b1
ttactttcctggggttccagtagccggaacattttgcggtggggaaattgggcgtggctgttcaagcttaactgcaaatggagatgaacgcggctctttttgtcgccttcttttgtgaatttcagcccccctttcctttttccaccaccatcaccaccta

SEQ ID NO: 5640 - DNA, 382 bp, Gossypium hirsutum
  Clone ID: uC-gsronu33B074f06b1
caattattgaaatcaaaagaaaaagcaaaagggagggcctcttttcttcacaaccaccatgagctgcgactcttcaataaccaagaggctggatggcaaggtggcactgataactggtggtgccagtggcttaggaaagtgcacagccacactttttgtcaaacatggagccaaggttctcattgctgatattcaagacgaactgggcgattctgtttgccaagagcttggaactgaaaacatcagctatgtccacttgcgtcattatatgccaattctatgtttttaatgttgttatcttggtttcttttatattattaatacatatgtttttattcctctcatttttatcatatttttttatcccaactccattttatct

SEQ ID NO: 5641 - DNA, 630 bp, Gossypium hirsutum
  Clone ID: uC-gsronu33B074h02b1
gcgtccattcgttcgttcacgaattggcagatcaagactggcctattgtgcaacttgcaagatgtgcaattgactttattagagaataaaaggcaaggaatggcaatggggaattaatttttagcggttgccattattgataaacaatcatattcttccttggataccatgaaatggctctaaggccttaaccaaggtggtttaagtttaatctttttttaactttaatgccctgtcccgggtcttaaaaggtataatttcctatttgtatttggtaaattcttaattgtttcaagaatggtatgaatcctttatatcaactcattttttttaggtttatattctaacattctatttagcttttttttggtatttttatataattttttgatttattcttttaatttaatgatactatctcatattttttctttatttcatttcttttttatttttttttttattttatattcattctatattactttttttttatcattattcattttaatttttctattatttcttttttattctctttttttttttaattcatattatattttttatattattatttctctatttttactttatattattattttttttttctattttttttctttt

SEQ ID NO: 5642 - DNA, 448 bp, Gossypium hirsutum
  Clone ID: uC-gsronu33B074h12b1
ggaaattctagttccccctcaactcaatctcatatgagaaccatttctgttgtgccaagaaatgcgcaccctttcccttggactagcatttccagttcaagaactagccacccatcaggttccattaatcctttagagagagctgctgcatcacgggaggaaccaaacataagaaatatcccgagaaacaatgcagagcatccaatgtttgtaccagcaacgcaagatccgacaggatggagtttggcatctgaaaatatcagcacatctggaggcgttccgtcttctaatcgacctgggcctagttcaaccatccagttgccgtctccttcctggattcctccttgcaacccgccaatacaataccaacaaagagtatcagaagttgcaccttggtctttatttccttcatttgattctgaacctggtagcagtagtaggtgttttc

SEQ ID NO: 5643 - DNA, 435 bp, Gossypium hirsutum
  Clone ID: uC-gsronu33B076a01b1
gattttataacttcttttgattccactgagcttcaacaaatcttcagaatttcgaattgaatccttttttttcttttataattcaccgaatcgtacggtgaaaaggagagaatatctgcgaaatggaatccactgtaacgaatccattgccgaactcgaattccgaccctgtcagaaggaagaagaaaaagaaaacatcagcagcggcggcgacggcgacgttgaagacgaatcagcagcggcagaaccaaaaccagagctacaatcacaccagatggaaatccgaggcgcagcaacaaatctattcttcgaagctgattcaagctttgagtcaagtcaatctcaacggtaaccattcttctccttcggctccgcgtcgtggacgagccgttcgtgaagctgctgatagagctttggctgtagcggctaaaggga

SEQ ID NO: 5644 - DNA, 210 bp, Gossypium hirsutum
  Clone ID: uC-gsronu33B081a03b1
ccctcgcgtccgtccacgcgttcgtgtaataagaaagagagattatagataaaagaatataaataatagataactgtaatgatagaaaatgggagtccgttcttggggatcccaggtgactttcggggtcttgctggctaggtgggcttcctttgtgggagccatatttattctgggggccgggtgtttccaaggtctttttttggtgac

SEQ ID NO: 5645 - DNA, 441 bp, Gossypium hirsutum
  Clone ID: uC-gsronu33B081a06b1
agtgcgtccacgcgtccgcccacgcgtccggccgccttctttccatttcttccacttttgcccttcctccccctcgattcccccattcctccctcgtttccgagggtatccccgtcttttcgcacccaagcttcagccgccaccgcgaccatgggtgacgctcccgacgttggtatggacgctgtccaaagacgcctcatgtttgaggatgaatgcatcttagtggacgagagtgataatgttgttggccatgaatcgaagtacaactgtcatttgcgggcaaagattctaactggaaagatgctgcatagagcattcagtgtatcattgcccaacacaaaacatgacttgcttgctagcaacctatctgcaacaaaggtaacattccctcgtgactggacatacaccatgttgcaaacatcctttcaaaccttgaatctg

SEQ ID NO: 5646 - DNA, 410 bp, Gossypium hirsutum
  Clone ID: uC-gsronu33B081a10b1
taagaaagctcgtccacgtgatcgacctgcgcgggcaattcctgctccagaagcaaatgctgagcttcaagccaaccttgatagacgacggttaataacacatgcaaatgccaaaagcaagagtgagaaatttccacctccacaccaagatggaactcttggttatcctttgggttctgcacatccgatagatcctggttatgatccacccgatgttccgtttagtacaagtttctcatattcaaataaagcaccaatccagacatggtctggccctttgatcgactcttctggggctggtgctcctaggagaaagaagcacatgtcaggtgatggtcattcacattcaaagtcaactaagaaagacaagaattcgactcgaatataagagactacatataaaacgggct

SEQ ID NO: 5647 - DNA, 363 bp, Gossypium hirsutum
  Clone ID: uC-gsronu33B081b03b1
cccacgctttcggagcgttggatttattcagctccaagcgacaaatcacaaaaaccagacaatttattgagttctactgaaacagacgagaaggtttaaagattcgattacaggtttaacagttaatatgggtaaagataaaagagacgaaaactgagccatttacacagaggatcggaattattacaaacttttcgttccttttttatttctttcttttgttgcattcataatggttaatcattttcatgttcctttaatttataatccaaggtgaaaattatgctgctgatagaggaagcaaattccctgtaaatccagcatcgttttcctctaataatatttgcttatagtaatttattt

SEQ ID NO: 5648 - DNA, 113 bp, Gossypium hirsutum
  Clone ID: uC-gsronu33B081b10b1
gtcattcgtgcgatcagtgtggggaaaagctagggaagataagatcttttgatcaaggggactgagaatgataaaaagatatactttatttcatagatgagagggatgttgaa

SEQ ID NO: 5649 - DNA, 96 bp, Gossypium hirsutum
  Clone ID: uC-gsronu33B081d06b1
ccggtgactcggaggtcacactagtatggaagttatttcatattccagaggacttaggatgttacaaacacaatcttcctcttctaaaagatgtgg

SEQ ID NO: 5650 - DNA, 300 bp, Gossypium hirsutum
  Clone ID: uC-gsronu33B081e03b1
ccttactaacattgaaacccctcctatggtgattgttggggttgctttctcctacacagagccaaccaccgaatgccactcctccttcttcttctagcccatcgattactcccgcaaatgctttttctccagcttccactccttcaagctctccgccttcattgactccaactagttcgcctccttcaatgactccgaccggggctccacctgtttcggctgatattccttttagttcaactacccctgccgaaagtcccgttgttattccttcaagcattttattaaccctacctattc

SEQ ID NO: 5651 - DNA, 183 bp, Gossypium hirsutum
  Clone ID: uC-gsronu33B081e04b1
gatcctcataaagagattaggaagcaacaatttcgtcgctgatttcccatgcaacaaagaaattccaagcttagatcgtccatcgttgagtcccaacagtatattcagtcaccacaaggatacccataactacaggattttcgttagtacatggaatgttggaggggtagccccacctgaaga

SEQ ID NO: 5652 - DNA, 114 bp, Gossypium hirsutum
  Clone ID: uC-gsronu33B081e06b1
gcttcttttacggtgaataggaggtaaaactagtgtggatgttatctcttgctccagaggacttacaatcttaaaaagttgatcttggcgttctaacagtgtagtgaggtgcca

SEQ ID NO: 5653 - DNA, 69 bp, Gossypium hirsutum
  Clone ID: uC-gsronu33B081e07b1
ttctctcatacggtcaatcgttggaaaaactaatgtggatattgtcgcatgatccaaagaactcacaat

SEQ ID NO: 5654 - DNA, 315 bp, Gossypium hirsutum
  Clone ID: uC-gsronu33B081e09b1
gtctctcgtacgatcagtctgaggaaaagctagggtagaaatgatcccttagtccaagggactgagaatactaaatagtcaaacttcatctcgtaaatcagttgtctgttgaatacaaactgtacctatggctattaattgcgcttgcctatggatgaatatgtgggaccattcaatctgaaatgaataccccgactgtggaactatgcccgtgcgcttgaatatttagaggacatactggacgtcgttctgatgacgtacccatattgggcagggtaaatgggactcttccgtgggcaggcaacatgccagctt

SEQ ID NO: 5655 - DNA, 312 bp, Gossypium hirsutum
  Clone ID: uC-gsronu33B081e10b1
gctattcgtacgatgaatctggggacactctagggtaaagtttatcccttgagcgacggtacgctgaaagagaactagatcaacttcgtctcataaatcagtgggctgttgaacacaaactgtacctatgactcttaaatgcgatttgctatggatgaatctgtggggacattcaacctgaactagacacctcaacggggggatgatgcccaatcactcgagtttctggtgcacagattggactttgttctgtgacgtacacgatacgagcaggagatctgtgcacgatctgtgggcatgacacctgcctgc

SEQ ID NO: 5656 - DNA, 177 bp, Gossypium hirsutum
  Clone ID: uC-gsronu33B081f06b1
ccgactatgcgggcggccctttggatttgactgcaaagggtttttctcttgtctcataggcctttaccttcttatattgctttacttgctataccaaaaccatgtttagttgccttttcatatacgacacgctttagctttctggctttccttcttgattactctccacaaaatgga

SEQ ID NO: 5657 - DNA, 144 bp, Gossypium hirsutum
  Clone ID: uC-gsronu33B081f07b1
tttcatgcgtacgctcaatcgttcgtcaaactaatgtgaatttggtctcacgctccaaagtatctttaattacaaacccttccttctaacaatataattcatttattttttactataatattcacttcattgactcttaatttt

SEQ ID NO: 5658 - DNA, 209 bp, Gossypium hirsutum
  Clone ID: uC-gsronu33B081f09b1
gccttgcgttcgttcaatgtagggaaaagctaaaggagagaagatccttcggtcaaagggactctaaatgaaaaatagataaactttatatcatagaatgacttatattcttaaggtcgaacagtacttaacactcttaaatacaactgaccatcgatagataacttagggaccccgatttaaagtaatactcactacatgcttatttt

SEQ ID NO: 5659 - DNA, 361 bp, Gossypium hirsutum
  Clone ID: uC-gsronu33B081g04b1
aaaaaattaaataaaaaaaaaaaaaaaaagaaacctaaacaccatggagaaccgtcccaagagtttccagcaagcatccggttgccacctcaagggtcactactctatggggccggcgcattgccccttactgggggggggcctactacggaacggcccgggtaccccccggggtttcccaacttaatccctttgtaatccctccccttacccccagttgggggccctcgcgaatagccccgttccgtggggcctcccctcggcttccccatcctgactggcgaacggtccccccccttttccggcctattaatcgcgggggatgggcccttccctggcccctttaccactttggttgccc

SEQ ID NO: 5660 - DNA, 231 bp, Gossypium hirsutum
  Clone ID: uC-gsronu33B081g08b1
tctataggtccgctcgatgtaagaatgaggtgcattatcttatatccctcgtgtgacgcgttccacaactgtcactgcacctaccttagccaatgcacgaaaatagtatacactatccccatgatcttggcgacttatatgcgctacatcaacaatgctgagatggatgctccagctgagatatatgttacttcaattgctctctgcctgcagctgcacagactgcaccct

SEQ ID NO: 5661 - DNA, 202 bp, Gossypium hirsutum
  Clone ID: uC-gsronu33B081g09b1
ttcatgggttcgatcgctgcagcaataagctacaatagcttagaaccttcgggcatagggattctatctgatcactcgatccaattttaaacatgattgacttatattcttaaggtcgcacattacttcagattcctatatacgactgcacatccatacatacattatgatcaccgcttcaaaataaagtcccctgcctgct

SEQ ID NO: 5662 - DNA, 386 bp, Gossypium hirsutum
  Clone ID: uC-gsronu33B081h03b1
cttattctaatataatctctatctcttaagaaagtagaaaatggcgagcagcaggacttccacaccattactttcattacttctttgccttgtgctactgtgtgaggtgggaatgctgatggctcaactttctgcagcacaagccccaggcccccaggacgcatgccccaacaagtgtgcaaagcggtgcagcctttcatggaagccaaagatgtgcaataaaacatgcatagcctgctgccacaggtgtcccgatcactgtgtgcctgatgggcctagagcttgccgagattcctgcccttgctactcacagatcaagacccctaacaaggtcaaagtgcccttagattttacatgacaatccttttcttttatttttaccagag

SEQ ID NO: 5663 - DNA, 442 bp, Gossypium hirsutum
  Clone ID: uC-gsronu33B081h10b1
acttccgatttgttttttgaaacgcaagaaagaagagaaatctcaatggcgccgaaagccgagaagaagcccgctgagaagaagcctgccgagaagccaacggaggagaaaaagtccaccgtcggcgagaaagccccagcggagaagaagccaaaggccggcaagaagcttcccaaggaaggtccaggggccggagataagaagaagaagaaagccaagaagagtgttgagacctacaagatctacatcttcaaggtcctgaagcaagtccatccagatatcggtatctcaagcaaagctatgggaatcatgaacagtttcatcaacgacatcttcgagaagctggctcaagaatcttcaagactgtcagggtataacaagaagcccaccatcacttccagggaaatccagacggctgttagacttggtcttcctggagaac

SEQ ID NO: 5664 - DNA, 450 bp, Gossypium hirsutum
  Clone ID: uC-gsronu33B081h11b1
ctcacgcgtccgatttagtcatccctttcttctcttctttcaactcaaaaactcccaagtaatattagaatcatgggtgttgacacttataactatgagtctacctctgcagtcgcccctgccaggcttttcaaggctttttctcttgaagctgacaaggcttggcccaaggctgctcctcaggcagccaagagtgttgaggctgaagctaatcctggccctggaagtatcgtaaagatcaactttgctgaaggccttccattccaatatatgaagcaccagattggaggacatgacgacaagaatttgtcatacagttatagtttgatcgaaggtggacctttgggggacatgcttgagaaaatcagctatgacaccacgtttgaggcagctgccggtggaggaagcctctgcaagagccccgatgaaatttcacccctgttgccccct

SEQ ID NO: 5665 - DNA, 352 bp, Gossypium hirsutum
  Clone ID: uC-gsronu33B082a07b1
gttatctggacctatccctagggagcttgctggtatttcaagcctcaaagttgttgacgtctcaaacaatgatttgtgtggaacaattcctaccagtggtccatttgagcacattcctttgagcaacttcgaggaaaaccctcgtctcgaaggcccggagttgttggggcttgcaagttacgatacaaactgctcgtgaagaaaccgattgatgctacaaaagtttggaatttaaatatgtagtcacaagattttaagtgtattatcagagtataatggggtaattgcggaaatgccttcttgtataagcactctgtaaattagatttacttgcatatgttacaaaaactat

SEQ ID NO: 5666 - DNA, 219 bp, Gossypium hirsutum
  Clone ID: uC-gsronu33B082a12b1
tatttttataactcaaggccaagaaataagaagtaagaggcacaccaaccttaacaaagccttgattatcagtatagaggcgcactctgtgagggttattcggcctacgcatagcagtgttggctctgtgttcatgcctctatgaggaacccttcttggaatgtacaggccgcgttctgcaatgccctccctttttaataccccccggtgccccacttt

SEQ ID NO: 5667 - DNA, 568 bp, Gossypium hirsutum
  Clone ID: uC-gsronu33B082b01b1
cccactcgtccgtgactagagagttgggtcataaatctgatggtgaaacgattgaatggcttttacagcaggctgaaccggcgatcattgcagccaccggaactggtactataccggccaatttttcgactcttaacgtttcgttgagaagtagtgggtctacgctttcagctccaccgtcgaaatctgctcctcactcgttccatggtgctttagctttggcttctcatcatcacccatatgaagaagggtttgctcatagcgctttgttcggtctccaccatcatcagcaacagctgttaagggcagatcaaatagctgaaactttacctgcaggtggcggtggtagcggcggctgtgggaattcaagtgagaactatatgaggaagcgctttagggaggacttgttcaaggatgataaccaacaacaaggtgaaaccggtggcggcggtggcagcggagatggtgacagtggcggtgatggatcctccattaaggcttttataactggcttacctcaattgcataagccatcgaatatcttacctgccactgccatgtgggcagt

SEQ ID NO: 5668 - DNA, 494 bp, Gossypium hirsutum
  Clone ID: uC-gsronu33B082b03b1
gaagatgtgaagcttttgaagacctggtcaagcgcttttggattaagggttgtttgggcgttgaagctcaaaggtataccatatgaagcaatagatgaagatctgtccaacaagagcgctttgcttcttcagtataaccctgtccacaagaaaatcccagttcttgttcacaatgggaaccccatctctgaatcccttgtgattcttgaatatattgatgagacatggaagcaaaatcccatattgccccaagatcctctacacagagccagggaacggttctgggccaaatttaatgatgaaaagctactaccatcagtatggggtgctttcaccaaagaagggaaagaccgagaggaagctatggctgcaacgatggagaacctgaaattcgctgaagaagagctgaaaggaaagaaattcttcagtggagagaagataggcctggtagatcttgttttcggttggcttgctaacttgatctctatttttga

SEQ ID NO: 5669 - DNA, 332 bp, Gossypium hirsutum
  Clone ID: uC-gsronu33B082b07b1
ttgtgtttaagcatatcaataagcggaggaaaagaaacttaccaggattcccctagtaacggcgagcgaaccgggaaaagcccagcttgagaatcggtcgccatcggcgtccgaattgtagtctggagaagcgtcctcagcgacggaccgggcccaagtcccctggaaaggggcgccggagagggtgagagccccgtcgtgcccggaccctgtcgcaccaagaggcgctgtctacgagtcgggttgtttgggaatgcagccctaatcgggcggtaaattccgtccaaggctaaatacgggcgagagaccgatagcgaacaagtaccgcgagg

SEQ ID NO: 5670 - DNA, 226 bp, Gossypium hirsutum
  Clone ID: uC-gsronu33B082b10b1
ctggttgtggctcagcactcgggtgaaaacatggttaggaccattgctatggatggaacggagggactggtccgcgggcagccggttctcaacactggatctcctatcactgtgcctgttggtagagctactcttggtcgtatcataaatgtcattggagagcctattgacgagaaaggcgaactcaaaaccgaccacttcttgccctttcacagagaagcaccag

SEQ ID NO: 5671 - DNA, 584 bp, Gossypium hirsutum
  Clone ID: uC-gsronu33B082c02b1
cttgagtattgctttcttctccaattctcaacctcgaacttatctacgacttcaaagctttggtctctctatatataaacattcactttcttccacgatcaaaatatcagtcacaccaaaccaaagagggggatcgaaatggggtggaaaggaattctgggttttgattatggaatagttttagcacctatgggccatgatattgctggacctgagctcgtagctgctgttgcaaacgctggtggccttgcccttcttcatgctcctgattgggattcaccagagcagctaaaggagctgataaggaagacacgagagctaactgataaaccctttggggttggtgttcttttgccattccctcacaaggagaacataaaggctatattggaagaaaaggtggctgctctgcaagtagcgtggggtgaatgctcaaaggaccttgctttagaagctcataatgcaggggtcatggctgttcctcaagttgggagtcttgaggaagcaaaacagtaattgatgcgggtgtagatgcgattatcgttcaaggctatgaagcttgagggcacgtaattggacaggat

SEQ ID NO: 5672 - DNA, 260 bp, Gossypium hirsutum
  Clone ID: uC-gsronu33B082c06b1
tttttggcgtggaaactctctctggtgtcctcgctggatctcttgtctctggtgtccagattgctatctctgcatccaacacaggaggtgcttgggataatgccaagaagtatattgaggctggtgcttctgagcatgcaaaaactcttggtcccaaaggttcagatccacataaggctgccgttattggtgacaccattggtgaccctttaaaggatacatctgggccatcactgaacatcctcatcaagctaatggct

SEQ ID NO: 5673 - DNA, 501 bp, Gossypium hirsutum
  Clone ID: uC-gsronu33B082c07b1
ggcactttcctcatttggctgatctggttactagaattaattacaacaatttctacatgtctgatggtggaaatttgatgactgcccctagctctgaaactgccgctgcaagacctgggaaggcctttgcaagttgaacaaaatacagttgattctgttacttacggtggtgcctgatctccaaaccaggtacgatcaaggcaatttgaatgataagtctctaaagctgctcatacatatgatctttgagtttgttatatacaaggtgagtttaaagaaatcaattagttcggcggtgggggctaaagtctttgcatctaaatttggagttgatcaaccgtctgcctttgcagtctgattgttcagtttgtaattgaaatcctggtataaaaagtaccatgtttccgttatatttcaggttgatgatgctgtggaaatggtatggtgtggtgtttctttttcttttcccctctctcctctcctttcctttctcttcttttt

SEQ ID NO: 5674 - DNA, 481 bp, Gossypium hirsutum
  Clone ID: uC-gsronu33B082c10b1
ttccactcgtccgtgattgcttatcagccttatgcaatgggtagaatgaggttcatttggggtgacaatgcggaggagttcagacctgagagatggcttgacaagaatggcatgttccagctagaaaaccctttcaagtttacagctttccaggcaggacctcggatttgtctgggtaaagagtttgcttataggcagatgaagatcttctcagctgttcttctcagctactttgtattcaaattgagtgatgagaacagaacagtgacatacaggacgatgatcaatctccatatagatgggggtcttcatgttcgtgcatttcaccgatgtcaaacttaaacctggtttcatctgttcgctgtctcggttcattgtaaactttaaacatctatataccacgtgaaacctgaatcatcttttgtcctataaaacgggttcaggcaacttataaataagcataaccaagtcgtttagacac

SEQ ID NO: 5675 - DNA, 203 bp, Gossypium hirsutum
  Clone ID: uC-gsronu33B082c11b1
tgttggtctgctgcccttgtggcttaatctgctcgtccagcctccccgtgccgtcctaccatgcccgtctctgacaagaagcgtgagtacgccttgaagctgcgcgccctgctgcaggagaaccgcagcgtgatgatcgtggagtgcgacaacgtgggctccaagcagatgcagagcatccgtctgtccctgcgcggcacggc

SEQ ID NO: 5676 - DNA, 280 bp, Gossypium hirsutum
  Clone ID: uC-gsronu33B082c12b1
gggaaaggtatatgatgtgacgaaattcttggaggatcatcctggtggtgatgaggtcctgttgtctgcaacagggaaagatgcaagtgatgattttgaggatgttggtcatagtagcagtgctcgggcaatgatggatgaattttacgtgggcgatgtcgatacatcaactatcccaactaagaccaagtacacccctcccaagcagcctcactatgagcaggacatgacctcggactttattataaagcttctccaattcctcgttcccctgttgatc

SEQ ID NO: 5677 - DNA, 445 bp, Gossypium hirsutum
  Clone ID: uC-gsronu33B082d03b1
aaggatcttaaacgtggttttgttgcttcaaactccaaggatgatccggccaaggaagctgccaacttcacctcacaggttatcatcatgaaccaccctggccaaatcggaaatggttatgccccagtcctcgactgccacacctctcacattgctgtcaaattttctgagctgttgaccaagattgacagacgatctggcaaggaactcgagaaggaacccaagttcttgaagaacggtgatgcaggtatggtaaagatgattcccaccaaacccatggtggttgagactttcttcgaatacccaccactcggacgttttgctgtccgtgacatgcgccagaccgttgctgtcggtgttatcaagagtgttgagaagaaggacccaactggtgctatggtcaccatacttgctgccaagatgaaatgagagattattgctgaga

SEQ ID NO: 5678 - DNA, 467 bp, Gossypium hirsutum
  Clone ID: uC-gsronu33B082d04b1
taattttctaattatataataataattttttaatattctagggtatactaatgtaaatgaaagatattgaaaaaaaacacagacaaaggggcggccgcggtagaggtcccggggctacccggccccgctggccctggcgtagccccctccctgtgtccccgcgccgcatgtcctcttggccgggggggcccccctggggggcctgggtctgcccgggctttccccccctctccccgggggcgctcccggcgcccctctgctcgtggggtggcggtgggttagccccggggggggggggggtccccgcggctgccccccctgctgggcgtcggggccccgcccctccccggcgggttgggttctggccgcggggcggtgccggtcctcccttcccccggtccgtggcccccccctctgccccgggctcccccccccttggtgccccccttttcccggggggggggggg

SEQ ID NO: 5679 - DNA, 330 bp, Gossypium hirsutum
  Clone ID: uC-gsronu33B082d08b1
attatgaaccatctccttcctttcggaacataatatacaagtctcctttctgcagcttaaattttcagccatgaatcacaaccagcaacacttcagtcaatcatctgcagctgcatacgcaccaccaccaccctccacggggccaggaccctacgggacagcaccgccggccggttacccgatgaccaaagacgagtacagtcagcaaaatccggctgctgtcgaaaccaagtccagaggtgatggattctggaaaggatgttgtgctgccctttgctgctgttgcgctctggatgcatgcttttgaagcttttatttttgctctttcca

SEQ ID NO: 5680 - DNA, 534 bp, Gossypium hirsutum
  Clone ID: uC-gsronu33B082d12b1
cccactcgtccggccacattcagcaatatttgtaacagatggcttcttccttccgagcattcctaaacagtccagttggcccaaaaacaactcacttttgggggcctgttgcaaattggggttttgctctcgctggattggtggatatgaataagcccccagaaatgatttctggcaacatgacatcagctatgtgtgtctattctgcattattcatgaggtttgcatggatggtacaaccacgaaactatctactgttggcgtgccatgcttcaaatgagacagtacagctctaccaactctcccgttgggcaagagctcaagggtatttgtcggagaagaaagacaaagctacatcgcagtaaagcagcagcttcagttggagctagctgcttttcgattctttccattccaagtgtctgtgagttttactgtgatccgggatgattggaggattctgaacctactattaaagcattcattttgactgctaaaccaataatgattgttggagtgcatcttgattgaccctat

SEQ ID NO: 5681 - DNA, 255 bp, Gossypium hirsutum
  Clone ID: uC-gsronu33B082e03b1
cccactcgtccggcaactttgacgcagctgctatttcttttttgtggttttcagcagcagcttgtatttggaagaatggtgagggtgagcgactcgactgacgctctcccgatcacgtccatggctgcaaaaatgcgcatccgccatgccaaaatcctaccgtcttttatgtttatactttaacctatgaatatattcaccgcacctccctctcttctttctcccttctttccctcccttcctctattaaaaacc

SEQ ID NO: 5682 - DNA, 382 bp, Gossypium hirsutum
  Clone ID: uC-gsronu33B082e04b1
cccacgcgtccggctaaagcagtggctttatcacttggcacgcattggatctccaactttgtcattggcctttatttcttgagtgttgtgaacaagtttggcatcagctcagtgtacttgggattcgctggtgtgtgcgctgttgctgtctttgacatagctggtaacgttgtggaaacaaaggggcgatcattggaagatatagagcttgctctgaatccgacgactcaatttgttcaatatccaaaggtttgcagcattaatctctgaagccggttaatgatcatctcatgagcattccattattttgcaaggccagatagagccaactagttctagtgacgtatacgtatacctatgttgcttgtactatggaaagaag

SEQ ID NO: 5683 - DNA, 616 bp, Gossypium hirsutum
  Clone ID: uC-gsronu33B082e05b1
cccacgcgtccgctcctgttcataatcctcctaagctgaaaccgccaccatatgaacataaacctccggtctatgaaccaccaaagaaggagaagcctgaacctaagccaccagtttatacacctccaaagaaagagaaacctgaaccgaaaccaccagtaaatgaacctccaaagaaggaaaagcctgagcctaaaccaccggtttatacaccaccaaagaaagaaaagcatgaacacaagccaccggtgtatgaaccaccaaagaaagaaaaacctgagcctaaaccaccagtttatgcacctccaaagaaagaaaaaccagaacccaaaccaccagtttataagcctccaaagaagccaccagtgtatgagcctaagccaccaaagccaccggtttatgcaccaccaaagaaagagaagccagaacctaaaccaccagtatatgagtctcccaagaagccaccatatggtcactatccaggacaccctccattggagaagcctcaatagagagatttcctcggctaaccattcccgacaactgagctactatggctacatagataaattattatcactgcaataagagctgctgccggctcatgtctgttttc

SEQ ID NO: 5684 - DNA, 475 bp, Gossypium hirsutum
  Clone ID: uC-gsronu33B082e10b1
cccactcgtccgacgaaactggatccacttagaacttatccatacagatacagggctgctgtgttaatggatgaccaaaaggaaaccgaagcagttgaagagctttcaaaagccatagctttcaagcctgacttgcaaatgctgcatcttcgagcggcattttacgagtcgatgggtgatatgaagtcagctctctgtgattgtgaagcagcactctgcttggaaccgaaccatatggacacgcttgatctgtataatagagcacgagacagagccatcagtccacaagaaatgtgagaggcatcatcgtcattacatttctgataaacttgccggatgtagcagtcagttacaaggaaaaagaatcatggagtcttttcacatcgagctgctgaatgaccctcactgtggaaaggaaaggaccccgagagagttgcttgcaaatgcgaacggcccttatggaatcaggtgtacc

SEQ ID NO: 5685 - DNA, 561 bp, Gossypium hirsutum
  Clone ID: uC-gsronu33B082f04b1
ccctaaccctttcattaccactgccgaactctcccgccttatgcaatggaagctcactcgcggcaaatggaggcctcgtttgttagacttcgtttcctctttggacgactcttccgtccaatccgtttctcaaaaggctttcctctcccttcccgacatctccaaagccatctccgagcttacggttttgaaaggagtcggcgccgctactgcctccgctgttctcgccgcctacgctcctgaaacggcgccgtttatgtccgacgaggctatgttggctgcgcttggaagctccaaagattattcgttaaaacaatacttgttatttgtggaaaaactaaaaagcaaatctaaggaactaagttcaatgggtgactccttcagaccttcagatgtagaaagggctttgtggagttcagctgtaggcgtaaagttgcagtcttcacagacagctccggacaagaagatcaagggaagcaacacaagacagagaaaacattgaattatctatgtgcaagatgatggaaactttgtgagttctaacatggccaagtattaatc

SEQ ID NO: 5686 - DNA, 327 bp, Gossypium hirsutum
  Clone ID: uC-gsronu33B082f05b1
gccgtcatcccatagtgaaatgggctcagagattggatgacgtcttcataactattgagcttcctgatgctcaggacgtgaagcttaaactagatcccgaaggaaaattcttcttctctgccaaaagtggagcggacaaaatcccctatgaagttgatttggatctgcatgacaaagttgacgttgatggaagcaaggctagtgttggaaatagaaatatctgttaccttgcgaaaaaggccgcgagcaagtggcggagcagattactgaagcctgaagggagacctcctgtgttcttgaaagtcgattgggatcgatgatttgttg

SEQ ID NO: 5687 - DNA, 398 bp, Gossypium hirsutum
  Clone ID: uC-gsronu33B082f09b1
ttccactcgtccgcccacgcgtccgcccacgcgtgcgaatgccgcaagagatgtggcagcaccatccattgaagaccctgggcacttcccaactcttgggggcaagtgaagaagtgagattccattagaaccccacatatgatatccatgggttttattggaattttaggtaccttttaatttcgggctgggaataagataaaataatctggtttcctgtcgccaaagtatctctgaattttatgttgtaaaatgtatgtttcagggtttttctttctctttttgtttttttggggttattgcccccactattgttatgctgtgatcttactgttattgctcactgctcagttttcttcgtggaatagatggaacttgtttgctacttgtcttcgacc

SEQ ID NO: 5688 - DNA, 523 bp, Gossypium hirsutum
  Clone ID: uC-gsronu33B082f11b1
gaaaaagatggaagagatcaggtatggggccattgagaggttagcaacccagaattcattaggagatctatttatgagtgtcgtgaggaggagtgccgaagctgcagagccactgcatttacttccttcagcatatttgacagtgaatcttactccatccgaagatttcaagcaagcccatgggatacaacaatggtggagacctgatctgcacttgaagtgcaatctttacaagtataaatagtttgtccctgtctagcttttgcttgtatatgtaattatgtaccactagtcaatccttgtagtggctcatgttgctgtgggttagggaaaacagagatatatgtattgttttccatgtgagactctcaaactgatagattccagtccattttcttgtcaataagtatagaatatggttcctttttggattaataatacattatttcttaaaatttcctcttcttctttctttattcccaccttctactcctctatcttccttttttttttttctacctct

SEQ ID NO: 5689 - DNA, 283 bp, Gossypium hirsutum
  Clone ID: uC-gsronu33B082f12b1
aggtcctactctccaaggaagaaattgataagatggctcaagatcgccaaaaagctaaaagattaatgttattcttgcagtactcttcagaacttccaataagtgtaataaaatctgctctggactctatgctacacagagctacaaccatgattatctttttgaaaatttatctcaacttcatttctcaaattgagctgcgaatttacaccctgttctaggattaacgtgcgtttatgttgtttccggatttgagcattcacccaatgtgggtctctgtggt

SEQ ID NO: 5690 - DNA, 580 bp, Gossypium hirsutum
  Clone ID: uC-gsronu33B082g03b1
tccgttgtttcacacattttagaacatagcaatataagagaggaaaagttaaataaaaataatacacaaatagaaaacacacaaacatgacacagcgggggtgccctttagagagggggggcttccgtactgctttcttgcgatgacatgcctttttggcgggccctggcatttttactcatttgcccggggttctccggcgggggtcttggtttttgtcgggctgccggtattctttcggggggggggggtttcccccgttttgggggtggggcccccggggtctgccccctttagggcggcgggtgccccccctttcttctcctcttggggttttggaccgggcccggtcgcggggcctcccccccacctggtgccccccccctcggggcttgggccggccccctttctgggccctttcttcccggggggggggggggttccccctctttttcttttctatttttcggtttcccccggcgcttttttttcgtgtctcccttttctcccgccccgtcttggttccccccggtggttccttcggggccccccttgggtcccgttggggcttttcctcctc

SEQ ID NO: 5691 - DNA, 242 bp, Gossypium hirsutum
  Clone ID: uC-gsronu33B082g07b1
gacttcactttagggcggaggagcctataaacgggacctcatgagaggcgcatggcggtcttgaagacagtgtacggacacttggaggacacccagacttacctgggaagtgtgaagcctaagtgggacagcccaacttagtcagccctgtgctgttcagtgctgttatcatagtactgataatatgcttgctgtacctatacttatttcaatccagaagctctaatctatcatatagggcc

SEQ ID NO: 5692 - DNA, 460 bp, Gossypium hirsutum
  Clone ID: uC-gsronu33B082g10b1
gatcgacaacgtgaaagccaaaatccaagacaaggaaggcatcccgccagaccagcaacgtctcatcttcgccggaaagcaactcgaggacgggcggactttagccgattacaatatccagaaggaatcgactcttcatctggttctacgtcttcgaggtgggatgcagatcttcgtcaagactttgaccggtaagaccattactttagaagtggagagctcggatacgattgataacgtgaaagcgaagattcaggacaaagaaggaattccaccagatcagcaaaggttgatttttgctgggaaacagctggaagatggaaggactttggctgattacaatattcaaaaggagtccactcttcaccttgttcttcgtcttcgtggtgggttctaagccctaaggtctttcttaatgtgggttttctggctttacgcgaaggaattgtgccctttgatg

SEQ ID NO: 5693 - DNA, 344 bp, Gossypium hirsutum
  Clone ID: uC-gsronu33B082h12b1
ctcgatctgagcatcagaaagccactgccactggttttggagaatctttattacctaccaaagcaagtcagaagataaagtggagaatggaggaaccacagccagaacttccgaaatcccgtggaagagaattttagccagcaggcctgtttgggcaatcgtggtaaataatttcacattccactatgccctttatgtattaatgaactggctgccaacatactttgagctgggcctccagctcagtcttcaggaaatgggttcttctaagatgttgccttatttcaacatgttcatattttcaaatatcggtggggctcttgctgaccacttgttcaccataa

SEQ ID NO: 5694 - DNA, 57 bp, Gossypium hirsutum
  Clone ID: uC-gsronu33B086a01b1
cagatcagttacggacaaggggaatccgactggtggaggaatttcaaaccattgcga

SEQ ID NO: 5695 - DNA, 65 bp, Gossypium hirsutum
  Clone ID: uC-gsronu33B086a06b1
tatggtacgtcacatgcaacctacagattcatttagtttaatagtcttcaaaactattcgatttt

SEQ ID NO: 5696 - DNA, 327 bp, Gossypium hirsutum
  Clone ID: uC-gsronu33B086a10b1
ttcctcgcgtccgggccaatcaaggccttattcaaccataggtctgcgagtttcgctcaccaaccttaaaatcgtcacctagcttcgattgcaacgaatcaagtgaggattcgaaagagccaactctctgttatttgtgtgctggcaatctgttttgcaagtatgcacggcatagagaaaccgttcgtggtgacgtgtcgtggcttgtgacttattgtctttggagaccctctttcattatgttcttctattatctttttttgtcttacttcttttctatctttttcatttcctttattttccttattttctctattaatttttcat

SEQ ID NO: 5697 - DNA, 281 bp, Gossypium hirsutum
  Clone ID: uC-gsronu33B086b12b1
tattagttacgtcgggaattatttttggacccattatttcttcacggttttaggagcttcttataccttcccatcttggaaaatgaacgatgtaccacacacgactttccttctcactcatgttgtcttcctgttttaccatgttacatcaaacatgacacttcgcagattaaggcactctattgctagcttgcccgagaatattcagttggctactgaggtggcatggatcttggcccttttttacacccattgactatctatgtgaacttttcgctctt

SEQ ID NO: 5698 - DNA, 192 bp, Gossypium hirsutum
  Clone ID: uC-gsronu33B086c02b1
gaatcactggccattacccaaagtgtcattttcgtgaacacgaggcgcaaggttgactggctaactgacaaaatgcgaagtcgagaccacacagtttctgccacccatggagatatggaccagaatacgcgtgatgtcatcatgcgggaattccgttctggattttccgtgttcttattattaccgattctg

SEQ ID NO: 5699 - DNA, 406 bp, Gossypium hirsutum
  Clone ID: uC-gsronu33B086d02b1
ccctcgcttccgatcatttcaggccgtttgatgggatttacggtaacacttttcagagactgaacagtttcaagggggattactttttaatattggatttccaacatgaaaagggactgaaaattgttttattcaaagcttaaggttcagttgattctatgttttattctctttactctcattttattcatttgttattgttttatatccttattatatttttctcattttcttattctttatattttttttcttttctcaattttttttttctatgtatatttatctttcattttctattttactttattataatcttttttttcatttcatcctcaatttatcatttattttactttctttttcttttatttatcttatttaatctttctcatatttatctata

SEQ ID NO: 5700 - DNA, 91 bp, Gossypium hirsutum
  unsure (1)..(91): unsure at all n locations
  Clone ID: uC-gsronu33B086d06b1
gaaangaagggtctgcaggcacttatattggcaatggtaatgtttatggcaacctcccttttttatactcaaaccatttcaaacattccat

SEQ ID NO: 5701 - DNA, 283 bp, Gossypium hirsutum
  Clone ID: uC-gsronu33B086e06b1
cctcgtgtccgccggaatccctctattcctctcttcgaaggttgccattttgtagcattgagcaaaatgaatctcaacaacctcaaagttcctaagatgcctggaggtggagcaccttctgctttgcttatgattgttgttattgctggactatgtattattatttaccttatattctatcttttttttattttctttattctcatttattttctatctcttattttttttttcactatttctctacatttttttttctcttcatatttctcctttacttttt

SEQ ID NO: 5702 - DNA, 61 bp, Gossypium hirsutum
  Clone ID: uC-gsronu33B086e07b1
tcttacttcgcatacactgatcaatggggaagaaggagcttcttttacctcatactctctt

SEQ ID NO: 5703 - DNA, 548 bp, Gossypium hirsutum
  Clone ID: uC-gsronu33B086e08b1
ttttctacgcgtccgcggacgcgtgggaaaaataaaataaaattttaaaaaaaaatatcttaattttacatatgggggggggtttttttttataacttcaagcttatttctcatatacatattcatatttttaatttttttattatttttataataaaattaatttaatttttatacttatttttatatattttatttaattattttatatttttatttatatttctttttattatttttatctactattttttttattttattcatttattaatattatattttttcttatattatcatattttattctctatttatttatcatttttatactttatcttcttttaatatcattattctatatattatattatataattctctatactttattattttatatcttatacttcttaatttattatacattttttttataaatttaatatattatctaaatttcatattatattatcttatttatatatttttattttcatacatttattttatatattacttaatattaattatactcatatttatta

SEQ ID NO: 5704 - DNA, 171 bp, Gossypium hirsutum
  Clone ID: uC-gsronu33B086f02b1
cctacgttttcgggaactttggccttgttattagcttcagctttggccgatgacgtcgtcgtactgaccgaagcgaacttcgataaggaaagtagcttaatactaaatatttaataattttaatatatttataataattatacatatattttatatttaattataataatc

SEQ ID NO: 5705 - DNA, 269 bp, Gossypium hirsutum
  Clone ID: uC-gsronu33B086f07b1
ttcctcgcgtccggtgctttgtgtactatattatgtcgctacatttcaagatcatgcctattttaagatcgataattctatttcaagaagagataaaatattaatttgtctattcaattacttatattttctaaaattctatataattatatcttaatttattcaaatattttcatttaataaattttattcaatatactttaatatataataccattacatttcattttcattaacattctattttatattccatatttatatatttt

SEQ ID NO: 5706 - DNA, 372 bp, Gossypium hirsutum
  Clone ID: uC-gsronu33B086f08b1
ccctcgcgtccgtgacaaccccatttattattatatagtcagttgatttagttattcaatttttatttttttttcttggtgggattttccatttctatgatgaattcgcaatgattttttattttatccatctcttcttcttccctcttttttccttttttttttcctcttttccttacctctttcttattttttttctacctcttctttctttttctttttctttcttctctctcttctttttttccttcttcttctctcttattttttttttcttcttttttttttcccttctcctcttttttttttcttttctcctcttctttttttcttttcttatatcttcttttttcttactttcttctttcttct

SEQ ID NO: 5707 - DNA, 198 bp, Gossypium hirsutum
  Clone ID: uC-gsronu33B086f12b1
atgctcaatgtccctcatgctcttagttgttctgtcctttattttgcacccggcatggatcttttaaacctagaggcatgacccaatgacggggaagaggcgtttttgttagaagtcagagcctttcttttagctttacggaagaacatcaacaacgataattttggccatttagttctgttcacttatcaaaagaca

SEQ ID NO: 5708 - DNA, 132 bp, Gossypium hirsutum
  Clone ID: uC-gsronu33B086g02b1
ccctcgcttccgcccacgcgtccgaataactgaaaggatagagaagaaatggaatgcctggtatagtattttgatattgaaaaaaaattctgcgcttttccaatgacaggcagaataacatcttacttgcca

SEQ ID NO: 5709 - DNA, 502 bp, Gossypium hirsutum
  Clone ID: uC-gsronu33B086g06b1
ttttcttacaacaaaactgaaaatgtcttgctgttcaggaaaatttggctgctgcgctgatttcaagagcggccagctccacgtaatttttattcttctatttcttattattatttcactttatcatttattccttttttttttcatcaattctcatcatttttattctcttttttatcttattcaatcttttattttaatttcttttcttttttactcctctctttttttttcatctctattacacttatctctcttttctcttttttcatctcttattttacctatctcttttctacttcatttttattttattttatacttcttcaatattattcttcttttattacttttaattttttaatttattctcctttccattttttattctctatacaatttttactttatataaatttttttttatttcctcttctctttttctataatttttttttatttttatatatatatatttatttactacttttttttattacct

SEQ ID NO: 5710 - DNA, 190 bp, Gossypium hirsutum
  Clone ID: uC-gsronu33B086g08b1
ataaaatctcatcaatggcgagttttttaggttcaatttaatagatgaaggacttctcttttttcttctacaacatttttacctctttcattccccctatacttctttacctctatctttattcacttctccttttatttttttctcataaatatttttcttttattccttacctcttttttactttatc

SEQ ID NO: 5711 - DNA, 558 bp, Gossypium hirsutum
  Clone ID: uC-gsronu33B086g09b1
ataaaaaataataaatacaatataaaaaataaagaaagaatttatgaaaaaaaagaataaaaaataaggtaaattaaataaaaaaaataaaaggggccgccctttttggggtcccctgcttccttctccttttttccccccgattagctttttttttggttttctctaattctttccttttgtcggtttttttcctcttttttctttgaatcccttttcccttttcctcctttttttccttttctcttttttcctttttttccctttttttcttccttttcctttatttttccttttgttttctttttttctgtttttttccttttttttgtcttcctttccccttctttttttctctctttttttttctttttttctttttttttttcttcttttttttccttttttttttctttctcttctcttctttttctcttctcctcttttttttcttctctcttttttttcttttccttctcttttttcctcttctttcttttttcttttttctcttcttctctttcttccttctcttttttctctctccttctttttttc

SEQ ID NO: 5712 - DNA, 180 bp, Gossypium hirsutum
  unsure (1)..(180): unsure at all n locations
  Clone ID: uC-gsronu33B086g11b1
tctcttatcgtccgcagaaatctcgtgtggaacaaaaggctcatagctcgtttgctccccgctcaaaagnccattaccacaccttcaaattctttctcttatacaattatctaccttctttccctcccttcccaaccactttttacctaacccttttaccataattctttttcttactct

SEQ ID NO: 5713 - DNA, 112 bp, Gossypium hirsutum
  unsure (1)..(112): unsure at all n locations
  Clone ID: uC-gsronu33B086h08b1
atagtcactccccaaactcccccacctccacgacgtgttatactaattccttattcaacgagctctcaaagnctttactcttggcacccctactttctatttctccctcatg

SEQ ID NO: 5714 - DNA, 100 bp, Gossypium hirsutum
  Clone ID: uC-gsronu33B086h09b1
tattgcagtgctttctcccatcttcacctctgccgcctttcaagatttcgagggtttataagccgctgccgcaatacccaagcccccttatcgaatatgg

SEQ ID NO: 5715 - DNA, 484 bp, Gossypium hirsutum
  Clone ID: uC-gsronu33B086h10b1
taatttccttcgttggcactcacgagtacttggcacctgaaatcattaaaggccaaggccatggaagtgctgtcgattggtggacgtttgggatctttctatacgaacttttgtttggaaaaaccccttttatggtagtctttatcctggcaactgtttttaaccttatcgttcagtctttgagattttcagtgtttctattcttctagctcttcaactattttcttatttctatcttttattttattagtaaccatcatcttccttttttttttttgtcttatttttttttttctttttttttttttttttttttttttttttattttcttttttttttactttttttcattcttttctttttttatttttctttctttttcctttttctttttctatcttttctttttctccttttttttattttcttatttctcttttcttctttaccttattcttttttctcttttttattctttttttt

SEQ ID NO: 5716 - DNA, 483 bp, Gossypium hirsutum
  Clone ID: uC-gsronu33B099a04b1
gtggtttcacttagttacaacagagctatggagatagtagtgaagaagagctatcggtgttgccacgttacactaaagtggatgtcactgggaataaccgtaccaaatcggttcttgttggtcttcaaggtgtggttaagaaagctgttggacttggtggatggcattggctggttcttacaaatggcattgaagtaaagctacaacgaaatgccctcagcgtaatcgaagctcccaccggtaacgaagaagatgatgaccttgagtttgggaacatgcaatggaacggatcagacttggcatcggatgacactcaaaagtcccatagatcaagacataagtcgcataaatcgacggggtcttctcacaaaactacgagcaggtctttttcctgtgactcgcagtctaagagttctgtttcgacaccccaggggtctatgaaagttgacctcagcaaactagagatggctgctttatggagat

SEQ ID NO: 5717 - DNA, 277 bp, Gossypium hirsutum
  Clone ID: uC-gsronu33B099a08b1
tactgttattggtccataataaaccattactcaggttgaagaccgagaggcagcggcgtgagaagctgaaccagcggttctatgccttacgagctgtgagtgcccaacataatccaagatggacaaagcttggggggtaggggatgcaggtgccaacattactgaccttgaggtgcaacttaaggtcttggatttagggacggaaaagttagttagttctccgagagattccacagggctagatggtaacaccaaggcggagcccaacataggagcg

SEQ ID NO: 5718 - DNA, 279 bp, Gossypium hirsutum
  Clone ID: uC-gsronu33B099a11b1
acccgccacttgtcctgtgagttctttgttataggaatacggactccactgagattccttttattcgccttattacatgtattattcattgcccctcccatatggggtgacgcctgtctatatttccactagttcaaaaataacttgcttgcctaattattgtagcctgcttccgatgtgctgccatgattctttgtactgacaattttacatgcatatttctatgtatgcccatcgtcataagatacaatcagtcccttgtcttagaacagacaaaaa

SEQ ID NO: 5719 - DNA, 259 bp, Gossypium hirsutum
  Clone ID: uC-gsronu33B099b02b1
aaaaatttaatttaaaaaaaaaaaaaaaaaaaaaaaaaaaggataaaaaaaaaaaaaaaaaaataaaaaaaaaaaaaaaaaaaaaaaaaaaaaaaaaaaaaaaaaaaaaaaaaaaaaaaaaaaaaaaaaaaccatttatatgggtgggggggcccgttttaggggacccaagttcccggccgggggctgggaaagttttagtttttttttggggaacccaaaatcaatgccaggggcggccctttaccaacccggggaa

SEQ ID NO: 5720 - DNA, 313 bp, Gossypium hirsutum
  Clone ID: uC-gsronu33B099b08b1
gtggtgttcggacaggtagttgaaggcatggatgtggttaaagcgattgagaaggtggggtctagcggtgggaggacttccaagcctgttgttattgctgactgtggacagctttgaaaaagggcttattgaattgtgtttccttcataatatctggtctttttaggctccttttttttatgctatgctgcttctatggctactgggttttggtgttttttaagaagttgcttgatgtagctttttcattaactgccataaataagataggctttattttcaaattaaaaaaaaaaagaaaaaaaaaacaaaa

SEQ ID NO: 5721 - DNA, 477 bp, Gossypium hirsutum
  Clone ID: uC-gsronu33B099b10b1
gttgcccacaacatataaaagataatagagactaggaaagatataaaaaataaaaaaaaaaaaataactaaataaaaaaaaaaaaaaaaataaaaataattagatctcaccttggtgctgttgggggcgcccttttggggggtccccggttttggcccccgggttggggcctccgtttttttttttgggggccccttttttccacccccgggccggggttttccccgggggttcccgggcttcccccgggggttcccccccttttttgccctgggtggcattccccttttaggggtttggttttttcgccttggggcctttccggttgccctttttgcccatgggcccccccccctttgggggggggttcccccccctttggggggcctttttttgggggggggggggggggtttttccccggggtgcctcttccctttttttggccttttggccccgcgtttttggcccttttccc

SEQ ID NO: 5722 - DNA, 367 bp, Gossypium hirsutum
  Clone ID: uC-gsronu33B099c01b1
atttgtttcattaaagccagcaagggtggttctttctagcatggaagttgttgctcaatcaatgggctataagacacatattcgtaattataagatgagagttgaaggtccttcagctaataagaattctcatttgtcagttatcctcgaagttttcgaggtcgctcccacatttttaatggtagatatggaaaaagcagctggtgatgccggagaatacctaaagttttaccaggcattttatagcaacctcgaggagataatatggaaaccaccaaatgaatcaagcaaaactaggatcaccaaatctaggagtaaaagacgttgacctgtcatcccacaacattgccagtatttcaatggcata

SEQ ID NO: 5723 - DNA, 405 bp, Gossypium hirsutum
  Clone ID: uC-gsronu33B099c05b1
ctgacacacttttggggtaccgaaaacgatcccgagttcaaaggatatcacgatgggaattcggaacctattggatttgggcacatcggccttaccgtggatgacttgtacaaggcatgcgagagatttgaaagtcttggagtggaatttgtcaaaaaaccaagtgacggttttgcattcatcaaggatcctgatggttattggattgaaatctttgatttgaaaggaattagacaaatagttaacagtttagcttgagttaatgcttcaccaaattcaggaaacaatgatatggcatatgttgtagattccaatgtctactctcatacgttaattcctttgctttccgaaacttgtcgagggacaaactcaagcgaaatcttaaatgaagcacatttcattcta

SEQ ID NO: 5724 - DNA, 478 bp, Gossypium hirsutum
  Clone ID: uC-gsronu33B099c09b1
taacatgtgagcccagcttaacattcttgcttgccaaattcgatggtatacttggtctgggatttcaagagatttcagtaggaaatgctgtgcctgtgtggtacaatatggtcaaccaaggtcttgttaaggaaccggttttttcattttggcttagccgcaactccgaagataatcttggtggggaattggtatttggcgggatggatactaaacatttcaaggggaatcacacttatgttcctgtaacacagaaaggatactggcagtttgatatgggtgatttcctgattggtaacgaaacaacaggattttgtgccggtggctgcagtgctattgctgattcagggacttctttgttggctggtcctacgggtattattactcaaatcaatcatgctattggagcatctggggttggaagttaagaatgcaaggctgtagtttctgaatacggagagaagatacttgatatgct

SEQ ID NO: 5725 - DNA, 437 bp, Gossypium hirsutum
  Clone ID: uC-gsronu33B099c10b1
ctacatctacccacagttgggtttctttgttctttttttctttttatttcttcaaaacatgtctgcgattcctccatcagcttcacaaaactcatcatcttcaggtttccaggatttcttgcccgtgatggctgacaagctcggaggggatggcttgataggggaactgcgcaatgggttcaacctgttgatggatagagaaaaaggggtcattactttcgacagcttgaagaagaattcggccccgttggggttaccggacttgacagatgacgatttgcagtgtatgatggaagacagtgattttgatggcgatggggctcttaatcagatggagttttgtgtgctgatgttcaggttgagccctgagttgatggaagccatcttggcttttgttttgaagaagcttttcaacatgaattcaaggattttcattg

SEQ ID NO: 5726 - DNA, 526 bp, Gossypium hirsutum
  Clone ID: uC-gsronu33B099d04b1
agaagtttggttagggaacctatggcgttgtttataaggctcgtgatcgtgtcaccaatgaaacaattgctttgaagaagattcgcttagagcaggaagacgagggtgtacctagcactgcaattagagaaatctctctctcgaaggaaatgcaacatggtaatatcgtcaggttgcaggatgtagtgcacagtgagaagcgtttatatttggtatttgaatatctggacttggatttaaagaagcacatggattcatgtccagaatttgggaaagatccacgaatgataaaaacattcctttatcaaattctccgtggtgttgcttattgtcattctcatagggttctccatcgggatctaaaacctcaaaatttgctgatagatcgccgtaccaatgcactaaagcttggtgattttggtctggcccgagcatttggtattcctgtcagaacatttacacatgaggtcgttactttgtggtacagagcacctgaaatactggttggatctcggcattactctac

SEQ ID NO: 5727 - DNA, 448 bp, Gossypium hirsutum
  Clone ID: uC-gsronu33B099d05b1
ggatggttcttgctgccaccctttgtcttagacgtgccccacgtgctagaccgcaaatgggcgttgttgtgaagctcctacaaggtgatgctgatgtgaccaagtgggcaagattgcaagtgaatgcatccgaaggatccgatacattggatgatgaagcttgtcctggtcggtccaaccttcaatcccatcttagtctcgcattgcttgatgtggaggaagactcggtctccatgagcagcatcgagcaacctgtgtcgttagaggactacctcaagggtcgatggagccgttcatcaagctttgactaacttcattaccgccagagataagctgcaaaataagcattcttccatttatggatcttttcacccatccttgtatattctttcggttccttgtttgacttttcaatggcattgctcattgcttacggtaggtgttggat

SEQ ID NO: 5728 - DNA, 443 bp, Gossypium hirsutum
  Clone ID: uC-gsronu33B099d06b1
ccatatttgttttagaaaaagaagagatgggagttttaggcaaagtggtggatgggattctattgctaacattcgtgtccatgtcggtggtgccagcgtgcttggactcccaggtacttttgcctaaagcccttttccccgatgtgctgggtcgtgtatatacatggtatacgacaacataccaagattatttgctgttggacgagcctcattttttcatggcacttatgaaattggagcttgttttagtattgccgctcgctatacttaacacttatggcttgttgacctccaagccttggttcaacaccacctgcctcatcttcggttctgctcttgttacctccacgacagctatggtgggagacatgctgggatccgacaagccatcagcaggtaaattggcatcgatgtactccccttttataggatttgggttccta

SEQ ID NO: 5729 - DNA, 467 bp, Gossypium hirsutum
  Clone ID: uC-gsronu33B099d11b1
tttcactttgtccgttccagtgctcatcaacaatggctatctctttgctttccaagttctctactcaaaccctactcattgcgtccattttcgtagtttcagctctgggtcacgatttctccatcgtgggctattcgccggaagatttgggttctgccgataaactcattgagctcttcgagtcatggatatcgaagcacggaaaaatctacgagtccatcgaggagaagctaatgaggttcgaggtttttaaggataatcttaaacacatcgataagaggaacaaggcaatcagtagctactggctggggttgaatgagttcgctgatttgagtcatgatgagttcaagaaaatgtatttgggactcagaccagatgttagacgaaaatcccagtcgactaaagactttagttatggcgatgtggctgagctgcccaaatcccgtgattggcgaaataaaggagct

SEQ ID NO: 5730 - DNA, 329 bp, Gossypium hirsutum
  unsure (1)..(329): unsure at all n locations
  Clone ID: uC-gsronu33B099d12b1
tagtttancaaataaaaaaaaaaaaaaaanaaaaaaaaaaaaaaaaaaaaagggggtcgggtttaggggccccgatctccgcacgcgaggggggggcgctatactgttctagggtgacctccattatatcccccgcccggtttttccaggggggactgggaataacactgtggggccccccctttttagcgttgtggcgggtatccctcttgcgccctctggcttaattgcctaggggcctacacctttcgctcttcatcacaggttgcactctcaggggggcactggggctctctctctacagttgcctctttaggaggggggggtgg

SEQ ID NO: 5731 - DNA, 375 bp, Gossypium hirsutum
  Clone ID: uC-gsronu33B099e05b1
cccacgtgtctttaaaaatataatggttggttttttttcttcaattgtttacttagcattagttagttcacattagcagctacttaattgttattatttttcttacctaataaacaattttacagttaatatggaatagaactttaggaggtccattaaggttgtctctgctatcattggcttgccatgtttttattctatattattaatgaaaagcttgagttgaattcgctgctggatggctccaggtctatcaacgacttggagttcattttagaggaaaaaggagagagcttttataatccttatattcctggggttatagaaggggttgaccaaacaaggtttagttgaggaaagtcagggagcttgtgt

SEQ ID NO: 5732 - DNA, 350 bp, Gossypium hirsutum
  Clone ID: uC-gsronu33B099e12b1
attgcctacctgttgctgctctaattgatgagaagatcctttgcatgcatggtggattatctcctgacttgaaaaaattggatcagatccgtagcatttctcgccctgttgatgtgccagatcagggccttctctgtgatcttctttgggctgatcctgataaagatcttgatggctggggagagaatgataggggagctccatatccatctggcgctgacatagtttctgaattccttaagatacatgactcttgatctcatttgccgagctcaccaggttgtagaagatggctatgagtcttttgcaaagcgactgtctgtgaccctaattctacgcttcaatctact

SEQ ID NO: 5733 - DNA, 529 bp, Gossypium hirsutum
  Clone ID: uC-gsronu33B099f11b1
gaaagatcctacccatgcaatcaccaccggagaccatggccactccttgcccacgcgaagaaaatgtctacatgggcaaactggccgagcaagccgagcgctacgaggagatggtcaagctcatggagaacgttgtctccgccgtccccgctcccgacgaactctccgtcgaggaacgcaaccttctctctgtcgcctacaagagcgtcatcggcgcccgccgtgcttcctggaggatcgtctcctccatcgagcagaaggaggaaggccgtggcaacgccgaccacgtcgccgtcatccgtgactacagggccaagatcgaggccgagttgtccgagatttgcgctggaattttgaagctccttgacgagaaccttgttccggctgctggaaacggggattccaaggtgccctatctgaaaatgaaaggagactaccataggtacttggctgagttcaagactggcgatgacaggaaatctgctgtcgagaataccctcactgcctataaatctgctcaggacattgc

SEQ ID NO: 5734 - DNA, 476 bp, Gossypium hirsutum
  Clone ID: uC-gsronu33B099g01b1
gtctgaaaatgtctcttccatggaggctttgtctttgtctcctcctatgtctccgccggttatcctaacccaagacgaattaaaaaaaatcgccgcttacaaagccgttgagttcgtggaatcaggcatggttctgggtctgggcacaggttccacggccaaacacgccgtcgaccggatcggcgagttgcttcgtcaaggcaagctcaccaacatcataggaatccccacctccaaaaaaacacaagaacaagctatttctttaggtatcccactttcggatctcgacagccaccccaccattgatatggcaatcgacggtgctgatgaagtggacccgcatcttaatttggtgaaaggcagaggtgggtctctgttaagagagaaaatggtggaaggagcttgcaagaaatttgtatgtatcgctgatgaatccaagttggtcaagtatttgggaggcaacggtttggttttcc

SEQ ID NO: 5735 - DNA, 358 bp, Gossypium hirsutum
  Clone ID: uC-gsronu33B099g05b1
cccacttgtcctcccacgcgtccgaaaaaacagcgtaggctacaatccaagttcaagattcgaagatgtcgggaagaggaaagggaggcatgggactgggcaagggagactctacgatttctattggcttttggcaattctatgttgtttaaatttggcaatttatctggtttttgctaaatggtatgtgtataaggataagaggcttgctgatgaagggattgaattggaagaatcggaacctaccttccactaaattaattaggtttcattaagattttgtgtttgtacctttgtataagtaccatgttaatttattgctgacagttaagctgtaaaaaaaaaaaaaaaaaaacaa

SEQ ID NO: 5736 - DNA, 480 bp, Gossypium hirsutum
  Clone ID: uC-gsronu33B099g07b1
cccactcgttcgcccacgcgtccgcgaaatctgacaaaattgatggcctcacgtgacaagaaatctgcgaagccgtcgagcagccgcgccggtggaatacgcacgctctcggatctgaaccggccctctggacccgattccgacagcgattccgatgatccccaggagtactacactggtggcgagaaaagtggcatgcttgttcaagatccttcaaagaaaaatgatgtagatgaaattttcaatcaagctaggcaactgggagctgtagaaggtcctctcgagcatcctcgtccatcaagttcaacaagttttactggaaccggtagattactctcaggggaaactgttccttctgcacctcagcagcctgattccattattcacaacataagttttctggaccaacggttttacccgggatgatggccctcttgggagggtgggaggatccctgaaatgccgcatttttagagagca

SEQ ID NO: 5737 - DNA, 320 bp, Gossypium hirsutum
  Clone ID: uC-gsronu33B099g10b1
tccactcgtccgattatgtgtaggggcatttggccttacctttgcagcttcaaatgtgtggattccgagtcttattcggttaacatgttgcggagttggtggtgttcttcttctgtctggtttgattgtgctcacctgtatagatcaagatgatgcatggcataatttcggccataccggaggtttcatatgcccttttgttccacttctaccaattgtctgcattctcatcaatgtctacctgctcatcaatttgggggctgcaacatgggctagggtatcggtgtggcttttgatagggtggttgtttatgtgttctc

SEQ ID NO: 5738 - DNA, 466 bp, Gossypium hirsutum
  Clone ID: uC-gsronu33B099g11b1
ttggcctccagaatcgacggcgattcctcccgaaaaatcatccccgacccgacccgaataaccaatccctcgataactcttcggatcctcaatccttgctccattccaggtttttaaaagtctaagcgcaatggatgatgtaactgatttgactggtgatggaggtgttattaagaagatcgtagcaagagccaaagtgggtgcgctcgccccttccgaggatcttccgatggttgatgttcattatgaaggtaccctagctgaaactggtgaagtttttgatacaacacatgaagataactctgttttctcctttgagcttggaaagggcacggttattcaggcttgggacattgctttaaaaactatgaaggttggtgaagttgcgaaaataacttgcaagccagagtatgcctatggtgctgccggatcttcccccgatatcccacccaatgctacccttatt

SEQ ID NO: 5739 - DNA, 359 bp, Gossypium hirsutum
  Clone ID: uC-gsronu33B099h08b1
ttccacttgtccgtcggcatcgaagagtgcttcagtgccattgtggcagcagaggacgtatgtcgaggaaaacccgatccagaaatgtttctatacgctgcacaacttctagaattcattgcagagcggtgcattgtattcggaaactctaaccagaccgttgaggcagctcatgaggcacggatgaagtgcgttgctgttgctaacaagcatcttgtctatgagctcagggctccagacttggtggtaagacgtttagacgagctttctattgtcgatttaaagaaccttgcagatatagagtcggctgaatttggatccgtttttcctatcccggagatggagattgaggaggatcc

SEQ ID NO: 5740 - DNA, 128 bp, Gossypium hirsutum
  Clone ID: uC-gsronu33B100a01b1
ttctgtaacagagtccagttttctttctagcaagccagaaatagtgagtgagcaacccaaacgtattacaaaaagatttgcgtctgaacaactgtaaacagaggcaaagaaatttgtctttaaatttt

SEQ ID NO: 5741 - DNA, 326 bp, Gossypium hirsutum
  Clone ID: uC-gsronu33B100a06b1
gacggacggacccagcgcgatcgcagcattaaatccggatgaaggtggataccatgtactgcttgctaacatatacgcaacagcttcgatgtggggtgaagtagccaaagttcgaactacaatgaaaagaaagggcttcagaaaacgcccggctgcagtgtagatgagatgcgaaacgcaagttacactttctactttttaattataaaccccccccagcttaccaagaattactgcttacctcgaggagcttggaaataagatcctagctgtcggttatgttcctgacacaagttcgattcatgatgtggaagactacattctaa

SEQ ID NO: 5742 - DNA, 496 bp, Gossypium hirsutum
  Clone ID: uC-gsronu33B100a07b1
tcgcccctcgtccgcccacgcgtccggataaatactatagaaatccaagaaaaaaaatttaaaaaaacccctaattctataaaaagatcgaattaaagtagaatcagaagcataaatcgccgaggaaaacaagatgccggggcagcaagaagatgataagatgcccggtgatcagtccgtggttcacatcaacctcaaagtcaaaggctaggacggcatttgtttctcttttaagaccttattttttacatccctttagatactcttctacttcccatctcttctcctttctactcttttccactttcttctttactatcttcctttcctaatctattcttccactttcatctttctctctctcctcctccttccttttcatttctccttacctttctttcatttccttctattcctttttcagctcccttctcttctctcttcttataacttttatctttttatcttttactaccatcttccacttcaccttttc

SEQ ID NO: 5743 - DNA, 186 bp, Gossypium hirsutum
  Clone ID: uC-gsronu33B100a10b1
ctcggtcgatataaaaggctttcatctttgagttggagtcgttccttttagagatctgctcctttggcacattttcccggcgttttcttgatccgaattgatgatcgatgatgaacttctgatactcctttacccatattcttttcttttctttttatctactttacttctttcttctcttctctt

SEQ ID NO: 5744 - DNA, 602 bp, Gossypium hirsutum
  Clone ID: uC-gsronu33B100a11b1
tcggtgcatgcactttgagattggtggagacaagaaggggaaaggaacatctctgttttaaacgtgttattcatggtatcttgttatgtttgctttactttatatggagtagtttgaacttacaagacttgaatggaattatgtcctgttagccaaggctcttaccaatatgttcggcgggaaaaccaccattacaacgcaatcaatcacatttccctctcaaaacccccgtcaaaacttaacttctggttgtcctgttctagtgtcttaatccttcctttcctctcttttctatgttatttttttttttttccagtcatttaatttcaatttattgtccttctcttttaaagattccattctgcaatatacttttttgaccttttttaaattcctctctttttaaatctcttatttattctatctttccttatttatcttcattcccttcacactatattccttccctatctttctccttaattttttactctctacttactcattttatcttattcccatacatttctattttatatttcattttctttttcactcttttttcttaatcttatcttcttttttctccttttaatttttta

SEQ ID NO: 5745 - DNA, 216 bp, Gossypium hirsutum
  Clone ID: uC-gsronu33B100b02b1
gatgctccagctgttaacgatggcaagtgcaattgcggtactggctgcagctgcacagactgcacctgtggccactaagccaacatacaatggtcatgcttcagatcatggcatatatagggatctaaataatgaatttaaggttgaataatttgtgtctgttgtagtttgcgtggcgacttatatctgtctgttaactctatctctcctttactt

SEQ ID NO: 5746 - DNA, 451 bp, Gossypium hirsutum
  Clone ID: uC-gsronu33B100b03b1
aaattttctaaatttttaaaaaaaaataaaaaaataaaaaataaattaaaaatttaaaaccaataaaacacccactaaactaaataaaatctaaaacttctattcctatcctcttttttgggggcttccctcttggggttcccccgtttccccctgcctttctttctccttttttttttttttgggctcccccttttttttttcccggggcggtttttcccctccggtcgttttgggtatccctcgcgcttcttctccttttctctcttctgccctccctcccttttttttctggggtcttttcctccttgttgtccccttcttttcttcttccccttttgtttttctcttcttttttcttttgtttcccctcctttctgcttttccttttttcctcttttctctttctttttcttcttttcttcctctctttctttctttcctcttcctt

SEQ ID NO: 5747 - DNA, 543 bp, Gossypium hirsutum
  Clone ID: uC-gsronu33B100b04b1
gtcgttattggagttttaaatgaaaaagacactgagggaagtgatagagaagtataatttaaatgtgcgaatcaccccgaaccaaaacctcattttgtgtgacattcgtagtgcatggaggcgtcctattaccacagttctcgctcaagctgggttgctgcatcctagatatgtggaccccttgaacttaaccgctatggcgtgcccggctttcccactttgccctttggcaataaccgaagctgaacgaggtatccccgacatcctcaagcgtgtcagagctgtctttgagaaggttggactcaagtacagtgagtccatagtgataagggtaactggttgccctaatggttgtgccagaccatacatggctgagcttggactagttggtgacggtccaaacagttatcagatttggctcggaggaacaccgaatcaaacccaattagcaagaacttttatgaacaaagtcaaagttcaagatctcgaaaaagttttcgagcctttattctactactggaaacgaaaagacagcccaaagaa

SEQ ID NO: 5748 - DNA, 89 bp, Gossypium hirsutum
  Clone ID: uC-gsronu33B100b07b1
caggctcagaaaaaacgaagagctcatcgttgatggataacttattgggccttcttcggattcggattaaacggggcgttaacctcgcc

SEQ ID NO: 5749 - DNA, 285 bp, Gossypium hirsutum
  Clone ID: uC-gsronu33B100b08b1
tttcgcacatctctcaatggtgcagtagaacagatgtacactgagatggcatctcgtcacagggtgagatttccatgcattcaaatcatcaagacagctactatcccagcaaaactttgcaagagggacagcaccaagcagtttcacaactccaagatcaaattcccactggtattcaagaaggtcagaccacctactaggaagcttaagacaacatacaaggcttccaaacccaacttgtttatgtagtagcccataattgatgatggcagggcaaaaggcctt

SEQ ID NO: 5750 - DNA, 129 bp, Gossypium hirsutum
  Clone ID: uC-gsronu33B100b09b1
tgttcggtgatagtaccctttcatcggtatttgatggaagacccgttcatataattggagagatcaatgccttgttgaataccggagttagcgcccatgttttgacttacatctagcgctttgctctct

SEQ ID NO: 5751 - DNA, 110 bp, Gossypium hirsutum
  Clone ID: uC-gsronu33B100c04b1
ccacgcgtccgcacattcactgcttcttctgtttcaacatctatgggaaaaccaagtgctgctaagatgaaaactgctagtgtctgatattggatgaactgttcttgtaa

SEQ ID NO: 5752 - DNA, 203 bp, Gossypium hirsutum
  Clone ID: uC-gsronu33B100c05b1
ctggatctggattaaattattagcggtgaagatactcgaacaactctgatgataaaaaatattccaaataagtatacctcaaagatgttgctggctgccattgatgaaaatcatcagggaacttacgaatttcctctatatgccaatagattttcagaattagtgcatcgtgggctatgccctttattatcatgctgcctcct

SEQ ID NO: 5753 - DNA, 287 bp, Gossypium hirsutum
  Clone ID: uC-gsronu33B100c12b1
gcaatttcctccggcaagtcgatctcgaaggagagacgataactggagaaagggaaggaaaggaaggagcagcggcagcattagtagtacgctacagtactatcacataaagcgtaacaaacaaatccccagcgtcaaaagaatcctcctctctcgctttcgctctccgttagatctttcctttcctctctttcgtctttcttttagttatagtttcagcttcttttatctgcctcgatccccagtgaataattataatttgaaagttgaagaaacgaaacaggggg

SEQ ID NO: 5754 - DNA, 545 bp, Gossypium hirsutum
  unsure (1)..(545): unsure at all n locations
  Clone ID: uC-gsronu33B100d05b1
cccacttcgtccgtccacgcgtccggttcaattctctcatcccttgttttccttctaagccaaacgaaatctaatcatttttgaaaaatggcaccaaaagctgaaaaaaagccagccgagaagaagcctgcggaggagaagaaagccgtagctgagaaagccccggcagagaagaagcctaaggctgggaaaaagcttcccaaggaaggcggagcggctgccggagacaagaagaagaagagagttaagaagagcgtcgagacctacaagatctacatcttcaaggtcctgaagcaagttcaccctgacatcgggatctctagcaaagctatggggatcatgaacagtttcatcaatgatatcttcgagaagcttgctcaagaagcctctaggctcgcgaggtacaacaagatacccaccatcacttncagggaaattcagaccgctgttaggcttgtacttnctggtgagcttgccaagcacgccgtttctgaaggtaccaaggccgtgaccaagttacttcattctgaaaggctatttgtgat

SEQ ID NO: 5755 - DNA, 362 bp, Gossypium hirsutum
  Clone ID: uC-gsronu33B100d12b1
ttcgccgacttcggcaaattgacctttggccagtccgagacagggaatgaaaactgggatgatagcttgctgacaaaggaagaaatcgaggcaagaatgcagagaaaggtggaggcagtcatcaaaagagaaagggccatggcgtatgcatattctcaccagctatggaaagatgcaatgaaatcacctcacacaggtgtacccaacattcggtctggtgtattcccatggtggtggaactggttagaacgttgattaccaccaaccgatttacccgaaaaccaagccacaaagaccttccaattttacaccaaggccaaactccgaattaaagcctaatccgaggccacaatccagtcagt

SEQ ID NO: 5756 - DNA, 51 bp, Gossypium hirsutum
  Clone ID: uC-gsronu33B100e06b1
gacttccccaactatactatagtgttacctaaattaaactcactgaccgtc

SEQ ID NO: 5757 - DNA, 146 bp, Gossypium hirsutum
  Clone ID: uC-gsronu33B100e08b1
tcggttctctggtcatctactgcacaaagcatgactgcacgcccaatgaagggaatgcttactgggcccgttaccatcctcaactggtcctttgtcagaaatgatcagccccgtcttgagacttgcttaccagattgtcttggtca

SEQ ID NO: 5758 - DNA, 168 bp, Gossypium hirsutum
  Clone ID: uC-gsronu33B100f03b1
gtggttgtagactaaaacgtcgtcgcaccaggagcagtaagaacaaagaagagctagagaaccagagaatgactcatattgctgctgaacgcattcgtcggaagcatatgaatgagtaccttgctgttattagatcttagatgcctgcttcttatgttctatggggct

SEQ ID NO: 5759 - DNA, 227 bp, Gossypium hirsutum
  Clone ID: uC-gsronu33B100f06b1
gttgtgacttcatgaattcattgaattggtacgagctgagaactacatgcgcgctatttcgtacgctcgaaggtacctttccccatggggagcaactcatttgaaagaattgcaacgagtcatggcaactttggccgttagaagccacactgaatgtgcaaaatacaaggttttgtttgaacctaagcagaggtacttcctggtggatcagtcttttacaataattt

SEQ ID NO: 5760 - DNA, 472 bp, Gossypium hirsutum
  Clone ID: uC-gsronu33B100g02b1
gaaggctgaaatcgtgcctggtgttctctttatcgatgaggtgcacatgcttgacatcgagtgcttttctttcctgaaccgtgctcttgagaatgagatggcccctatattagtagttgctacaaacagaggcataacttcaatccgtggcacaaattacaaatcccctcatggaattccaattgatcttcttgatagactactaatcatcactactcaaccttattccgaggatgaaattcgtaagattctagacatcaggtgccaagaggaagatgtagagatgtctgaagatgcaaaacaactgttgaccaaaattgggcatgagacctccttgagatatgctatccatctgatcacagcttctgcactgaattgccagaagcggaaggggatgggttggataagttcaggacatcactcgtgtttacagtctattttctggatgaaggagatcaacgcaatacttgat

SEQ ID NO: 5761 - DNA, 145 bp, Gossypium hirsutum
  Clone ID: uC-gsronu33B100g07b1
tgcaagcgcctgcatggcaccagtgtccgaattgaccggacggacccacgcgtccggagatttgcttagtgatgtcatatatatataagaggagcagatgcttgacatcgagtgcttttctttgctgaaccgtgctcttgagatt

SEQ ID NO: 5762 - DNA, 188 bp, Gossypium hirsutum
  Clone ID: uC-gsronu33B100g11b1
tcggaccctgattggtactatataagagctgcttccatggcaaggaaaatctacttgaggggaggtcttggctgtcttttcttccttactccttttctcttgcttcttttccaatcatttttctctttttctttttttttttcttccttcttttcttttatttttttcttcatcttttttttcatctt

SEQ ID NO: 5763 - DNA, 105 bp, Gossypium hirsutum
  Clone ID: uC-gsronu33B100h01b1
gccctcctttctcatcttgtgatttgagcttcgtgtttgtgttgggataagcaattccccaagatgcataacgaagagggataaatcttggatcttttcatacct

SEQ ID NO: 5764 - DNA, 232 bp, Gossypium hirsutum
  Clone ID: uC-gsronu33B100h02b1
atatttagaacaaagcgaagagagagtgatataattgcaagcacacgatactgcttattcattttgatggctcaaggagattctaacttccagcaagacatggctaaagaggaagaagaacagaggctgaaatacttggaattcgcgcaagtagccgccgttcacgccgctttgtgcttcaccaacctttacctttacgctaaggaaagatcggggccgttgaaacctagcg

SEQ ID NO: 5765 - DNA, 314 bp, Gossypium hirsutum
  Clone ID: uC-gsronu33B100h03b1
gacgtagaggcactgcagtggccgggggattagaactttatgattgactgatcacacaaccatcccaactgactcgttgtaggagggaatcgatttttactctaccattacccgtgccaggtgggaagaacttaacatggatctattcaggaggtgtatggaaccagctgaggaatgtctgagggatgctaagatggacacgagcactgtgcatgatggttgttcttgtgggtggtttcacttgaattgcaaaggtccaacaacttttacaagatttttttccatgggaagggtgctttgccagagcaatcacc

SEQ ID NO: 5766 - DNA, 225 bp, Gossypium hirsutum
  Clone ID: uC-gsronu33B100h09b1
acggtctcgtgggttgactctgggcacttgtatatcaatggcaattccaagtttttttgtttcctttaccaagatccttgttgggttttgccttctttgtatggtacataaagattttgtggttgccggttttgaggaggttcgttttgctcatgatacttgtgatccttctaccattggtgcatttactgctgctcgaaactgttgaaacttatcatatatatt

SEQ ID NO: 5767 - DNA, 260 bp, Gossypium hirsutum
  Clone ID: uC-gsronu33B100h12b1
tcgaaagactaaatggacattatggggttggagcatttgtcattggaaacacaatttcatccattccttacttatgttttatctctttaatcccgggagcactagcctattacctggttggacttcaaaagagttctgatcactttatctactttgtcatatctgctcttcactagcacgatgctggtcgagagcataatgatgactgttgcaagcgttgtgccgatctatttcatgggaatcatctcaggagttggtat

SEQ ID NO: 5768 - DNA, 208 bp, Gossypium hirsutum
  Clone ID: uC-gsronu33B101a01b1
taattctttccagtttcaattttctcacaacaaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagt

SEQ ID NO: 5769 - DNA, 215 bp, Gossypium hirsutum
  Clone ID: uC-gsronu33B101a03b1
ctcagtcctaaacagagatttgtcagagaaggagctccaaatgaaaacaaggagagaaattatggttcttggggcccagttgggtaaaacaaacatcgcagcatgggctagcaaagaggaagaggataaggatgcatccacttcactgaaaattgtagcaccagaacaaccatctaagagtgtcattgaaacccgtgcagcattatgggaggaag

SEQ ID NO: 5770 - DNA, 146 bp, Gossypium hirsutum
  Clone ID: uC-gsronu33B101a04b1
ttcatttcccacatgaagccaaatagcatccttgggctttcccatggatttcttcttggccatttacaatcggtggggcttgagtgtcctaagaccatccagtgaattgctgtctgcccgaagggaatgggaccttctgtgaggag

SEQ ID NO: 5771 - DNA, 317 bp, Gossypium hirsutum
  Clone ID: uC-gsronu33B101a05b1
taggtttggacccaaatttttgaatgctagtggcggttttggtggatcctgctttcagaaggatattctaaatcttgtttacatctgcgagagcaatggccttcctgaggtggcagagtattggaagcaagtcattaagatcaatgactatcagaaaaaccgatttgttaaccgtgttgtttcctcgatgtttaacaccgtttcaaacaaaaagattgctatcttagggttcgcctttaagaaggataccggtgacactagggagacccctgctttcgatggatgcaaaggactcttgggagacaaagctcgattga

SEQ ID NO: 5772 - DNA, 51 bp, Gossypium hirsutum
  Clone ID: uC-gsronu33B101a07b1
tctgatatcttatcctttgtttatttccctgggggacagtttgttgatgaa

SEQ ID NO: 5773 - DNA, 240 bp, Gossypium hirsutum
  Clone ID: uC-gsronu33B101b01b1
ttcattcgtccgaaaaaaacctagaactaaaaaatttcctttgtttccccttgtttccagccgaaaggctaattccccaggcctttaattgccaccgagaccgactgcgacaatcgaagcagggccttccagtggtgcgtgcgcgatgtaactctggttgtggagttgtggagaacgaacagcgcatagcgcgggtgcgaacatggagcgaggcacatggggatcgtgcgcggaggcgct

SEQ ID NO: 5774 - DNA, 161 bp, Gossypium hirsutum
  Clone ID: uC-gsronu33B101b03b1
taagtaagtgacctttggcccctctggtctgaccactgaagttaagtctgtcgtgatgcaccatgaagccctctctgaggctctccctggtgacaatgttggattcaatgtcaagaacgttgctgttaaggatctcaagcctggattccttgcttcaaacc

SEQ ID NO: 5775 - DNA, 169 bp, Gossypium hirsutum
  Clone ID: uC-gsronu33B101b06b1
ttccttcccctaaaaaactctcactcatataatttaaattcgaagaatctgctacatcaatgggaaatcacaaatcccatttctcttccttacattcttttctttccttttcaacaattgcatcttttgcttttgaccccaacttctgggtttcctcttcctgtccatc

SEQ ID NO: 5776 - DNA, 188 bp, Gossypium hirsutum
  Clone ID: uC-gsronu33B101b09b1
tcgtaaaaccttttatgctaaatcttcaggtctgttattcctctatacttttaagacgactgctttatgttatgacaatcttatgctccaaaaaaaaaaaaaaaaaaaaaaaaaaaaaaaaaaaaaaaaaaaaaaaaaaaaaaaaaaaaaaaaaaaaaaaaaaataaaataataatatatatttaaaa

SEQ ID NO: 5777 - DNA, 256 bp, Gossypium hirsutum
  Clone ID: uC-gsronu33B101c04b1
tgtacttttttgtctgtcagactctccacttcccgaaaattgttcctgacgttaaagtcaaagcagttatagggtatggcatttattgtaccctactttttttattgatttatttcaaacgctttctttttgttctctttcctctattatcaccttccttttaccatctccattattttgctcatctctgcaacatcaaatcctttttcttcttttttcagcttatcaaacacttttcgtttccaatttccttttt

SEQ ID NO: 5778 - DNA, 266 bp, Gossypium hirsutum
  Clone ID: uC-gsronu33B101c08b1
tgttcgttcacgcgtccgcccacgcgtccgagagtttgtgggagttaaagagattattgcatcaatggcttctttgcaatgccagaaaaccattgagaaaggcttgggtcaaggatactatggtggcggttctagttggggacgccaggccactaaaatgtataactctttccactatggttatgctacgtctcacatctattttgaatcccactcacaatttccgctgcaccacctatggattgtgccttattctacactactta

SEQ ID NO: 5779 - DNA, 262 bp, Gossypium hirsutum
  Clone ID: uC-gsronu33B101c09b1
tcgtaaaaaaggagttaaaaatggcttgtcctccaactcacaaagtggtaaaaggtgagcttaagaatggttctgatgactgccttgcgagcttgatgtattcgaattaccaaggtgctccagtaacgattaaaaaagattcattacccactccatttgcgcagaatatgctagtcgacggtctgtacggaggcctggtgtatgatgttgttagggttacttttatatctcttttctcttctttccttatatttttttttct

SEQ ID NO: 5780 - DNA, 164 bp, Gossypium hirsutum
  Clone ID: uC-gsronu33B101c11b1
tcgctcacgcgtccggcagttcaagcacggtcgaggcggtgttggacgcaatttggagaaagctctcgtctcttttctgaaaggctctgcgcgtggctccacgcttgccatggccgatgcggggcttgtttactgggaaaggggttagaaggatgaggctatcg

SEQ ID NO: 5781 - DNA, 87 bp, Gossypium hirsutum
  Clone ID: uC-gsronu33B101d01b1
tatgttgcttaagcgcgcgacctatacccggccgtcggggcaagggccaggccccgattagtaggagggcgcggtggtccccttaaa

SEQ ID NO: 5782 - DNA, 81 bp, Gossypium hirsutum
  Clone ID: uC-gsronu33B101d07b1
tgcgacgttatagctttcctattgggctacctaaattcaattaactggccgcttttctacaactcctcttcctggaaaaac

SEQ ID NO: 5783 - DNA, 100 bp, Gossypium hirsutum
  Clone ID: uC-gsronu33B101d10b1
tcgataaaaaagcagaagatattgttgggttattgaagctagctagctccacatttcctatggcttcaaagcttcatttgattgctgtccttgttcttga

SEQ ID NO: 5784 - DNA, 171 bp, Gossypium hirsutum
  Clone ID: uC-gsronu33B101e06b1
accattcgtccgcccacgcgtccggttaaattcagctatggctgcacaactcgtttggaccccaatcgatgttgtgagccaaaagacttatggttccaaggtttacaacaatagtaacagctgtatgaatgcaatttcaaacgtgctttcttgtctatataagaatggtct

SEQ ID NO: 5785 - DNA, 178 bp, Gossypium hirsutum
  Clone ID: uC-gsronu33B101e10b1
tcgtacaaacccaaatctccaattgatctgtttcatttttcagcaaagctagaaaaacaatgactaaggatatcgagactgcagagcaacatggaggggagttttcgttcaaggactatcatgatccaccacctgtctcattgattgatgctgaagagttaaccaaatggtctgttta

SEQ ID NO: 5786 - DNA, 394 bp, Gossypium hirsutum
  Clone ID: uC-gsronu33B101f01b1
cgcgagagaggtttttgagattttctgtctttttatttcaaaaatacaaaaaatatatattttttaaatgaactaaaactcccgcacaagtttcaaatcctcccaactcagttcaagcctagttcaataaagctacagtagggaagaagaggctttgaagtttctctaatggaaaagagagtgtgtgaagtttggaaaggaagtaataagtttatccttggtgggaggctgatattcgggccagatgcttagtctttgcttgttaccttattgctgatcactgttcctgttatcattttttgggtttttgctgcatggcatctttcgttcccctttttttcccatatttatgcttcgatttttcatttcttgtctgttcacatctccttttacc

SEQ ID NO: 5787 - DNA, 180 bp, Gossypium hirsutum
  Clone ID: uC-gsronu33B101f03b1
tatcttccacttcttctcttctttgaactcaaagtcccagttaatattagaattatgggtgttgccacttatgactatgagtctacctccccagtcgccccttccaggcttttcaaggcctttactgttgaagctccgaaagcttggcccacggctgcacctaatgcagccaagagtatt

SEQ ID NO: 5788 - DNA, 205 bp, Gossypium hirsutum
  Clone ID: uC-gsronu33B101f09b1
tcgtcacaaaggaagtgcctcaacaccatgaagaccaagttcttgctttatcccgtctttgaatctcaaaattattaagaagatggaataaactacggttgtacatgtagaaacccttatttttttccgtacgatttgttgtttgttgatgctttgccatcgttaaatcttcattgtctttctttcttttttcacctctaccttt

SEQ ID NO: 5789 - DNA, 75 bp, Gossypium hirsutum
  Clone ID: uC-gsronu33B101g03b1
ctatatgcaaagcaaacagctggaagagcttactggcaagatgagggaatgtaaaagattaatcaaggagtttga

SEQ ID NO: 5790 - DNA, 160 bp, Gossypium hirsutum
  Clone ID: uC-gsronu33B101g06b1
ttcatcgaaggggtgctctgagatcacataccaaaatggtgaaggccgttgccgtccttggcagcaatgaaggtgttagcggaactgtattcttttcccaagaaggagatggtccatctaccgtgactgggaacctttcttggcttaagactattactcc

SEQ ID NO: 5791 - DNA, 532 bp, Gossypium hirsutum
  Clone ID: uC-gsronu33B101g07b1
tcgtcacgcgtccggttaaaggaaatggtaccatttttctagctggactcacctcttgtcaaagctgctacaggagaggaagtgtctgcagaggatttagggggtgctactgttcattgtaagacctttggggtttcagattatcttgctcaagatgaaatgcatggactcgctctcgtgaggaatatattttagatcttgcacttttttgtatacttgttattttgtgctctttttctctttttatctttttttcctcctatttatttttataaatctattattttatattttttttcttctacctttttttgttttttctttttttattttctcatttttctattaatttctttatatactttgtttttttttttttttctatttattctctctattaatctccttattctttcttatccttttcttactttatcctttttttctcttcttattatatcttattaatcctttttcttttttcatctctttctcatctttttactaaatttatttattttcttttcttatt

SEQ ID NO: 5792 - DNA, 87 bp, Gossypium hirsutum
  Clone ID: uC-gsronu33B101g08b1
tcggttttttatggcaaaaatgagtttataattttttcaatttttaaattttctgatcttttacctatcatttattcctcccaaaat

SEQ ID NO: 5793 - DNA, 114 bp, Gossypium hirsutum
  Clone ID: uC-gsronu33B101h01b1
tttggaccttattcatttatttgggtttattaattagcaaataaattaaatgggcccatgctaaaatggttggctgaaaaacaaataaaaataaaataataattaaaaataaca

SEQ ID NO: 5794 - DNA, 397 bp, Gossypium hirsutum
  Clone ID: uC-gsronu33B101h02b1
gagattgccccggcagagaagaagcctaaggctggtaaaaagcttcccaaggaaggcggagcggctgccggagacaagaagaagaagagagttaagaagagcgtcgagacctacaagatctacatcttcaaggtcctgaagcaagttcaccctgacatcgggatctctagcaaagctatggggatcatgaacagtttcatcaacgatatcttcgagaagcttgctcaggtagcctctaggctcgcgaggtacaacaagaaacccaccatcactttcagggaaatccagaccgctgttaggcttgtacttcccggtgagctagccaagcacgccgtttctgaaggtaccaaggccgggaccaagtttacttcatcttgaaaaggctattagttgatct

SEQ ID NO: 5795 - DNA, 259 bp, Gossypium hirsutum
  Clone ID: uC-gsronu33B101h03b1
atagcatttaccattgacctgtgccggaaaggaaataagaagattttgcttgaccatggctgacaaggcagtgactattaggaccaggaagttcatgaccaacaggcttctttccaggaagcaatttatcattgacgttctacatcctggaagacccaatgtttccaaggcggagttgaaggaaaagctctctagaatgtatgaggtgaaggaccccaattcaatctttgtgttcaagtgtaggactcattctggaggt

SEQ ID NO: 5796 - DNA, 415 bp, Gossypium hirsutum
  Clone ID: uC-gsronu33B103a02b1
gttatattcttagtctcttacgaagtgaaactatggctcaacttaagaagatggattgcgaaatagtgatcaagacaccagctgataagttctacaataccttcaggaccaaatcccatttgataccaaagatgtccaacggattaatgatagatggcaaacttcttcaaggtgattggaatactgtcggctgtgtcaggctctggtcttatgtttccgaaggtaagtctgagatggttaaagagatacttgagaacgttgacgacgaaaacaagacaatggttttcaaagtggcggagggtcaaatcttgaactattataagagttggaggagcatctttaacatcacgcccatgggtgaggggagctcggcgaaatggactatggaattcgacaagcagatcgagatcatccc

SEQ ID NO: 5797 - DNA, 541 bp, Gossypium hirsutum
  Clone ID: uC-gsronu33B103a03b1
cccacgcgttcggcgatttctccagtatcttgataatagacaccaacacagatatctgtccccgtatgcactcagaaggctgtttcgatgacaaaagtatagcgcgctaaaaacttttctttcatgtaatggaatataataatatttcagcgtttgcatggaatgttgatgaacataatgtaaaaggcgagaggattctattataggttggagagcaatgaagatctctactattttatcttgaggtgattaaagtaccttggtccttaacccgttgaccatttgggtactttcactttctagcgtcacatcgcaagccaatattgtcttcttttgagtacctgcaagtctctcaagatccctccattcggtctggcagggcaggtgggtacttgaagaagacaataccagtttgtgatcactatgccaacacagtgcaactacccagggaaatgatagtattaggttggtcggtgagtcgtgacggttgtacaggcatgtcaaaaacatcaacaataaagatgaatgaattcacctaaaa

SEQ ID NO: 5798 - DNA, 486 bp, Gossypium hirsutum
  Clone ID: uC-gsronu33B103a08b1
ctgactcgtgggaggggacaatatgacaagggaacagatagaggatgagattaaaaaaataaaagaggcacatgccgaagatgaggaatttccagatgaagtggatactccactagatgttcctgctagaaagcggtttgcaaaatatagaggccttaagtcttttaggacatcctcgtgggaccccaaagaatctctacctccagaatatgccagaatttttgcttttgatagttttgccagaacacaaaagcatgttgttgcacaagctttaaaagtggagcaagagggcagggatgactgtgcaccagttggttcatttgctaggttttatatcaaggaggttccttttcatgttgcttccaacttgtgtgtggcctcaagaactgcacccattgttttatgtggtctcctgcaacatgagtctaagatgtctgttcttcattttagtataaaaaagcatgataggtatgatgctccaattaa

SEQ ID NO: 5799 - DNA, 169 bp, Gossypium hirsutum
  Clone ID: uC-gsronu33B103a12b1
cccactcgtccgagatgaccaaatgggtttgaaataaaaatgttagggatgtgtggaagattatatagtatttgccattaatgcagtcttgttttgctgcattgcttttttttaaagcaattttattttaaaaaaaaaaaatacaaaaaaaaaaaaaaaaaataataat

SEQ ID NO: 5800 - DNA, 261 bp, Gossypium hirsutum
  Clone ID: uC-gsronu33B103b03b1
gtttgtcattatctgtcaagaggaaaactgacctggttcttattccaactccatatcatggatctaaaattgttcattagaaccacaaagatcatttggttggtttcctctcagtatcatattaatagtacttgttcctgtcatgtctttggtaaaacacaataagcttacgccgcctatttctttttgttaatgttaatgaaacatggaataaccggagttgaaccggtgcttggccctaaaaataaacaaaacttaaaa

SEQ ID NO: 5801 - DNA, 471 bp, Gossypium hirsutum
  Clone ID: uC-gsronu33B103b06b1
gcagtttcagagggggaaaaaggaagaaaaaaaaaggctaaaaaaatgtttttgcgaatgatatcgcggccgttgttggctaaggtgaaggagacaacggggatcgtcggattagacgttgtccctaacgcaagggaagtccttatcggtctctacaacaagactctgaaggagatccaggccgtacctgaagacgagggttaccgtaaggccgttgaaagcttcacgcgccaccgtctgaaggtttgccaagaggaagaagattgggaaatgattgagaagcgccttggatgtggccaggtcgaggagctcatcgaggaagcgcgtgacgagctcactcttatcggaaaaatgatcgagtgggatccatggggtgttcctgatgactatgaatgtgaggttatcgaaaatgatgctcctattcccaagcatgttccttagcaccgacctggtcctctttcgaggagttta

SEQ ID NO: 5802 - DNA, 510 bp, Gossypium hirsutum
  unsure (1)..(510): unsure at all n locations
  Clone ID: uC-gsronu33B103b11b1
ttatatgctcggtcttgagacctatcctggtgttaaacgcatcaccattaagcctcaaaccgataggtgggtcttccctgaaaccaaaactggcatcattgtgttggctgaaggacgtctgatgaacttgggatgtgccactggacacccaagttttgtcatgtcctgctcgttcactaaccaggtgattgcccagctcgagctatggaaggagaaggcaactggaaaatatgagaagaaggtttacgtattgccaaagcacctcgacgagaaagttgctgcacttcacctcggcaagctcggagctaagctcactaagctcactaaagatcaagctgattacattagtgtgcctgttgaaggtccttacaagcctcctcattacaggtactgagggggacagttaatgagtttttatcgagaaagaaaaaccatccggaggntctgaatgtttcttgctttactgaaattcatgatgctaggtttttgtttatttttagagcctttttt

SEQ ID NO: 5803 - DNA, 227 bp, Gossypium hirsutum
  Clone ID: uC-gsronu33B103c02b1
gacatttaatattaaaaaaaaaaaaaaaaaaaaaaaataaaaaaaataattaaaaaaaaaaaaacataatatacattcatattgggggccccctctgtggcggtccttctttcccccggtcttctcttggcactggtttctctttctttttcgtcctctttttttcccttccttggctttctttccccccccttccgtctttgttctcccctggccttccccccttt

SEQ ID NO: 5804 - DNA, 81 bp, Gossypium hirsutum
  Clone ID: uC-gsronu33B103c08b1
tttattcgtccgtctaaaggtaccaaataattagagtatcaaataagggatactactttatgacagtcggaacaattaagt

SEQ ID NO: 5805 - DNA, 476 bp, Gossypium hirsutum
  Clone ID: uC-gsronu33B103c09b1
ttaaactgagctttgctgaattttcgtgatcgtcgagaaagaaaattatgggaaggaaattcttcgttggcggcaattggaaatgcaatggaaccactgaggaagtgaataagattgtgagtactttgaatgctggagaggtgccttctcaggatgttgttgaggttgtggttagccctccatttgtgttccttcctttggtcaaaacttcactgagacccgatttccatgtcgctgcacaaaattgttgggtcaagaaaggaggtgctttcactggtgaagttagtgcagagatgcttgtcaatttgagcattccttgggttattattggtcattctgagaggagacttattttgaaggagtcaaatgagttcgttgcggataaggttgcttatgcacttgctcaaggcttgacggtgatagcttggattggggaaacacttgagcaacgtgaagcaggatctactgtggcggtt

SEQ ID NO: 5806 - DNA, 553 bp, Gossypium hirsutum
  Clone ID: uC-gsronu33B103c10b1
tgacgcatcacctaagcgtatcagaaggggtcggggtttcagtgagcgctactcttatgcacgaagatacagaaccccttctccagatcgttctcctgtgaggtcctctcgtttcagtggcaggattgatcgtgagaggtattcaagttacaggcggtattcacctaggcgctatagaagccccccaagaggaagaactcctccaaggtatagaggcagaagaagccggacaagaagtctgtctgtatcaccgagcccgaggtatagaaatcgtcgatatggtcatagccgcagtcgtagtcgaacctctattcgcagccgtagcccaagtcgaagtcgaacccctgttcgcagccgtagtccagttgattctccaagggctggacggcgaaggtccccttcacagagcaggagccgatcagactcaaggtcttcgttgaactctcagtctccaaagaaggtgagcaaagcaaagtcaaggtcatcatcaggcagtccagacggtggaaaaggactggtctcttatgatgatggctcacctgattcaggaagg

SEQ ID NO: 5807 - DNA, 92 bp, Gossypium hirsutum
  Clone ID: uC-gsronu33B103d03b1
aaatatattttataaaaaaaaaaaaaaaaaaaaaaaaaaaaaaaaaaaaaaaaaaaaaaaaataaaaaaaacaaaaaaaataaagggaaccg

SEQ ID NO: 5808 - DNA, 479 bp, Gossypium hirsutum
  Clone ID: uC-gsronu33B103d05b1
gcgctgatttagtaaaagaagggatgggagttttaggcaaagtggtggatgggattctattgctaacattcgtgtccatgtcggtggtgccagcgtgcttggacgcccaggtacttttgcctaaagcgcttttccccgatgtgctgggtcgtgtatattcatggtatacgaccacataccaagattatttgctgctggatgagcctcattttttcatggcacttatgaaattggagcttgttttagtattgccgcttgctatacttaacacttatggcttgttgacctccaagccctggttcaacaccacctgcctcatctttggttctgctcttgttacctccacgacagctatggtgggagacatgctgggatccgacaaaccattagcaggtaaactggcgtcgtggactcccctttataggatttgggtcctagccatccgcgagggctgtttcggaatcccccaacgcttcaaa

SEQ ID NO: 5809 - DNA, 274 bp, Gossypium hirsutum
  Clone ID: uC-gsronu33B103d06b1
cccactcgtccgctagcaatcaaatgtcaaatagaaccttatggtctgaagtgaagggcctggttctggaagcaaaatcagtcgtaaagatcccatcatttcaaattatcgttgctcagggtgttactggttcattcccctggtctgcattgtcatttgcaccgatgtggttggagctaattgggttctcccacaagaaaactgcattcctgatagccatgtttgtgattgctacttctgcggggggcctttttggtggtaggatgggggatta

SEQ ID NO: 5810 - DNA, 566 bp, Gossypium hirsutum
  unsure (1)..(566): unsure at all n locations
  Clone ID: uC-gsronu33B103d07b1
gtggatattggaccgtttccttatcagaaaccagcaactaatgttaacatgatgaatgtgcctggtgcttatgtgatgaatccctgcaatgtgcaatgcaatgatcagatgtattgccttcatcctggagtcgaaaataaaacaggagaagctgcagcactgaatggacaaggatttaatggttgtgactttgacaatattcagtgcttggcgaatcagaactctacaggtgggattggaagtgcagggtcgaatggcaattattctggcacaaaaaggaggaaaggtaaaagtttaggagtctttcttttgatttttttgcataatttatgttgatataggaatgttaatctctaatttgatttatctattatgactagtatgttggcttgagtgtagttatttacttcactagtttctggcttggaactctacaaggtgtagctatgtgcttcttttaccttgttaggactgctaataactactttttttttnggtgtgtgtgtgtctattatgaagttattccatctactggcttgttggtccacaataagggctcttgattg

SEQ ID NO: 5811 - DNA, 547 bp, Gossypium hirsutum
  unsure (1)..(547): unsure at all n locations
  Clone ID: uC-gsronu33B103d08b1
ttcactgtctctttagcctttaccctttgtttcgttgatttgtttctaaggatttaatctccaaaccttcttcccatttcttcattacattgttcaagaaaaaagaagcaaaaaaacatggccaaagttctgttgttcattgcactatgtgtgcttccagctttggttagtgctacacgcattctgaataatcaattggcggtagaaggctatgtgtactgcgatacttgccgtgctggttttgaaacccctaagactagaagcctagctgatgccatggttaggttggtatgctccgacaggaagagcggccaagttgtcttcaaaaaggagggatacaccgacaaaaccggaaaataccagattcgtgtatccgaggatcacttggatcagatctgtgatgcagctcttgtgaagagctcccagcttggttgtgccacaatgtcccccggtcgtgaacgtgcccgtgttatcttgaccaactttaatggcatttcatccaccacccgttatgccatngccatgggcctccatggtgacgagcctg

SEQ ID NO: 5812 - DNA, 313 bp, Gossypium hirsutum
  Clone ID: uC-gsronu33B103e04b1
cccacttcgttcgcccacgcgtccgggaaaaaccaaaaaaatggcgaaaccccaacttttatttctattttccttttcccttctctgtctcatatctttttccgccgccgattcctccatcatagacgacttacgtctagccggttccagtttcccgtcggttcatgcaaagaagctgattagggagttgaatttgcttcctaaaggggaagtcaatgtcgttgacgaacatcgggtttcgctgccggagggtcccaaactggcggagaagcggctcaagctcccaactttggcagcgcccggcggagtttcc

SEQ ID NO: 5813 - DNA, 412 bp, Gossypium hirsutum
  Clone ID: uC-gsronu33B103e08b1
cccactcgtccggtttcacttggctagcagccgacatgcaaatagctccatcaaaggctgacgacatgcgatcaacggctaaatccttgcccacgcaagtcgcaaccatggagatccggatcatccgtacggaggagcggggagaggtatgcttgaaagaagccgtgcgaggaaaccgctcgtgagacccaaccccctggcactgttctggcatgttccagaagcttttggtgcttgactgttggaattctttttgaatttgggctatacgggctaggggtttatgaatctgggtatttgggctggtaaaaatttgcaaaaggacattggtatttggattttcttgtctgggggtttttttaatttatttttttggtttttttaatttctatttttcattctaatggccccg

SEQ ID NO: 5814 - DNA, 457 bp, Gossypium hirsutum
  Clone ID: uC-gsronu33B103f01b1
tttctaaactttgcccccacttcaccaaacttctcagccctaaaaatcaaattgtttgggcatattccagcagccactgagtacaccacttcatcaggtgatcgatggcactccagcgacaatcgatgatgcctttggaccccttcaactacgattttcagcgaagagggcagagatccatggctgatttgtaaggttccattgtggctatggtcgcacggaaggagggaccgttcgtgggcgtggaggaggctcgaatgcttcggtactggcttcatgcgagactgctgcgcacttgagcttggtggctagggttccaaaaatctggctggggtttgagttttgggccattaggtgttgggctatttggggtaaattgggttagacctggtctcgggctcaagggatttacttgggttgtaagtataaatggactatggacatttattggattttt

SEQ ID NO: 5815 - DNA, 484 bp, Gossypium hirsutum
  Clone ID: uC-gsronu33B103f11b1
tgtttttgatagcctcatcggggaaaagatgtgtgttggaaacggcggtgaagaaagacggcgacgtcgagtatcaatgccggacgtcggaggttgtggtggagaggatggcggagtatatcgagactgacgagtgtgttgctgcttgtggcgtcgatagaaactccgtcggcatttcatcagattctcttctcgatcaacagttcaccgccaagctttgtacccctgcttgttaccaaaagtgtcccaatattgttgacctttacttcaacttggccgccggtgaagctttggtttgcaggtgtatttttgcctgatctttgcaacgctcagcgatcgaacccacggtggagcatggtggagcttatgttgagctcctgtgctgcccctgggcctgtttctagccaagccaatcgtcgttgaagcccctgccccatcccccatgtggtgatctaaattgctttccctcttttctttacttaaa

SEQ ID NO: 5816 - DNA, 170 bp, Gossypium hirsutum
  Clone ID: uC-gsronu33B103g02b1
accacgcgttttaccacgcgtacggaaacgaggaacgatcgcacatggttgcaaaggaaagattaaacaggctacagtgtatagctacgcgactctccgagagatatgagattagatgaaagactactcagacaagccactgtaacaatctgtgtagacatagacagact

SEQ ID NO: 5817 - DNA, 414 bp, Gossypium hirsutum
  Clone ID: uC-gsronu33B103g07b1
tccactcgtccgcccacgcgtccgaaaaaaaaaaaaaaaccccaaacagacaatagcctaggacaggaggatctctcagggtttaggtgatggcttcaaagcggatcttgaaggagctcaaggatctccagaaagatcctcctacctcttgcagcgcaggccctgttgctgaagacatgtttcattggcaagcaactattatgggtcctcctgacagtccttatgctggtggagtgtttctagtcaccattcatttccctccggactatccatttaaaccaccaaaggttgcatctaggacaaaggtctttcacccaaatattaacaacaacggtagcatttgccttgatattttgaaggagcagaggagcccttgcctcaccattatcaaggtattgttatctatctgctcac

SEQ ID NO: 5818 - DNA, 114 bp, Gossypium hirsutum
  Clone ID: uC-gsronu33B103g08b1
tttaatataaaaaaaaaaaaaaaaaaaaaaaaaaacgaaaaacaaaactagagagaacctagaaaacaaaccaaggcagggaaagactatcggccctctctggtgccggggccg

SEQ ID NO: 5819 - DNA, 508 bp, Gossypium hirsutum
  Clone ID: uC-gsronu33B103g11b1
cccacttcgtccgcgaagttaaggctgctgccggaccttacggtgtaagaaccgaacaacctgttcaacgtacatgggttccaccacagccaccacctgtggcaataccagaagcagctgaagccattagaaggccaaaaccattagcttcaaaagaacaatcggctgatgaacaatcaatggttcaccccgcagagccaattgatgagttacagaggatcacaaaaatatcggagtcaggaggttcagtggagatgaatgtaggttttccgagtggaacctccagtgatgtacaagaacaagaagttagctatgaagggaattgaaactggactccgtatccagggtaagctcgatgtaaagtctatcgatgtgccataatattgagcatccctgtagtatatgcagaactttctcatcatgatacgttctttatgtacacccaataatgataataagggtggaactctgtaaattggggtgggttatgtttatttggagctagaat

SEQ ID NO: 5820 - DNA, 401 bp, Gossypium hirsutum
  Clone ID: uC-gsronu33B103h01b1
aattcttcgtatctccaaccgccaacaaacaccatcttcaacagctcgaaattcaccacagccacccaaaccttcgagtaaacaaggatcggaagttcccatcaagttcgactataccaccgccccaccaaccgagaaaccaaaaccagttgtttcagctggtaatgctcatcaactgtgaggaagtaagctgaagcctagtgcagcaaagggtaatgggaaaagccaagtccaaaaccacgatgatatatttgctaaatctatccatgaaacaaggcggcagatcacgtcaccggagccggacaacggtgagatttcccagaaagtgggtggacatggacatggacatggtagtggtcgaaaggatcatcaattctcggataccataagcagactaaaag

SEQ ID NO: 5821 - DNA, 489 bp, Gossypium hirsutum
  Clone ID: uC-gsronu33B103h03b1
tacgctcctcctcccaagtcacccagcaagccgccaacttacgctcctccacccaagtcacccagcaagccgccaacttacgctcctccgcccaagccaccgaccaagccaccaacttacgcccctccacccaagccaccagtttatcctccaactaagccgccaactgcgcccccgactaagccaccagtgcatccaccgacatatcctccaccatcgccttctccagctaagccgcctacttatcctaaaccacaaaggagcctagtggctgttcagggcgttgttttttgcaagtcatgcaaatacgctggatccaacaccctgttgggagcaaaacctattttgggcgccactgtaaagctgacatgcaagaacaccaaatacaagcaagaggccactgcgaaaactgacaagaatggctatttcttcctgcaagcaccaaagaccgtcaccagctttggagcccacaaatgcacagtgtctcta

SEQ ID NO: 5822 - DNA, 547 bp, Gossypium hirsutum
  Clone ID: uC-gsronu33B103h12b1
ttcactcgtccggcgagttggctgaaccaaaactcctaacagcaaacaatccgactttggaagaagatgttgaagtttctatccaaagtgaagatcgagttcaatgcattggacccacgcatagcttcatgcatggaattcttagcccagtgcaacgcccgcaaagctaaagagtccaaccccgcctgccaacttcaggtcaagcgccgaaccgacgatcacccgccccaaatcaccgttactttcgtcaacggagtggaagaagcttttgatgccacttccactcctgctcaaaccattaggaccatgatcctcgagaaaggtcagatgcttgagactgagcaaatgttccgtgaagcaggcgagaagtggcccgttattatacccgaggaggaacttcaccaatcctttcctggaaccaagccaaggaaagcagaagagaagaagcagtaacgccaatctgtctgaccattttactggatctcactttgcaagatcatagatattccattgtatgatgaagcctgagaaagtccctatatgaaca

SEQ ID NO: 5823 - DNA, 482 bp, Gossypium hirsutum
  Clone ID: uC-gsronu33B124a03b1
ccctctcgtccgctcaaatacctcatttttgcaggggcaattttctatctgtgtttgcctctattgaaactttaaaaatatgagtaacataaggttggtagaagccaagttgccaacagggttcaggttccatcctagagatgaagagcttgtttgtgattatttgatgaggaaggtggctttaactgataccttccaactcatgattgaagttgatctcaataagtgcgagccctgggatattcctgaaacggctcgggtgaatagcaaggaatggtatttttacagccaaagagatcgaaaatatgcaacaggattgcgaacgaatagggcaacaacgtcagggtactggaaggccactgggaaagataaggctgtccatagcaaaggcaccattgttgggatgaggaaaaccttggtgttctaccatggtagggctcccagtggaaccaaatctgattgggtcatgcatgaattcaagc

SEQ ID NO: 5824 - DNA, 488 bp, Gossypium hirsutum
  Clone ID: uC-gsronu33B124a08b1
tgttgagcgtatttttgggggcactttactggcgatgtgctccaatgattttatttgtttttatagttgggctgaatgcagattgattcgtcggattgatgttaccgttaaaaatctttactgggctgatagtggtgacttggtggcaattgccagtgatacatcgttctatatcctaaagtacaatcgggatgtagttcaatcatacttagatagtggaacaccagttgatgaacaaggagttgaggatgcatttgagcttcttcatgaaaccaatgaacgtgttaggactgggatatgggttggggactgtttcatttacaacaactcttcatggagacttaattactgtgttggtggagaggtcaccacaatgtttcatttggaccgtcctatgtacttgttgggatatcttgctagtcaaagtcgggtgtatctgatagacaaagagtttaatgtaatgggatacacgttacttctcagcctta

SEQ ID NO: 5825 - DNA, 404 bp, Gossypium hirsutum
  Clone ID: uC-gsronu33B124b04b1
gttgttttgaaatcgagcttgttttgttactctgtgacctcatcatatgagtgctttttatctttattctttgtgttttttccaccccttcactatcctttttttgttttcttagaaactaaactttctgcaggttaagttagtatcagcagtcatatataattacaattaaagttaatactatctttagattgatttcttatttaaaaaaaaaaaaaaaaaaaaaaaaaaaaaaaaaaaaaaaaaaaaacaaaaaaaaaaaaaaaaaaaaaaaataaacaaaaattaaaaaaaaaaaaaatattttaaccaatgcactcaaaagtaaaaatcctatggggggggccctttttaagggccccagtttaccccccgggggatggcaaatttttaatttttttttg

SEQ ID NO: 5826 - DNA, 281 bp, Gossypium hirsutum
  Clone ID: uC-gsronu33B124b05b1
cgttctcatgtctaaggcttaagtgagtgagtgattgtgcttggtgtatccaagctttagcaattttaatttagaagagatgttatgagagaataaacgaattgtacggagcatatttttgtgtgaagaagggttgtttcagttttattacccaagtacttgaatgtttcaagtttcattgcagttgtttttctactttaatgcatacgtggtgattatggtttcaaaaaaaaaaaacatatataaaataaaaaaaaaaacaaatataaaaaaaaaataat

SEQ ID NO: 5827 - DNA, 495 bp, Gossypium hirsutum
  Clone ID: uC-gsronu33B124c04b1
ccctctcgtccgcccacgcgtccgctctgcaaaaatggcaaggaaaattgtgctcattctggtactgagatgcctctgcattgggctagcagctgctgactggaacatcttgaacccaatatggaatatcaatgcaagacaagatagcttgaaaaactactgtgaaagttggaggatcaatgtggagctgaacaacataagggagttcgatgtagtgccccaagaatgcgttgctcacatcaagaagtacatgacttcatcacagtacgatgctgactgccagagagctatcgaggaagtgacactatacttaagccgctgttgctctttgaaaggtgatggcaaagatgcatggattttcgatgttgatgatacactcatctccaccattccttacttcaagaaacatggttttgggggagagaaggtgaactcatcttctttggaggcatggatggaagagagcaaggcaccagctctcgaccacacattcaa

SEQ ID NO: 5828 - DNA, 491 bp, Gossypium hirsutum
  Clone ID: uC-gsronu33B124c05b1
gtcttacgcgtccgtgcattgtatgaagcctttggattgactgttgtggaggcaatgacttgcggtttgccaacattcgcaacctgtaacggtggaccagccgagattattgtccatgggaaatctggtttcaacattgatccttaccatggtgatcaagctgctgacatactcgtcgatttctttgaaaagtgtaagaaagatccatctcactgggataagatctcccaaggaggcttgaaacgaatagaggagaagtatacatggaagatttactcggagagactattgaccctgacaggagtgtatggattctggaagcatgtttccaaccttgaacgccgtgagagtcgtcgttaccttgagatgttttatgctcttaagtaccgtaagctggctgaatcagatccattggcagaggagtaaattgaaacttgtaaataacattgggccggtttttcttggagactaatattctgttttgtaatttc

SEQ ID NO: 5829 - DNA, 220 bp, Gossypium hirsutum
  Clone ID: uC-gsronu33B124c07b1
tcttttttgcgtccgcccacgcgtccgctcattgggggctgttaattaacatttggctgtgtttttcgtcatcctttctcttttttcaaattcaagtgtgttgcaagtttcaaattgtttatgtttgaatttctggcagaattttataaatggtaactctacctgccaaatgttattatatcttcaagtgtttattaataacactatgttcttgcataat

SEQ ID NO: 5830 - DNA, 287 bp, Gossypium hirsutum
  Clone ID: uC-gsronu33B124e05b1
ccctctcgtccgggggaaggggaggaggaagtttacggctatgttgagtgctattcctgaataagcgggaaagggtatatttgtaaatatgagatcgtattggggtattttagtcaaatcactgtgaaataaagtggctgaccaaacattttgatgaactcacttgtcttctttacgttcttgggtaagcccatttgagggtagttttacaattttacccctatttgggtcaaaatgaatattcttttaaaatgatgcatatataaaaaaaaaagcaccaaatagag

SEQ ID NO: 5831 - DNA, 482 bp, Gossypium hirsutum
  Clone ID: uC-gsronu33B124e06b1
ctgtctcgtgggcggacgcgtgggcggacgcgtgggcggacgcgtgggggaatgagtcaggtctatctaggaagtgccggtgcactcgatgtggatggcaaagagctgcctcgacttgtctatgtttctcgtgagaaacgacctggttatcagcaccataagaaagccggtgctgagaatgctctggttcgagtttctgcagtgcttactaatgcacccttcatattgaatctggattgtgatcattacatcaacaatagcaaggccatgagggaagcgatgtgctttttaatggatcctcagtttggaaagaagctttgttatgttcaatttccacagagatttgatggtattgatcgtcatgatcgatatgctaatcgaaatgttgtcttctttgatatcaacatgttgggattagatggacttcaaggccctgtatatgtaggcacagggtgtgttttcacaggcaggcattgtatggc

SEQ ID NO: 5832 - DNA, 344 bp, Gossypium hirsutum
  Clone ID: uC-gsronu33B124e11b1
ttttaaaaaaaaaaaaaaaaaaaaaaaaaaagaagaatttataaaaaaaagaaggaaaaattaaaaaaaaaaaaaaataataaaaaaggaaaacagcttattaaaatttctgtggggtcatcttatttttttggggtggccgttttggggcttccaattttcgtgctcttgtcattgggggtgctcattttttttgggtggccgctgatttacattgtttggggcgggtttttccctgggtgggccgggttaaatcggcctttgtgcccgcccttgtttgccttctgtgggctttttaatggatcctcaggttggaaagaagctttgttcggtgcggtttcccc

SEQ ID NO: 5833 - DNA, 404 bp, Gossypium hirsutum
  Clone ID: uC-gsronu33B124f01b1
gagcagcaaacaacacaaaaaacaacatgggagagatatgagaaactgtacgtgatcctaacaccagactgcgaaacatgcgtgtcgatccgtcctatttttaatattgtgcatcagacgatccgctacatttttgacctttaccattccctggaggagctatacaatgccttgtatgagttctgcttggacccaggctatgctgcccgcacccttattgcttaatgtaacaagcctggctccgagcgtccttgctgcttgagatgtatgctgccactgtatcactattctgctacatcttgcgcctgacgagtgcccacgttcttaccggctcacttggttatcgcttgtgttcattgtggattcatggcctgagcccgcggtgatcacatttaccttgttct

SEQ ID NO: 5834 - DNA, 488 bp, Gossypium hirsutum
  Clone ID: uC-gsronu33B124g06b1
ctttctatctatatccttatcagctttcaaagatggcaggaatcgcctttggtcgcttcgatgattccttcagtttggggtctgtcaaggcctaccttgctgagtttatctcaactttggtgtttgttttcgccggcgttggctctgccattgcttacaacaagttgacaactgatgcagccctagatcccgatgggctagtcgccattgctgtttgccacggatttgctctctttgttgcagtggctatcggtgccaacatctcaggtggccatgtcaaccctgcagtaacttttgggttagctcttggtggccaaatcaccatactcactggcatcttttactggattgcccaacttcttggatccattgttgcttgcttcttgctcaaggctgtcactggtggtttgacagttcctatccacggtcttggagctggagttggagctattcaggagtggtgatggagatcatcatcacatttgcat

SEQ ID NO: 5835 - DNA, 248 bp, Gossypium hirsutum
  Clone ID: uC-gsronu33B124h06b1
ccctctcgtccgggggaaggggaggaggaagtgggcggctatgttgagtgctatggctgaataagtgggaaagggtatatttgtaaatatgagatcgtattggggtattttagtcaaatcactgtgaaataaagtggttgaccaaacattttgatgaactcacttgtcttctttacgttcttgggtaagcccatttgagggtagttttacaattttacccctatttgggtcaaaatgaatattctttt

SEQ ID NO: 5836 - DNA, 475 bp, Gossypium hirsutum
  Clone ID: uC-gsronu33B125a07b1
aaataaaaaaaaaaagaagcagaagaagaaagaaaagattaaaaagctttgcaaaaatggtgcttcaaagattggagatatgcgttgaattgatgaaactagccgtagagtttgtcgtggttgtggcggaagcagtcggaatagtcattcatcaaaaccactcgccgccagtaatgacggctagccggtccttcgctacttcggttcccttagtcgggtttcttccttgctgatcagtttcaattttccgaattttttttcccttttcattagagaaaatgatcggtttgaatccttttctaatttttgctgttgttgctttactatctacgtttgggaatttgaatgtgtaaatttaggctaatcatgtattttaaggactggagaagtctattttctatttgaatttcaaaaataaatcacctttaaataaaaaaataaataacttctttactgatttcaattttaatcttat

SEQ ID NO: 5837 - DNA, 400 bp, Gossypium hirsutum
  Clone ID: uC-gsronu33B125b01b1
gtccgtcctttttttttttttttgtatatgttgaagcccttcactcctttcctttatgagaaagagtggaggtaagaagggagagttgggtggtggatacggtgacggtctatctttatactcatgtggcgggggctcttgggcttgggttaaggcgttctaggattagtgtgagcttccgctcttattttagggtttaatgggtttgtttgctagtgcgtggattctatcgatctttcaccttgtctcatgaggagtttgtattccttaaaagagcaaggaaaaacttccctgtcttcacaagaaagcctgaagaggtcaatagcccggattcagccccagcaccatgagtcctatcaccaacaggagtctaaggaaaagaccggacttttgggggggg

SEQ ID NO: 5838 - DNA, 525 bp, Gossypium hirsutum
  Clone ID: uC-gsronu33B125b02b1
cccactcgtccgcaacttattcgctatgcaacttgccagtgcatcagtcctccccatggtcctcaaatcagccattgaacttgacttgctcgagatcatggctaaagctggtccaggtgctttcttgtccccaaaagaagtggcttccaagctccccaccaccaaccctgatgcacccgtcatgctggaccgtatcttgcgtctcctggctagctacaacgtcctcacttgctccttgcgtaccttccctggtggcaaagtggaaagactctatggccttggccctgtctgcaaattcttgaccaagaacgaagatggtgtcactctttccgcccttagtctcatgaatcaagacaaggtccttatggagagctggtactacttgaaagatgctgtgctggatggtggaattccattcaacatggcctatggtatgactgcatttgagtaccatggcactgatcctagattcaacaaggttttaacaggggaatgtctgatcactctaccatcaccatgaagaag

SEQ ID NO: 5839 - DNA, 469 bp, Gossypium hirsutum
  Clone ID: uC-gsronu33B125b03b1
atgcttcaaaagcttttgacacaaatgctgaaacccgcatcagaagctgagggttcagggatatcgcctgaaaagaaagtgaggaaaatgagggcgtcaccgttcaacatgaaaagcggttcggtcttggggaagacgagcggttcttcactgtcttcaatgccggaaatcgatagcgatgaagatgaagaagtagctgtggttgtggaaccaagagctagaccacaaagggcaaaccggaccaagacaacttatgttgttagtgattccgagactgaggaagaagttaatgatgactcagatttcgaggaagattaggattgaggaaaactgtgatgtttatctttcagtgtaggaacgaacaagtaactctaattcttggctgcttgtttatggtcaacttaggttgtcaacgttgtgtaaaactgaaagtcatgaatttccttctgtttccattgcaaaaaacaat

SEQ ID NO: 5840 - DNA, 384 bp, Gossypium hirsutum
  Clone ID: uC-gsronu33B125b05b1
gaaaactttacctgatgaacgactgccggtggtggcttctcgtttcttgttgcagtttcagaattccccatttgtactttgtcctctaattacgatggcacagatatgtcatttatgttcccatttgcaaggtcaagcaggaactctgctggattcatggcaatgagaggggaacaacctatagatgagaaataagccattgcttccgaagctctcccgaagtaaagcgaactgcctttccctagaagaaccaacttgtcgaatttgtggaacagtctacttgatggctggtggattgttgttatcacagtcttcccggcctgcaatgagaactctgaagtcatttagattcaagaaaatacacacacacgctttcagtttttg

SEQ ID NO: 5841 - DNA, 437 bp, Gossypium hirsutum
  Clone ID: uC-gsronu33B125b06b1
ttttaccatttccagagatccaaaacaataaatatccttcttttttaaaaagatgatgaggatgaatactaaagcgacagggctgtcaccggcggtgacaaatgaagaatcaggttttgtcggtggcggtgaaccgactgctcatgattgggagcttagacccggtggcatgttggtgcaaaagcgagacctcgacaacggtcgtccccctatcccaccgccgacaattagagtcagagtcaaatacaagtcaatctatcatgaaatcagcagcaattctcaagctacattcggagagttgtagaagatgttaacagggcccacggggctacaccatcaagaccaaaaacttttatacaaagacaaagagagggattcgaaggcgtttttagatacggtcggtgtgaaagacaaatccaagcttgttttaattgaag

SEQ ID NO: 5842 - DNA, 482 bp, Gossypium hirsutum
  unsure (1)..(482): unsure at all n locations
  Clone ID: uC-gsronu33B125b10b1
taccacgcgtccgaccacgcgtccgcgattttctattttgttttctctccctccaattaagatgcagatcttcgttaagaccctgaccggcaagaccatcaccctcgaagtcgagagttccgacacgatcgacaacgttaaggcgaaaatccaagacaaggaagggatcccaccagaccaacaacgtctcatcttcgccggaaaacagctcgaagatggccggaccttggccgattacaacatccagaaggagtccaccctccatctcgtcctccgtctacgtggtggcatgcagatcttcgtcaaaaccctgaccggcaggaccataaacttggaagtcgaaagctctgacaccatngacaacgtcaaggcaaagatccaagacaaggaaggcaatccacccaacccagaaagggtttatattggcggggacacaactcgaggacggtcgcaccttggccgatacaacatccaagaggagt

SEQ ID NO: 5843 - DNA, 368 bp, Gossypium hirsutum
  Clone ID: uC-gsronu33B125b11b1
tattagagaggggtttgagttgccagagaaccatcaacaatttctgctgctttttcattttcactcctgtctggatgtgtgctctctcattttcgtatttaaattgcaagtagggaggagtgacggaggatgaatttgtagtgtaggattttacgaatataattgttgttatggtggatctttggtcgtgttttcgacttttgctttttgttgttatgggttttgctgcctttagtgaaatctttatgttatagttactctatatgtttttgaatatgaaattcttgagaagaatattggaattcaaaaaaaaaaacctaacggagatacactctctagaccaaaaaattttattcaaaaactcacca

SEQ ID NO: 5844 - DNA, 348 bp, Gossypium hirsutum
  Clone ID: uC-gsronu33B125b12b1
ttttaaacaccgacatgctgaaatagagggctgaccgtttgctaccacttactcgtcaatgctatgccattcaactggtacatgaagcacccgttcattcacagctcaaccatatgcagctaaagctagataacacttggagattggagagaggctagagctcactgataataatggcttaacactgcaacagcctcatgccaaacgataagacagaaggactctaggaccagcgctctcgtgtatggcacactcacggatggatcttatgcattaaaactgatgcttaggccgcgaactaggaaaaaaactggtggatcaactaagaatggacagagaccaaaaccc

SEQ ID NO: 5845 - DNA, 559 bp, Gossypium hirsutum
  Clone ID: uC-gsronu33B125c01b1
cccactcgtccggcaaaggcagtccctaaaatctggctctctatactcctcctattttaaccatttcttccttgtcctcgccccttccctagcaagctacatttccatggccccccctgaattggttcaacccagtgataaaacaaacgtcttcgctaaacaagtcagtttgcgtaatcgtgcatatgtcacgttcttggccggaaatggggactacgtgaaaggcgttgtagggttagccaaagggttaaggaacgtgaaatcggcgtaccctttagtggttgccgttttacccgacgtgcctgaggagcataggcggatcctggagaaccagggttgtatcgtccgagagatcgaaccagtttacccgcctgagaaccagacccagttcgccatggcctattacgtcatcaattactccaagcttcgtatttgggagttcgtggagtacagtaaaatgatatacttggacggcgacattcaggtatacgacaacatcgatcacctgtttgatctgcctgatgggcatttctacgcactaatggattgcttctgtgag

SEQ ID NO: 5846 - DNA, 415 bp, Gossypium hirsutum
  Clone ID: uC-gsronu33B125c06b1
gaagggtaggtgcttgctcatccgcgccacaggtggcaggatgagcgtcatattcgaccatttgagaagaaggcagaggtggatcatgagattcaacacatgatgtcaaacatgcgcgattcccagcttcaaaaattccgtgaggagcttaagaaccgttcacgggtcctgaagaagctacgccatattgatgctgatggtgttgttcaccagaagggacggctagcctgcttgatagacactggagatgaactgattgtgacagaactgatgatcaatggacattcaagaatctggacatcacaagggagcagccatgcacgctgtttcattccattagataatcaagtgaacagatacagctgaggacagacagtgccatagcattacagctactgcaagaaagtgcaagaaa

SEQ ID NO: 5847 - DNA, 347 bp, Gossypium hirsutum
  Clone ID: uC-gsronu33B125c07b1
gttgaaaagcttgatgaaagccatagattatgaaaaaagaaagcagcaaaataacaggcctctgtaatgatttattttcaaggatggatgcctgcaaggtctataattatgtctctctctgtcttgtgtaatagaagctttgtttgtggtgaaaataatgtataagccatttggttgggagcaaattttccttttgtccaaaggatttttgctgctcattcatggtgacttggtttatggttttatctgttgttgttaaaatcttataaaaatatatatcgattgctgcttttggtttgttaaaaaaaaaaaaaaaaaaaaaaaaaaaaaaaaaaaaaaataaaatt

SEQ ID NO: 5848 - DNA, 515 bp, Gossypium hirsutum
  Clone ID: uC-gsronu33B125d03b1
cttttgcttacgtacttgctaggagtggtacttggagtgactgctttagccactccctatgttgctacctatgatggtaccaactatggtaaggccaatactcctgctaatgagactcctaaggtgaatgcaccacctcatgaacattatccacctgtctatgaacctacaatgaaggataaacctgcacctaatccaccagcttatacaccaccaacgaaagagaagccagaacccaaggcaccagcatatgaggcaccacccaaggcaaagccagaaccaaatccaccagcttatacacctacaatggaagagaagctagcacacaatccaccagtatatgaaccaccgactaaggataagcctgcacctaatccaccagcttatacaccaccaccgaaagacaaaccagaacctaatcaaccagtttatcagcctccgaagaggcacctgtttatgagcctacaccactcaatgcaccagcttatgtaccaccacagaaagagataccagga

SEQ ID NO: 5849 - DNA, 208 bp, Gossypium hirsutum
  Clone ID: uC-gsronu33B125d04b1
cccacgcgtccgctgcaatctcttctttttagagtgccatcacaccagatattacaatgggttcaatcggtgaaactcaaatgacacccacccaaggctcagatgaggaagccaacttattcgctatgcaacttgccagtgcatcagttctccccatggtcctcaaatcagccattgaactggactggctggagatcatggccaaagt

SEQ ID NO: 5850 - DNA, 563 bp, Gossypium hirsutum
  unsure (1)..(563): unsure at all n locations
  Clone ID: uC-gsronu33B125d07b1
tttccacgcgtccgtgcagaatcatacgttaaaattcctttgtttggagctgtctcataccttacattggctgtttcccctttctgcattgcgtttgctgttgtttgggctgtttaccgcaatgtttcctttgcttggataggtcaagatatactcggaattgcattgataatcacagttctgcaaattgtccatgtacctaatctcaaggtgggaacagttctactcagttgcgctttcttatatgacatcttctgggtttttgtttcaaagaagttgttccatgaaagcgtgatgatcgtggttgctcgtggtgataaaagtgggcaggatggaattccgatgttactgaagatcccacgaatgtttgatccatggggtggttatagcataataggatttggtgatatccttttacctggattgctggtagcattttcactcaggtatgattggctggcaaacaagtctcttcgagctggctacttcgtgtgggcaatgattgcttatggcttangtcttcttgttacgtacgtngcactaaatttgatggatggacatgg

SEQ ID NO: 5851 - DNA, 448 bp, Gossypium hirsutum
  unsure (1)..(448): unsure at all n locations
  Clone ID: uC-gsronu33B125d08b1
taaaaaaaaaaaaaagaagcagaagaagaaagaaaagattaaaaagctttgcaaaaatggtgcttcaaagattggagatatgcgttgaattgatgaaactagccgtagagtttgtcgtggttgtggcggaagcagtcggaatagtcattcatcaaaaccactcgccgccagtaatgacggctagccggtccttcgctacttcggttcccttagtcgggtttcttccttgctgatcagtttcaattttccgaattttttttcccttttcattagagaaaatgatcggattgaatccttttctaatttttgctgttgttgctttactatctacgtttgggaatttgaatgtgtaaatttaggctaatcatgtattttaaggactggagaagtctattttctatttgaatttnaaagaaaacaacctaaacaaaaaccaaaaattatgggc

SEQ ID NO: 5852 - DNA, 79 bp, Gossypium hirsutum
  Clone ID: uC-gsronu33B125d11b1
ttttcgcgtccgttaaaaaataaaaaataaaaaagatatttaaaaaaaaataaaagaaaaataaataaattaataaggg

SEQ ID NO: 5853 - DNA, 531 bp, Gossypium hirsutum
  unsure (1)..(531): unsure at all n locations
  Clone ID: uC-gsronu33B125e06b1
gcaattccagttcttgagcgctcgatcgagattccagtaattgaggatggccaaactcatgcacttgctaaatttgctggatgcatgcagttaggtgatacctatgcaatgcagggccaaatcgagaactcaatattgtgttatacagcaggtttggagatccaaagacaagttcttggagaaactgatcctcgagtaggcgagacatgtcggtatgtggctgaagcacacgtacaagcactgcagtttgatgaggctgagaagctttgtcaaatagctcttgacatccacggtgagaatggtgcaccggcttctatcgaagaagctgctgatagaaaactcatgggactcatttgtgactcaaaaggagactacgaatcagccctcgagcactatgttttagctagcatggccatggcagcaaatggcaatgaagtggatgttgcttcaattgattgtagtatcggagatgcatatttatcgttggctcggtacgatgaggcaattntggctcatcaaaaagcactcaca

SEQ ID NO: 5854 - DNA, 402 bp, Gossypium hirsutum
  Clone ID: uC-gsronu33B125e09b1
tttcacgcgtccgcgattccggttattatacgatgcatgagttgcggtcgtgttaagttaccacacttcttctgttgcagtggagatcgtgggcacaacaatgaacgagatgattcatccggttaagttgtaggtgaactaataataagaagctttttcatttattatgagaaaacattattgggatgtcatgacaatgttggtgggcaagcgtagacggattcagtcataaaaataggttagaaagttttgtttacaaatgaagccatctagaatgatggcaaataactgcaaaaatgatgatctgatctagctagtacatttttatggagttacataagtttgcacttgtatggaaaatcttggttggtttaaaaaaaaaaaaaaaaaaaaataaaatat

SEQ ID NO: 5855 - DNA, 422 bp, Gossypium hirsutum
  unsure (1)..(422): unsure at all n locations
  Clone ID: uC-gsronu33B125e10b1
ctggaatggtcagatggaaaacacattgttggtggtccaatagctttcagttggacataaccatgacaacaattaggttcatgatactaatactgggactttcaagtgccctcaaagcaccagagacctctcttatagtatatgaatccatctcgtactatctcatattacagcaacgcacaaagcagctccaactgtattcataaatgctctccaaaaacaattaggggacagtaaattgggtttaaaaaaaaaggtcagggccagctcggggaataattgtatagtggcctacctgtataaggaactagcatgttaatttaaactggattcctagttataagtcatgttttacaaannaaaaaaaaaaaaaaaaaaaaaaaaaaaaaaaaatttttaaaacacaaatttatttttggtta

SEQ ID NO: 5856 - DNA, 538 bp, Gossypium hirsutum
  unsure (1)..(538): unsure at all n locations
  Clone ID: uC-gsronu33B125f03b1
atttgtttctcgtcctcttaacgatatcctctgtttgcagttaagaaaagcagatcatggctgctaccacggtcccagccgccgcaaggcagctatctcctaaagaagccgatatccagatgatgttggctgacgaggttcatctcggtaccaagaactgcgatttccaaatggagcgttacgtcttcaagcgtcgcaatgacggaatttacatcttcaaccttggcaagacctgggagaagcttcagcttgctgctcgtgtaattgtcgctatagagaaccctcaagatatcattgtccaatctgcaagaccctatggtcagagggctgtcttgaaatttgctcagtacactggttgtcatgccattgctggaaggcacactcctggtacattcactaaccaactccagacatctttcagtgagccacgccttcttatcctcacagatcctaggaccgaccaccagcctatcaaggaagcagctcttggaanatattctaccatngcttttgtgacacagactcaccaatgcgatat

SEQ ID NO: 5857 - DNA, 367 bp, Gossypium hirsutum
  Clone ID: uC-gsronu33B125f05b1
cccactcgtccggaagattgataggttcatcggaggtgaaacaagcttgcctttacatgggttggaaggtaatggtggtggttgcagtggtggtgctaatgggcggtactatttggggatgttcttgggtggggcttaccaggaatccctcggtggagttcacaacctctttggtggcccaagtgttgttagcgtgtcgcagagagatggtccatatagctttgcggttacgcgggcggcgcctggtccgtcatgtggggatgtccttcaagtgatgcagcacgagcccgagctaatgtttgagaccctcaagcaccgtgcggaaaaattttgtggacaggaccatggcaatgaaagcacccatgct

SEQ ID NO: 5858 - DNA, 261 bp, Gossypium hirsutum
  Clone ID: uC-gsronu33B125f06b1
tcgccctctcgtccgggcagtagcagctgaaaaccaatctgagccttcccaaaacgatttgccctatgtcctcatcttgaaacccccggcagcattcagcatcttcggggaccatttgttccactcacccaaattccaattcctgaaagcgttcgaatccccactccctctttaccagatattgctcacccatgcacagggcgtacaagccattcttacattaactagcgggtttgtgaccggtgatactatacgcctttt

SEQ ID NO: 5859 - DNA, 339 bp, Gossypium hirsutum
  unsure (1)..(339): unsure at all n locations
  Clone ID: uC-gsronu33B125f12b1
tcggccacgcgttcggaataacttgggcaaaggctgaggaattgaaaaatttggaggaggagttaaggaagaccaaacctaattttagggaaggcaaactgaaggtggagaagggaaaatctgatttaaaagaaaacacactgagggtggaaaagggtaaatctgatttaaaagaaacccatctgactctggaaaaggacaaagctgatttagaagaaaacctactgaatctagccaggttgcagaagaaaccacggttngcgtaatgtgcttttaagaaaaacattctaaatggtttattgaggatgttgatcaactgaagatacaaacattttgtgt

SEQ ID NO: 5860 - DNA, 221 bp, Gossypium hirsutum
  Clone ID: uC-gsronu33B125g08b1
gtgtacattaattaaatttcatattagctctggatcatttaaactttaaaaaaagaaaaaaaaaaaaaaaaaaaaaaaaaaaaaaaaaaaaaaaaaaaaaaaaaaaaatattaatacgtaaaaatgttaaaatatcgaccataaagaatgaaagatcattaaaaaataaaacctataaagatttatttggagctatttaaataaaacttgggattgaaaaa

SEQ ID NO: 5861 - DNA, 232 bp, Gossypium hirsutum
  Clone ID: uC-gsronu33B125h02b1
ggtgttaatatgataggctaatttaaaatggtgggggaatgcatgttgtgaaaatgatgggtttgcatgtcaaattacccaaaatttgagctagtggttggccatgctatgggtggaaacatgttgggaacatgttggcctagtgaggtatgtaggaaaaaaataaaataaggggcatgggcataaaataatgaaaaggagtatgccattcacataaaaacaagcttgaact

SEQ ID NO: 5862 - DNA, 131 bp, Gossypium hirsutum
  Clone ID: uC-gsronu33B125h09b1
aatgtcattgaaaataatagtcctgttgaacagtgctatagtgccatgtaaacttggtattttcaacgtcgtaatcaatcaattttccttgggaaaaaaaaaaaaaaaaaaaaaaagataaaaaagaaaaa

SEQ ID NO: 5863 - DNA, 556 bp, Gossypium hirsutum
  unsure (1)..(556): unsure at all n locations
  Clone ID: uC-gsronu33B002a03b1
atttagccatcatcgatagtgagttacaaccatgtgggaaataatgatggcatgaatctgtcagcaccccaaaccttccgttccaaggagatctcaaagagcaatgttgctgatgacatggtttcaagcaatggaatcctctatgagcctggtgaacatcctgatcatgttgtggtcatcaagtatgtgccgtatgtgggagacagcaagagagccatggatgagtacacatcagagatattcatgggaggcaagaacaccattgtgttgcacaacacatgtgaggattccctgttggctgctcccattatcctagatttggttctccttgctgaacttagcaccaggatccagttcaaggctgatggagagggcaagttccacactttccatcctgtggctacaatcctcagttacctcaccaaagcccctcttgttccaccaggcacgaccggtggtgaacgcactgtccaagcagcgtgcaatgctggagaacatactaagggccagcattggcttggctccttgaaacaacatgattntggaatacatgtga

SEQ ID NO: 5864 - DNA, 390 bp, Gossypium hirsutum
  Clone ID: uC-gsronu33B002a04b1
gcgggccccgattcccggttcgcggccacgcgcccggctatcgttttcgcgtccgcccacgcgtacgagggccctgtgaccgtttatagacatttaatactacaaaaaaaaaaagggggggggcggctgttggatccgggcatacccttcctgaccctggaacgccacggctttttttttgtgtagcctaacttaaattcactggccgggcgtgcccatcaccacgcctgggatggccaaggcgtggcccaacccaattgactggcctagcatcccattttccttaggggggggggtgcattaggggcccggcccgatcggctttccctacattacagttgcccaaattgaaaggggaacgggccccgccccgtggctttacattcggcc

SEQ ID NO: 5865 - DNA, 255 bp, Gossypium hirsutum
  unsure (1)..(255): unsure at all n locations
  Clone ID: uC-gsronu33B002a05b1
atcaatancccactaattcgaggcctatgggtataattaatcgtcaaaggaaatagaccaaactataagttcaaataaaaattcacagaatctgaacgatcaaatcgagacttctaaaaatatttgaacctgtgtttaatcgctggtgttgctttcatataattttttctccttcacttaatagctcaatttaaattggcgcatttacgcctgagttttaattataattaatcgaaagggatgtacagatgaaaa

SEQ ID NO: 5866 - DNA, 348 bp, Gossypium hirsutum
  Clone ID: uC-gsronu33B002a06b1
ccacccaaaaaggggacatgtggaattagcaaagccttggcgttcaacaccggccctagatcggctttgatagttctgacttcgttctctctattcacttctccacaagtctgtcaacagaggctttcattcaacttgcgtgaacagaatggcgggcgggcctggccatgatgaacccaatcacctcctttctcaacagcatctcctctttctttatcggattctcaaaatatggactgcccaagactccgttcgtctctgcttcagcattggtgtggcttgttcctatctatcctgccattttcccaccaaaaaagactgcccctggttgctctcccttcttccccc

SEQ ID NO: 5867 - DNA, 362 bp, Gossypium hirsutum
  Clone ID: uC-gsronu33B002a08b1
tttcggtttatcgaatgggagatacaagtaggggacagggcaacatgaaaagagatctatgggcacaccaacagttgcacccagagtggatccaacaaggcgcattagtacagacccatatacagggcctgatgataggaatgctcctggaaggcatgctgcgaatcgggatactggtttcaacagtggcccaaagccttcagctgataatatccaacaacctgatggccctagctatgacagtgggtaccctaaagaacatcttaattctgcaccaacaaattagtctgcatatgttaattcatgggcacattaaaatccgatgagggatgcaccttctacatacactgacagatacactc

SEQ ID NO: 5868 - DNA, 496 bp, Gossypium hirsutum
  unsure (1)..(496): unsure at all n locations
  Clone ID: uC-gsronu33B002b02b1
gaaggaaggtggtgtcctccctggcatcaaggttgacaagggtacggttgagcttaatggaacccatggcgaaactttcacccagggtctagatggccttgcacagcgatgccagaagtactatgaagctggtgcccgctttgctaaatggcgtgctgtccttaagattagtgctaatgaaccaaccgagcttgcaatccaagaaaatgccaacgggctagctatgtatgctgccatctgccagcaatgtggccttgtccccattgttgagcctgaaattcttgttgacggatcacatgacattaaaaagtgtgctgcggtgacagagcgtgttcttgctgcttgctacaaggctttgaatgatcaccatgtcatgcttgaaggtactcttttgaagcctatcatggtgacccccggttctgactcccngaaggttgccccagaggttattgctgagtacactgtccgtgcctttcagcgtaccgtccctgctgca

SEQ ID NO: 5869 - DNA, 399 bp, Gossypium hirsutum
  Clone ID: uC-gsronu33B002b03b1
gtttgtccttctcaagaacgagatggtgattacgggcacagatcatattctgcaggatatgaaaatgccgatggaaatggttatggcgagaaatctgcaattgagcccgagaactctcgggctgcatggaggcgatctccatgtagatcatcaaggtctccaggtagatattcaaggtctccttctgggtctagatcgagatctgctgaccttcacgtaggcatagcagacaagtagcaaactttagcctctgggtgcatatggcatctatatcagatggtggattcaggggtgattagtctttttgtgtgcttatctctatcattttgaatgggacatctaaatttgtggcttgctttcatatttgttctatctaaacactgtaacgaaacacaaaaa

SEQ ID NO: 5870 - DNA, 529 bp, Gossypium hirsutum
  Clone ID: uC-gsronu33B002b04b1
gtttaatcctgtcaacaagggtcgctttattagggtcctggttaaagtcgccaccgtcaccggaaacgccccggtatagtcggtgacaagacggcatcactgaacagactcaaatccggcgcggaacgcgtctgcgttttcgccaacatctacaaccaaggcttcacggcggaatatgatgtgagtctcattgataatagctgggctcaagatgcttttgatattgtcagaggcaacactccacattcatggcagaagcttgatgccggtggtcatctatcacattcatttgaattagaggccaaaaggaagggaatgttacatggtgctccagcagtcatatatttccgaattcccaccaaggctgttcaacaggaggcgtatacaactccaatcttgcccttagatatccttgaggaaagaccgcctgagaagaagtttgagtggggtaagaggctgatggctaaatatgggtctcaaaactacgtgatataaatgtggttctgttcattctacctgagagtaaccc

SEQ ID NO: 5871 - DNA, 544 bp, Gossypium hirsutum
  unsure (1)..(544): unsure at all n locations
  Clone ID: uC-gsronu33B002b05b1
cctttttcataccgcccacgcggccgcgactatggacgggggcaatgttgtagccctagcggtcgacaagacnggcaggagagacagggcaatactgagatactcactgcccgtgatcgactagggcgaggactttgagactgactttcaggagttcaaagatgaagaatctgatatagatgattatgatgttgatgatgttttggctgacgtaaagccctttccttttaacgctagaacgaaacctgcttctgctgtatctcatgggtcgaactctgaaaagcccatgcagttggatggacaagctgagaaatgtgcgacaagaaagaggaagaaccagtatcgtggaatccggcagcgcccatggggtaaaagggctgctgagaaccgtgacccaaggaaaggggccagggcctggttaggaactttcaatactgctgaagaagctgcgagagcttatgatgctgaggcaccggaaaatccgtggaaagaaagctaaggtgaactttcctaacgagactccgggtacctctccaagcatgca

SEQ ID NO: 5872 - DNA, 485 bp, Gossypium hirsutum
  Clone ID: uC-gsronu33B002b07b1
ccccggttttctgctgttcggacggaaggcggaacccggccaggaatgaaggaagccatgggtacggtgtgagctaaacgaagcccatggccaaactgtcaccgaagaccaagatggccttgcacagcgaggccagaagaactatgaagatgtagcccattttgctcaatggggtgctgtccttaagatgagggctcatgcaccaaccgagctagcaatccaggaaaccgccaacgggctaactatgtatgctgccatctgccagcaaagcggcctcgaccccattgatgagcctgagattcttgttgacggatcacatgacattggagcgcctgctgaggtgacacagcgcttcctagctgctcgctacaaggctatgaatgatcaccatgtcaagcttgaaggaactctttggacgccgttcatggagacccccggtgctgactccccgaaggtagccacaaaagttatcgttgagtacactg

SEQ ID NO: 5873 - DNA, 326 bp, Gossypium hirsutum
  Clone ID: uC-gsronu33B002b08b1
ttttcgcctatgcgtacggaaaactacaaccggggttaagaggctttatcagaggcaggccaatggaaccttggagctccctgctgttaatgtcaatgactgtgtcaccaggagcacgcatcggtaagcttgaagtggcatgtccatccactctgatctccctgatgtggcatgagtgacgatgcttagccgtatgatcatagagttgctaggtgaaggcacgcctgtgtgtcgcgcgtgtctatggaagatgctcgagcacaggtgttgtagcatgtttgtctcgatgcgagccaatgctcgcgttattgccactggtgatccat

SEQ ID NO: 5874 - DNA, 432 bp, Gossypium hirsutum
  Clone ID: uC-gsronu33B002b10b1
tttcgatttgcagcagctgccgccgccgctgcacgtcctctggtctccgtccaaaccatagaatctgacatggccactgactccacccaaaccgtaccactcgccgatgtcatgaaagcctcgatccgacccgacattgtcaccttcgtccacgacaacatctccaaaaaccgccgccaaccctatgcagtctccaaacgcgccggtcaccagacctctgccgaatcctggggcacaggccgcgctgtctctcgcatcccccgtgttcccggcggaggtactcaccgtgctggtcaaggtgctttcggaaacatgtgtcgaggaggccgcatgtttgctccgaccaagatttggcgccgctggcaccggaaaatcaacgttaaccagaagcgctatgccgctgcttcggcgatcgctgcctgtgccgtaacc

SEQ ID NO: 5875 - DNA, 517 bp, Gossypium hirsutum
  Clone ID: uC-gsronu33B002b12b1
ctttaattctctttcagaaacacattttcaaacctgaaatttccatttgtccattccaagctctcaccaatgggtctctcagttgagaattcggtaacacaatctcatacccgaacccacaaaaccttcctcatcaccaactacatcctcttgggagctgcttccgcctgtatcttcctcatcctctccctccgcttgctcccgtccttgtgtggattcttccttatcctcctccatgtcgtcaccatagccgctgccgtctcgggttgctccgtcgtcacttccgggtccaacaagttctacgcagctcacatggtggtggatggtgttgacatcgatattccagggctcggtttcggtgcttatattgacccgaacttctgatttcttggggtacttgaagtcctacgtgagggaagatgatggggcggtgatcctgaagttggctggtgggctatgctgtggctgctttctgcttggaatgatggtgttggggcttgctctgtgttgagatact

SEQ ID NO: 5876 - DNA, 609 bp, Gossypium hirsutum
  Clone ID: uC-gsronu33B002c01b1
gttatgaattgccattcaccttcaacaagatgaatggattctccaccgtggatggtttcttggagataaccgaatccgtagctgagatgataaagttcgtggcgaatgaaccctcagtaggacttttctacattcaacagcacaccgagaatgccattcctaacgtagttaatctccgtaatcacgttgtagaaaaatctcatgaagcaactttacacacacaagacttggaagattctatcaccacggtgagatcgatgaaggaatgcggtttcccaattgcagacgagatgattaaggacattaagagttccttaatgttaatgtcctcaaaacaaccgaagagaggattgatccacagtcctgcttcaagctttcagatgggaagaactagctcttcgggaccaatgtcttggaatcctgctgggaacatccagtttgatgggagtaattatttttcgactgtaatcaagtccgcagaacataaagcatgcaattttaagtggccacaacttgataccaggaacagatggtagccgagccccatagccaccttcacaccagctccaccgttatcagttgcatctgctagcactagttcaattcctg

SEQ ID NO: 5877 - DNA, 299 bp, Gossypium hirsutum
  Clone ID: uC-gsronu33B002c02b1
gttatcatctaccaagaaaagcgcccaacaggggggccgggtaggacatggagacctttctcatcatccaagcgggaggacaacccccggtgctgaagatgccctagtggacgctctacgttcgggtcagcataatagctattcgaccactggtggtattcttcccgcaagaagggcactagcagacaacctcaaccgggaccttagctaccacttatcgcccgatgatgtacatcgaacaataggatggactcacggaatagcagttggcatatcaatactgtcccgccccggggcca

SEQ ID NO: 5878 - DNA, 330 bp, Gossypium hirsutum
  Clone ID: uC-gsronu33B002c05b1
ccacgcgccgtttgcgttggaagcgcaggaccgaaagggcatgttagacatgttacacccagacagagggacaaaagtgacaaatgtaatcgcgagagccgagtcatcatccagctctgaaaagataccactatcatgaaacaaagaccttcagacacatgacctcagacagggcaaaacactttctgacgcgcaaggccccaggagctacatacgagactgccgcacattgagacaatggcctagtcgaagaaacgaacagaaagacaatagacggtgccggagcaccaacctacagaggagaacgattcagtctgaaagaaagttggg

SEQ ID NO: 5879 - DNA, 584 bp, Gossypium hirsutum
  Clone ID: uC-gsronu33B002c07b1
ttttcgtatgttgttgatggagcccactatgggtgctctggttgtcatcggtgtgaagctcaccagcgccttgggctcccaacaatccgttgcaaagctcgacgaggaaccaaagaaactctcaggcataatcttcgctgaacggaaggatatgctcttatagtgcatttcacaactttcattatgcacttcttagatggctggaagcagcttatcacacacctaacttgaagtttgtatgttaaatgtttcaaacagacttcacagctaggcgataaacgatggtcacatacagagtgaggacacacagagattgtcaatgatagggacgcaaaaacaagaacattcctgctagatccacagaactgcttcaagctttcagatgggaagaactagctcttcgggaccaatgccttggaatcctgctgggaacatccagtttgatgggagcaacttcttttcgactgtcaccaaggggcgggggctaataggaggccacttttaagtggccccaccttgttaccaaagaacagattggaagccgagccccaaaagccacctttcacaaccaggttcaccgtttt

SEQ ID NO: 5880 - DNA, 410 bp, Gossypium hirsutum
  Clone ID: uC-gsronu33B002c09b1
tttcgggtcttggacccgcaaaaggagatctgctctgggggactattaatgtccatcaacggttgaatcccaacgccacattgttagaatggaaagcgtacccaacagaacaggattactgtgctgaggggaggcctgcaagccaaacgtccaagtgtttgctggactactggagtcaagaccggatccagaagccccaaggggacgacaccgagaaacatgcaccctaaaaacactatgcctggtatggcgatgacgacgacccttatggtgaccctacccttaaaggcctaaacgggaatactttaaaagaataaacgccaatagtgacgttcggatgcaacatggtggcaactgcgagtgagttaccaacggtgaccgacaaagcgctcaaaatcgccaatgtgaaa

SEQ ID NO: 5881 - DNA, 323 bp, Gossypium hirsutum
  unsure (1)..(323): unsure at all n locations
  Clone ID: uC-gsronu33B002d03b1
gggccccaatccccgggacgccccacgccccacgcttttaccattcntcagcacgacccaaaaaaccaccaaacgggggaatttgaaacacccagcccgtccagacccacaagataccaccggaaaacaccaccggcgagaaaaaccgccggccaagagccgcagaggacccccacacaaactgacacccggggaaggccaacccagaagaccgccccccagcagcacacgaataccaagagggactacggaaggaacgcaagaacaccccacataaagtcccacaacacaacccaggacaaaaactcctgatcggacctttt

SEQ ID NO: 5882 - DNA, 468 bp, Gossypium hirsutum
  Clone ID: uC-gsronu33B002d07b1
caatgcttgatgatcttgggggtacttttgcttctcaccaggtagaaatggctatttacgcaaaggaactactgaagaggttccatgttagcattgagcaaacaaaggaaatctctgattataccagtggaattctggataagctttcggaagatactatgagggttgataatcatgctgtggaagctgatgaaattcaaatgaagagtattgctggcttccagaatgcttatcaggagcaatcgaagtttgatgcaaagaagcttattgccgatatgacaaatctcgtttatagccatgttcgtcggcaaaaagagctggtggatgcaaggctcgcagatctcaaagaaagtgctgtcgcaaacaaaacatttttagatggacatgtttcctccattgagggcatcacaacagatgcaaaacgcaaatggcaagcatttttcatgcacgcctaaaatgatgctaatg

SEQ ID NO: 5883 - DNA, 344 bp, Gossypium hirsutum
  Clone ID: uC-gsronu33B002d08b1
gttagtgggaactccctcaaaatgggctctggtgccactttgggaagatatttcttacttagactgatgatatccaattggaaatgaacaacgatttctcgatttccaaagctgttgctgttggggaccctgccacatgctgattccaagcaatggcctaactgatcccccaccccgttattgatggtttgtttgatatcttttcggggttaattcaatcgtaatttttatattttcccttcttacatgttgggatatgatatgctgatcggactagttgttaatcaatggagagacgatttgccttttacaaaatagaagggagaccccaatttcaaaaacac

SEQ ID NO: 5884 - DNA, 606 bp, Gossypium hirsutum
  Clone ID: uC-gsronu33B002d09b1
tttcgaatgttctttaacactctttatgacccataccggtccggtgctgacttcgttcgtggctacccttccagtctccgtgagggtgttaccactgccgtctcacacggtctctggctcaacatcccggattatgatgctcccacacagcttgtcaagccactcgagaggaacaccaggtatgtcgacgctataatgacgattccgaagggaaccttgttccccatgtgcggaatgaatctggcatttaaccgagaattgatcggccctgcaatgtactttggactcatgggagatggtcaaccaattggacgatacgatgatatgcgggctggctggcgcaccaaggttatttgtgatcacctcggatggggagtgaagaccggacttccctacatttggcacagcaaagcgagcaacccgtttgtgaaccttaagaaagaatacaaaggaatttactggcaagaagagttgattcctttcttccaatccgttgcccttcgaaggactgcaccaccgtacaggaatgctacatcgagatcttcaagcaagtgaaggcgaaactcggaaggtcgatgactactttaataagctgggggatgcttt

SEQ ID NO: 5885 - DNA, 405 bp, Gossypium hirsutum
  unsure (1)..(405): unsure at all n locations
  Clone ID: uC-gsronu33B002d12b1
cccacgcgtccgctttaaggaaagcctctaacaacagaggcttaattcgaaccgctttggagcttaccaaggagtccattgctgggattcaaatggaatacatagacatttcaccacttccaatgctagatacagatctggaagttgatggcaagtttccccctgcggttgaggctttcaggcagaagattttggagtctgatagcatcctttttgcttcccctgaatacaacttttctcttactgcgcctctgaagaatgcacttgactgggcttcaagaccaccaaatgtatgggcagataaagcggctgccatcgtaagcgccgggagaggctttgngtggtgccgcgatcacattatcatcttgcncaagtggggtttgncttgatctacattttatcaat

SEQ ID NO: 5886 - DNA, 410 bp, Gossypium hirsutum
  Clone ID: uC-gsronu33B002e07b1
cacccgggacgccccacgctggcggctggtcggccccgcgaaaagctgagagaggaggttgagaaacgagcacgagaaaagatcctccacacgcgggaggaagacaaggcaaacagaaggcggaccgcacgggcccacaccagaggaggccttcagcagcacctaaaccatctgcaaccagaggggcggagaaaccgagcgcatcgccagccaggcctgccacaacggctgaacatatgcgcgaacgcccgcgagcccggaagcaaaaccacaaggaagatgatgcgaaagccacgagagcagtccagactctccggacatacacaggcaaagaggccaggaaacctgacgaggagaaatggagaaaaagaagactaaatagccaaccgtggcaggaaagagcaaggagc

SEQ ID NO: 5887 - DNA, 587 bp, Gossypium hirsutum
  Clone ID: uC-gsronu33B002e08b1
tttcgggtctttgtaaaattttgggccttggatttattttgtatgttttgggtttgttgggcccgggcgaaaattaggccctacaaattatatttagtttgttggcctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaataaaaaaaaaaaaaaataaagggggggccccttttaaagtaccaaattttccttccgcgggttggaaacttataaatttttttatggggacactaaattcaacttcttgggccgtcttttaaaaaccgcaaaaagggaaaaacctggggaaacccaacatataaaccttgtgaaaatatccctttttcacattttgggttataaaaaaaagggccctacccttatacttttccaaaaatttgcccccctctatttgcataagaacccccccttatggggaaaataaagcggggggttggtgggttccccgattttttctttttttttttcgagggcctaaggcccccccttcggtttttcccatgttttttc

SEQ ID NO: 5888 - DNA, 476 bp, Gossypium hirsutum
  Clone ID: uC-gsronu33B002e10b1
gtttttcgttggagttgatgaattacctggccctgctactactcagcatggctctcagagagatcattctttcccattcctggagtcattgaatgaggtcttagaaacaaacagagttgaagagtcacagagccacgtccacagaatgtatttcatgggtcctaatactttcagcgaaccttggcatctgccccacactcctccagaagaaataaaagagattgtatatgagggtgcatacaatacattcgtggatgagatcaatgcaattgctgcttaccagtggtgggaaggagcaatttacagcattctttccattcttgcttatcctgtcgctttgtcatggcagcagtggcgccgcacaatgagattgcaacgactacgtgagtttgtacgatcagaatatgatcatgcctgcttacgttcgtgccgctcacgggctctatatgaggggcttaaggtctctgcaactaccg

SEQ ID NO: 5889 - DNA, 600 bp, Gossypium hirsutum
  Clone ID: uC-gsronu33B002f02b1
ctttttattttccccaaacgcttcccacaccttggacctactatcactaaaattcctctccttttttcgacgaaatctgcgtcccagaacttcttttttctggctcttttcccctttttgctggaatcaaaccattgatcttttggtatttttgtgaatggcggaaacaatttggagctgtagtatattgatgctctccccttgcaaatcgagggcgagcactctccttcctctttctgctgcttctgctttcgcattcggttcttgcaaagaaggctggtactaccgctgccttggccttgacccataaacaaccccacctcaatacctctattcctttccaccaataacccagatttgtttttttttgatatacgccccacaaaataacaaaacaaacccattgtttctcttttcgcggttgttggcgaattgctcattcatctgttttcggttttgattccttttcattttgaattttgaacaaaaaaaatttgaaagaatgttgctttacaagcaagagaaagaccagggtccccaggggcaacaggctcctgattagcgtcactgttctcggaagtgctgggccgatccgttttg

SEQ ID NO: 5890 - DNA, 304 bp, Gossypium hirsutum
  Clone ID: uC-gsronu33B002f03b1
cgtacgctttgtcggacgcgagggcggacgcgggggcttttcttctttagtatggttggttttggggcctaaaaggaggagctctagaaaaatgaatcagtggctcaagctgtgatccttcttccacttcttttccaggcatggagcccggggtccgttccgaagtcgcacccagagacgagtctacccgtaccgcgctgtgctgtgctgtgctggtgactgcgtcaatggctaaacaccgactaatcttatttgcaatgaccgcggcgtccacccacccttccacccccccgtacacaaaccc

SEQ ID NO: 5891 - DNA, 320 bp, Gossypium hirsutum
  Clone ID: uC-gsronu33B002f04b1
cccgggggccccaacacgcaaccccccccacgacccaccctacccaattgcccacccgacacacccaccccagcaaaaggtgaaatcaaaaacccaccaaggggcacccaaaaacaaaaaaaaacaaaacaccaacacaaccccacacagcacccacacaacaccaacaaccgaagaacacagaacccacaaacaaacaccacgacccaccacacaaaaagcacaacccaacaacaccacgggcaacaccaaccaagccaagaaacaaacctccaaacacacaagaccaaccacgcaagccaacacacgccccccacaca

SEQ ID NO: 5892 - DNA, 701 bp, Gossypium hirsutum
  Clone ID: uC-gsronu33B002f05b1
ggaagacccacgattacgaatcaaagagaaaaaaaaaaaagagggggaaagggaaaaaagaaaaacccaaaaccccccagaaaaaaagaagggaaaagagaaaggaaaacggcggagaggaaacagaaaacaagaggggcaaaaaaagacagaagaacaaaaagaggagacagcaaagaaaccggaaagaagcatgaaaagaaagaagaaaaaagggaaaccaagagaagcaggaagagggcaagaaaagcggggaggaaaagacaagggaaaaacgaaagagcggaagagaaaaaacaaaaaaaaccaaaagaacgaggaagaagaaacgaagacggaaagaagagaggaagagaaaggaaggaaagggggaaaaaaaaaaagcggaggaggcggcaaaaaaagcgggggagaagaaaaaaaagggaaagaaggaccaagaccaaaggaaaaaagagggagaaagaaggggcaaagaaaaaaagaagggaaaaaacggagaagggaggaaaaaggagggcaaaggaagcaaaaagggaaaagagaagaaaaaagggggacaaaaccagggggaaaaaaaggaggaaaaaagaaaagaagaaaaggcccaagggggcaaagaaaaagagaaaggggggaaaaaaaaaaggaaaggaggggccagaaaaaccaaaaaaaaaagaacaaagaaaaaaacaaag

SEQ ID NO: 5893 - DNA, 337 bp, Gossypium hirsutum
  Clone ID: uC-gsronu33B002f06b1
taccgacttcgcgaacagaccaaaacaaaggggggaaggggaaaaagaaaaccgttagcccccccaggacacaggcagggaaagacacaagcaaacggaaaggaacaccggggggggacacgccaccgcaagaggggagcaaacacggggagacgagaagagacggcacgaccacgaaagagacagagacaagggaccatacggaagcagaagaggcccagaaaagggggaccagtgcagaaggagaaaacacagcggcaacaagaaacccaacaaaacaaaaaagcgaggagcaccgcgcggccgcacagacgaaacacggaaaaggaagggagag

SEQ ID NO: 5894 - DNA, 340 bp, Gossypium hirsutum
  Clone ID: uC-gsronu33B002f10b1
taccggatcgccgccctttttttttttttttgcaaaaattaatatcaaattgcaattatggcccctgaaaaatagattacataaaccaaacaatccctcgtgttcttacaaatctataacagtgtaaaaggttccacaatatagacatgatacaccacagaaatgtacaatgcacaacaccagggtaacccaacatgccaagaacaaatttcaaaaccatgagcaacttgctgtcaaccatgctcctcacaaagatgcataaaaaaaaaaaaaaaaaaaaaaaaaaaaaaaaataaaaaaaaaaaagggtgcccacccctaaaggggggcaatttttttg

SEQ ID NO: 5895 - DNA, 592 bp, Gossypium hirsutum
  unsure (1)..(592): unsure at all n locations
  Clone ID: uC-gsronu33B002f12b1
tttccgctttcgcgtccggagctctacaaaacagggatgggggaaaccacatttgaaaagttggcaatgacatgttcatgtctctgcacaagcaatggagaagcatttcctggttgggacacacttctgaaagttggctgcaaactcggagaatgcagaattattctgtgtgaagccggtgataggcacagggtgcagaagttgcagctcaattttcccagtgatgatgttgcttttgcactgaaagatagcaaggatctgccatggttggccaagtacttatgattctacaagcctgcaattatatttcaattcttaaacatatagctacaggttttgaaccaattttcattataagatcctccttatatttaaatcacagtccttgcaatgttttagcttatgatctttggaagaggcagattgttccaatttgaggcattgttacttttcattatgaaaaatgctgatatgaactgaaacatntttctaattgttatttatatatacattctganaatggtttggccnannacaaaaatanttttttttttttttataaaaataaaaaatttttattttacaatttttt

SEQ ID NO: 5896 - DNA, 452 bp, Gossypium hirsutum
  Clone ID: uC-gsronu33B002g01b1
gactctcaccatcacggcttagacctagtcaacgcagccaactcaggtgagcttggagcccgtaggccaaggggccgtcctccaggttccaagaacaaaccaaagcctcctgtcatcatcacacgggagagtgcaaacaccctccgagctcacattcttgaagttgggaaaggctgtgatgtgtttgattgtattgccaactacgcccggagaaggcaaagaggaatctgtatattgagtgggagtggtaccggtgaccaacgtcagcattaggcaaccatctgctgctggagctgtggttaaccttcatggcagatttgagatactatcactttcaggttctttcttgccaccaccagctccgccaggtgccaccagtttgacaatcttcttggcaggcgggcaagccaggttgtagaagaggtgtggtttggggaaactcatgacggctg

SEQ ID NO: 5897 - DNA, 330 bp, Gossypium hirsutum
  Clone ID: uC-gsronu33B002g03b1
cgttcgcgatggctacaaaagagcttgcttaacaggaagttcaacctcaccttaagcagactattgttattctgcgtggaaggaaattagcctctactgtactccagtgtagcgtagcatagcatagttatattaattttagaatgcttgcttttagtttgttcatacaggtgttgcaattaaaattattaagctgatattcaactgttaaattattctgtaatcataatgttccaagttgttagtcgtctaaagtacagtatatattgtttcaaaaaaaagacaatcatattacctaaaaaaaaatttcaaaaaaaaatggttggtcgg

SEQ ID NO: 5898 - DNA, 55 bp, Gossypium hirsutum
  Clone ID: uC-gsronu33B002g05b1
catatttttttttaaaaaaaaaaaaaaaaaaaaaaaaaaaggaaaaatttaaaaa

SEQ ID NO: 5899 - DNA, 543 bp, Gossypium hirsutum
  Clone ID: uC-gsronu33B002g10b1
cgctttcgatttatactcatttagcccctttcattagcatggaaatctctccagtcttctttatcactgaaaaacgccttgctgtggtggaaactgtggctgcggctctggctgcaagtgtggcagtggctgtggaggatgcaagatgtacccagacctgaacgttgccgagatgaccacaactgagactctggctcttggtgtagcaccccagaaagcacactttgagggagctgagatggaattcggggctgagaacggctgcaagtgtggagacaactgcacctgcaacccttgcaattgttaatgattagagaccaaagccaaagcttccctggaagcagagacgcctttgtctttaagaaataatatgtctcgctgtttatgtgtttttagaataaagcagccatggcttgtcccaagttttgcctgttggccgcccggttccttggtgcttgcccatagatagagtgaagtactaattttacttgtttttctgtccaggggagcatccctgcttttctcaggatttattgggccatt

SEQ ID NO: 5900 - DNA, 475 bp, Gossypium hirsutum
  Clone ID: uC-gsronu33B002g12b1
cttacgcgtccgcccacgcgtccgcggttgtgtgtgagctgccccgggatgaggagtttgttcgtaggtggcaacttgcttgtgaagggaatatagcacatgtggtggtgatgcctaatgtgacaatcgaaaaactggatttcttcttgaatgaattagttgaaaaacggtcgacttggtatcaagggaatgttcaacctccttgtattgcagcagagatagggaaagcgaattgcgtttgtgctctgcacaagtgaaaaaaaatatcagtctatgattcgggaattcctctattttcatgcagcttgtcatttggttttaatgaaatatagattatattcataagtttttcgttttacattctcattgttatggtaaatagtagcgcctatcgacatgttcatatattggctattctgtctgccgcggtcaggggcttttgtgtgcggcttgtgacatattcatataccaactt

SEQ ID NO: 5901 - DNA, 453 bp, Gossypium hirsutum
  Clone ID: uC-gsronu33B002h01b1
ccctcgcgtccgcccacgcgtccgcgatcacttgggcagaaccccactgaggcagaactgcaagatatgattaatgaagtcgatgctgatggaaatgggaccattgattttcctgaattccttaacctgatggcaagaaaaatgaaggatacagactctgaggaggagcttaaagaggcattcagggtgtttgacaaggatcagaatgggttcatttctgcagccgagctgcgccatgtcatgacaaaccttggtgaaaagcttacagatgaggaagtcgacgagatgatccgcgaagccgatgttgatggtgatgggcagatcaactacgaggaggttcgtcaaagtcatgatggccaagtaaaggacctctccaactataaccaggattaaaaaatggggtttaaaaaaaaggaggaaagtaacagggcagataagtttgctaaatatcta

SEQ ID NO: 5902 - DNA, 518 bp, Gossypium hirsutum
  Clone ID: uC-gsronu33B002h10b1
tttcgctttcgcgtgggtcgaaatctttcagggaaaatggcctatttaaatggctttgctttaacattccagatggctatgtcatttgcaagcattgatgctggggtagcagctcgtcaccttctgcagcagcatcaaacgcaaagtttgccatctttccctaatctcccaacgccatcccgaccatcattcccatggcccggggcgcttcctccacttcctaccacattggcaacaggactgccccctctgccaagcattccctcaggccccacaatcccaattgcaatcccccctattcctttctcttctccaccattgccatctttccgtaatctcccaaaccctggggcgcttcctgcacttcctaccacattgccaagaggactgccccctctgccaagcattcccttagtccccacaatcccgactgcagttccctctattcctttcttttttccaccaccttctcggtctactccttgaaataccttttttttttctatctgctggatact

SEQ ID NO: 5903 - DNA, 618 bp, Gossypium hirsutum
  Clone ID: uC-gsronu33B004a03b1
ctgtgtgtcaacatattagctgcttggtcagaggctattggtcccactggtttggccaaggactcgaggaagaccatgttcaacatcatgtcaggtacatcaatgtcatgtccacatatcagtgggctagcagcgttgatcaaggctgctcatccagaatggagcccaagtgcaatcaaatcggctctaatgaccactgcctacacccaagacaacaccaactcgactcttagggatgcggcggacggatcgttgtcaaacccatgggcacatggggctggccacgtcgatccccaaaaagctctttcaccaggcctagtatacgacatctcgaccgaagaatacatcacattcttgtgctcactcggctacaccgtcgaccatgtcaagaccatagtgaaacgccccaacattacatgttcgacgaaattcaaggaccctggtgaactcaattacccatcgttttcagtcttgtttgggggcaaaggggttgttcgatacactcgtgaattaacatacgtaggccctgcaggttccatatacaaagtcacagtaaatggaccatcgacagtagggatcttagttaggcccagacactaattttagatccgtggtgaa

SEQ ID NO: 5904 - DNA, 255 bp, Gossypium hirsutum
  Clone ID: uC-gsronu33B004a05b1
tccttaactacccacccatccccacttttttttttctatacaccaccaacccctacctccgggggggtttaataaaaaaatgaccgtccgtataaaccaccccacatacactaatacccagccaccttctttttcctagacactcccacacaattgacccctaattccaagccctaccctatttctctcaaatgccagtggccccattcattttctctcctttacaaccccacccacatgagcccttttcttctg

SEQ ID NO: 5905 - DNA, 603 bp, Gossypium hirsutum
  Clone ID: uC-gsronu33B004a11b1
ctttatccttataaatccttaatcaatcatctcattcctttgtcatctaattattaaagcaaagatagatggctaaacttgccacctttttcgtcttaacccttctcttcgtttccactctatcctttgccgcccgccctggtccagctttccctaaccagtctcctaccaaaactcaagctaagggtattactgtggtggagactgaggttgagcggtcgactgaagctgttgaagatagctgccaaggagttggagaagaagaatgtttgatgagaagaactcttgctgctcatgttgattatatctatactcagaatcacaagccatgagagctttttatgaatttatggacatggtcttttaaattttaaataacataatcactcaagttaatttgtgttcgttacctcttcattatatatttcttcaatcttcggctatttttttcatacccgaaattatgattgttggttctctttcttaggatttcgctgccccttcgttcttctttcatataatcaccaggtctctttgtttccatccattcaatttgtttattacattctattttatctcttttctccttttttctctttcttc

SEQ ID NO: 5906 - DNA, 455 bp, Gossypium hirsutum
  Clone ID: uC-gsronu33B004a12b1
atagttttcaatggagtactccagctggtcatatacactaaggaaaagaatgcaattctctttacttatcctcctgctggatccgtcaccagcactggtttggtggtctcgtcaaagttaccaagattctctgatctttatacacttacgatagcaagtgcagatcccaagtcgatatctgcagggaaaccggttgagttgaccaaaagtgttactcaatggttcactaaggacggagtattggttgagggcctattctggaaagatgttgaaacactaataaatgattatgcgacagaaccaaagaaaaagaagtgattgtagatagtaagccttaccttgttaggttattggttagaccgtgaaatctgtcccgtgctgcaacctttggttagagtatgttcaccacaatcattggtttgaagaatttaaactaaaaacagaaaatgaacttt

SEQ ID NO: 5907 - DNA, 441 bp, Gossypium hirsutum
  Clone ID: uC-gsronu33B004b02b1
cccacgcgttcggtttcgaggtacttctgggatgggagtcgtgttaggttgcttcgtgttgatggcgacggcgttgacggcggaggctctggggtgccgttttgtttcgatttggataaggtggttgaagcttcaagcttggctattaggaacttttttattcctaagcaagtcagtgaaaattatataggctatgtgaagtggaagtttttgcacagggtttttagctctgcccttcaagttcttgctactcaagcaatgtttcgggctataggaatcgggtattctcgttcactcacttcagctgctgcacttaactgggtattgaaggatggacttggacgattaagcaggtgtatttataccggtagtttggcatctgctttcgataccaatttgaagagagttagggttacaacctcgatgctgttcacttttagc

SEQ ID NO: 5908 - DNA, 448 bp, Gossypium hirsutum
  unsure (1)..(448): unsure at all n locations
  Clone ID: uC-gsronu33B004b04b1
cccacgcgtccgaagctttggaaatctgtaatgaggagcagaagaaagtgttatatgagaactatgggaaaccagaccctgccaatgttgctaaagtgaaggctctatacaatgagcttaatctcaagggcgtatttgaggactacgaaagcaagagctatgagaggctcgtaacctcaattgaagctcatcctagcaaaccagtgcaagcagtgttgaagtcattcttagggaagatctacaagaggcagaaatagaatccagtttccaaagatgaatgtggctggaaaacctctcccactcttctgttctatgctcatttgtttgtcttaatattttataatcaatcatcttcttgttttctattccgacaaacattcggtttcagatttaaataaatttcatagagttctgtctcttanaaaaaaaaaaaaaaaaaaaaaaaana

SEQ ID NO: 5909 - DNA, 377 bp, Gossypium hirsutum
  Clone ID: uC-gsronu33B004b05b1
ccatgcgtccgcaaagagaaaaaaagctaggcaaagttgcttatatttatgaggagaggctgtcaaagtacaagtacttattccgtttatttttttcatatcattcactttatcaattttatttctatattatgttcttttttatttcttaatacttatttttttacttcttctttatttttcctttaaattaatttatccttatatttttctattatataatctattttaattttcttcttatttatattttttttaattctcttttcttttcaatttatttttttttttacatataattttttttatttctttttttatattctttcttttttctctttttaattattttacttcttatttatttttcttactta

SEQ ID NO: 5910 - DNA, 893 bp, Gossypium hirsutum
  unsure (1)..(893): unsure at all n locations
  Clone ID: uC-gsronu33B004b06b1
gcatgtaatatacgccaacagcatcgatatatactggggttgattttgcaaaaagttgtgtggtgtttccattattagaagtggtgaaagcatggaaaatgcattacgtgcatgttgcaaaggaataaaaattggcaaaattctgattcaccgtgatggagatgatgggaaacagcttatctatgagaagcttcccaaggatatttccgaacgacatgtcctcctactggatccggttcttggtacagggaattctgcgaaccaggccattgaactactgatacagaaaggagttccggaatctcacattatattcctgaacctcatctctgcgcctgaaggaatccattgtgtttgcaaacggttcccatcattgaaaatcgtcacttcagagattgatgttgcactaaatgaggaattccgtgttataccagggatgggtgagtttggggaatcgttactttggcactgatgactgatccgccattgttgacaaaagtccaactaaccaggtatcatatggaaaccggtgcttgaatatgaacattccaaatacatgtanaaggtattgggtaggatgatggagagaaagtccgttgagacctccattcaattaccttgtttctggtgccttaaagcctgattccgacttgcgtgaagtcgaaaatttattccaatctttccttttttaacaatccgtagaagtgccttaatcagaggtatgtggttggttggaaaaaaaaaagggcgccttaagacaattcaccttttgaattatttttttgacaacttaatgngccaaacaggtgaatgaaaaaaatggaaattttttgtttatatttttttattactatttnnnnatatttttatttaatttatttatttatataatt

SEQ ID NO: 5911 - DNA, 581 bp, Gossypium hirsutum
  Clone ID: uC-gsronu33B004b08b1
ttcctttcgtccgatcggctgtaatagccatgcattcccttcaacgttgaatagggatttcatccgccgtttctttcctattttccattttctgccctcagcttcatcttctcctacgttttcttctttcccaaattgcagagattgaatgcaaaacaacccaccccagaagctgacatgccgattccaaaaccaaggcctcgatccccaagaagcttccatcaaagtcattgaggatcttcaaaacgtggtgatgagggtcgtctcctccaactccaaacccaagaaagacaagttcttgatcgaaacttccagaaagattgacagtgtcaacaccaggcttgctgttgttgacatgaagctcgactccaagcctggttatttggagacttttgcaattggggttgcttctggtgctgcttttaatggaatttgcagtgttcttgctcatgtttttggagggtttcgctcagatttggtctttctgtaggactgctaccaagccttcttcttttcttaattcatttagattaattttcaagtaacaggtttttttatttggcttatcctggtttgggatt

SEQ ID NO: 5912 - DNA, 916 bp, Gossypium hirsutum
  Clone ID: uC-gsronu33B004b11b1
gatgagcttcaggtcattgtgggatttgttcaggctgcaaagagattgaagaccgtctgcaaatgaccccgataagaatgttcagacgggttttgagttgggttgtcaatgctaacagaaacttggtatcctaatgtccttgtcccctagtagctatatctgtaatatatatatatatgtatgtatgtacttgtggcttgtttatctttgcactccctctgttgagtaggttaatatttacttgaagctttagaggctctttcttcctttttgtttgattagttatatgtttatttattatccaaaatttgtgtttctagtacttttattttttccttgtgacttttttttatatgtattgtatactttgttatgttcatttctctctgttttatctatgtttattattaatattcttttctctcttcttttttctctcttttttattttttttcttttatatatattctttattatttttttttctttcttttattatcacttctacatctattttttatttcgtcttctcttatgtttcctttcttatttttttacatttttctactatcttttattatttatttctttttcatttattttctattatttattttacgttctatctctttataatctattttttatcttctctcctatatatatttttttccttatcttatttattttcttattttttcatttttctaatttcatttatttcttctcatcatatctcttatattatctttctttaacctatctcttatttcttattttatttgtctattatattttttactttttttttactttatttctttattatacattatttttctatcttatttattactttctctttatatcttcatttttttaatgtaaatagtttatttttttatatttatttttt

SEQ ID NO: 5913 - DNA, 544 bp, Gossypium hirsutum
  Clone ID: uC-gsronu33B004b12b1
taaaaatttgtagaatttggattccatcaccgtttgggtttttccttttttttttcctttgcagaatatctgaaaatctaggtggtatttttcttttactttgggtggctttttgaagaaagtggtgatcaaattgcctatttgttgattttggattttgctggggatttgcatattagattgcgctttagttgattatatacatatggctgtggcttttactcacctttcatgggggttatggagtggtaaacatcaagaacctagaattgctaatggatcttctttaagttcttcgccggatgccggtttattagattcggataatctgaagtttccattggttaagagagctaatatggcgtcttcatctagaaaagttaggaggaaatggcatatccgtgaagaaagaaagatagatagggaatatgatgtagttatcgtcccatcggacggagggtgtgtttcggggtccgaatccgatggttcagattactccattggatggaggaacctcatggcctggtttaacagtgatgatgaa

SEQ ID NO: 5914 - DNA, 485 bp, Gossypium hirsutum
  Clone ID: uC-gsronu33B004c03b1
ggaaggcgtcttgatacacgcccccatttattttatttttgcaaacaaattttcccttcaattttcgtataatttcctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttgttgatctggagcctactgttatcgatgaagtgaggactggtacgtaccgccagttattccaccctgagcaactcatcagtggcaaagaagatgctgccaacaatttcgctcgtggccattatacaattggcaaagagattgtttgatctctgcttggatcgtatccgaaagcttgctgataccgtactgggct

SEQ ID NO: 5915 - DNA, 263 bp, Gossypium hirsutum
  Clone ID: uC-gsronu33B004c04b1
cggtctctttcgcccacgcgtccgctattctcaagctttgagataggtatgacggggcgtgtcgttctatcatcccctttccctcttttttatttttttcttcttctttttctccctttttttcctttctttttcttcttctctctatttttcttccttcttcttcttctgttactactcttttcctttattctttttcctcttttcccttttctttcttttttatttttttctttctttttcttttcttctttttcctcttt

SEQ ID NO: 5916 - DNA, 447 bp, Gossypium hirsutum
  Clone ID: uC-gsronu33B004c06b1
aatttatttattaaaaaaaaaatatctcttataagggggggatataaaaaatttacgtgccctttaaaaaaacaaatctaattcactaatatttgcttcctatccttctttcccccttctcatttccgttgacgcatttatctacttttcccattgtagctttatgatttcttttttctttgttattccttcacccccttttcctcttccctattccttctctccttcttttttttctctcttccccttcatccttttatccttccccttttttccttctcttactttttctttattaacctcttctccctttctcactctttgttccttctctctttcctttacattttactttttccttcctattcttttctcctctcttctctttctcaactttctctctcttccttttttcttctctctcactctcttttcttcctcttcttt

SEQ ID NO: 5917 - DNA, 61 bp, Gossypium hirsutum
  Clone ID: uC-gsronu33B004c07b1
cttgcaagaaaaaaaaaaaataaacggaaggatataaataaaaaaaggggggttatataaa

SEQ ID NO: 5918 - DNA, 229 bp, Gossypium hirsutum
  Clone ID: uC-gsronu33B004c08b1
ttccatgcgtccgaaagatactaaatagatcagttgggaattaaaacctcatattccccaagttacgttttctagtcattaaaattaaatcccttactcccaatttgtctctttaattttttatcaatgaatatgatttgttggaatggtcattcagctcttctgctaaattttagcattggatgttgaaatgttctacaatgaacggttatgccatgatttagactag

SEQ ID NO: 5919 - DNA, 455 bp, Gossypium hirsutum
  Clone ID: uC-gsronu33B004c09b1
tcccacgcgtccgaagaaatcgataaaaatggcgagggcgagtgttcgatctggtctcctacgagcagcccttcgcggcggctctcgtcctactgctcctcccacgcgtggcttcgcttcctcttctcatcacgatgatgcttatgaaaccgcaaaatgggaaaagataacatatttaggtgttgctacctgcactgttttagcgatttataacctatcaaaaggtcatccccaccatgaagagcctcctgcatacccatatttgcacattcgcaacaaggagttcccatggggtccggatggtctgtttgagaaaaaggagcatcactagggatggccggatggatgcatatctttccgagttcggcgcatttttatcatttctctgagaaatcaatcagataattctgtggatcttttgtaattttagcactcgatttccgtttatggacttt

SEQ ID NO: 5920 - DNA, 356 bp, Gossypium hirsutum
  Clone ID: uC-gsronu33B004d04b1
gcattatgtgcagttgctagagccagccgcaatggtaagttccggtatgatcaacatctctgagcaggaacttgatctgccatgtagttccttgatatgtaccatcttctttcttcctgttatacggttaaacatactttaatgattcttttgaactccggtgtgtcggttatggatatggatatgtactagttcttttgcttactcgcctttcttttcctctctttttcgtttgcttctctttcttatttatttttctctccttcttattttttctctattcttctcttttattattttttctttttactctttcctttcttttttcatatctctttcttattattccttctttt

SEQ ID NO: 5921 - DNA, 846 bp, Gossypium hirsutum
  Clone ID: uC-gsronu33B004d05b1
cccacgcgttcgcccacgcgtccgcccacgcgtcggatttcttccgttgatctttggtagagattagctttttaatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagtttttggtattagaaaccctgaggaaatcccatgggctgaggctggagctttgtattttgatgagtctattggtcgttttactgttcttggctctggtttctactccattgattgttttcgctagtgagctttttttattctttcattgctattttattattttgctccgtttgacctgctttgatttttgttctttttttattattaactctttttatatatatgccttttttcttctccacttctttgattcttacattgattttttattatctttcccatgtctcttttatattattattttgttgtttctcacttatttctatttatttgccttacagcattctgtcttttatttactttttctttttctttttccttatttggttattctttctattattcttattttctacttggttttttttcttctttatcttttttttgtcttaatcttcatatattacttttttttttttatatattatttttatattttttatttgtttttatatttaatttatatttt

SEQ ID NO: 5922 - DNA, 137 bp, Gossypium hirsutum
  Clone ID: uC-gsronu33B004e01b1
ctcttcctttcgtatgagacccgcaagaggaaaagggagcgatcaaatacttacggagagacttctggaacaggaatgccaacacaaattgaggaccaggagacagacaaaatttaatatattttatactaataaat

SEQ ID NO: 5923 - DNA, 417 bp, Gossypium hirsutum
  Clone ID: uC-gsronu33B004e04b1
accatacgttctaacaaatatgctgatgactcggcgaacaacgctacttacataggggcccttgtaaagggtattctagctgctgatgaattcactggcaccatctgaaggcttatttcaaggattaatgtagacaatgttgaagacatcaggcaggctctacgtgagcttctattcacaactcctggagctattgagcaccttatctgtgagattatctttgaggaaaccatctatcaaaaaaccgcttccggcaagcccttcaatgatggtttgaaggaacgtggcgtcctccctgacatgaaggctgacaaggttactggagcgcttaatggaactcatggcgaaactttaaaccagcgtgtacatggacttgcacagtgataccagaaggactatgaatctggtgcccggttt

SEQ ID NO: 5924 - DNA, 350 bp, Gossypium hirsutum
  Clone ID: uC-gsronu33B004e08b1
tttatacggcaaatcccgtggcattgcttctgtgcggggccatgatgttgagacatggtccagtttccttcatttgccgatcgactcgaaagtgcagtgaaacgtgtaatctcagagggccagtatcgaactaaagatctcggtgggcaaagcagtacacaggaagttgttgatgccgttattgctaaactagattgattactcgtcttcttcttcactatgggttttccacagtaagattttcttaagttggtatatctcattcttacattttcagaataatatttttttttcgaaatactcgaaaatcaaacttataacaaacaacaaacaactgttgagttgtgaac

SEQ ID NO: 5925 - DNA, 403 bp, Gossypium hirsutum
  Clone ID: uC-gsronu33B004e10b1
tcccacgcgtccggtttttagtttgattttggtggggcataaaagatgatcaggagtgcagtccgtgaaatactatctttcagagcatccatgcatcgtcaacttccgatggagcaacacccaaacgtttggctccacgtggtccttcctcttctcctccatctccatctacgtcttcgccgcgaccaccctccacagcttgctctctcacatcctccccaagcgccggggtgttccgcttggccctatcccagccatccacagcctctgcatctcgttaatcttcgctgtcattttcaccggcatcctcctatcctcggtcgccgatattcgcgacacccgctggttctggcgccgtacgaaaaccattcacaaccccattccaatggtgcctctgcttccc

SEQ ID NO: 5926 - DNA, 114 bp, Gossypium hirsutum
  Clone ID: uC-gsronu33B004f02b1
aaaataatttttaaaaaaaaaaaaaaaaaaaaaagggggggggcttatagagaaaacaggtgtgctaacaaaagcatgcgatgttatagttttactatagcggtaacaaaaatt

SEQ ID NO: 5927 - DNA, 936 bp, Gossypium hirsutum
  Clone ID: uC-gsronu33B004f03b1
cccatgctttcgaataagcaaacacacactctcatggctgctctgtatttcctttggctgtgtaatggctactttcttcttcttcctcctctccttccttatctgcttttcacttctcaagtgctgagccgtttattggagtgaactacggccaagtggcggacaacttaccgccgccttcagccaccgcgaagtttctaaaatcgactttcattgagaaagtctgattgtaccgtttcgttcccgctatttttcttgttttgttatatttttctctttggattctttatcttgcccttttctgttcctatctcttctcttttctctctcctttttcttttttttctcctactttttcttatcctttttcccttcttttttttttttctcttctttcttctaattttctatctttttatttcttttcttcatttctcctttcttttttctttctattatctctttctcttttctctttacttattttcttttatttcgattcttttctttctcctctccttttttctttatttttactctctcttttcttttatttttctttctctcactcttcttttatacactttcccattattttctacattatctttatttttctcctttcctctattctcttttttcttttctttattttcgatgtcttcctttttttttctctcttttcttacttttatttttttttctcttcattctctctatctttttcatttctcttttttttttctttcttcttcctctactcttttatactttactctttttgctcttttttctttattctcttacttctcttttctccccctcattctctcattatcctttttcttttcttcgtttttctatattttttttttttatttttttcttcctctccctcttcctacattattctccctccccccccctctccccccc

SEQ ID NO: 5928 - DNA, 933 bp, Gossypium hirsutum
  Clone ID: uC-gsronu33B004f05b1
cccatgcgttcggaaatctccaatttttttcccttggtctggtaaattgatcctttgcttcggctttcagtctttgccttctagggtttatcacttgttcctaagcttcctttacgtcgttttcgtctttacagagtaacgaatgaaactgtatgcaattcatagtcactgctatcttggaaaagaaccgatataagcatagatggcttctgagctggttcaattcttccatcatgtgacaaattggctgagattggactgggcttagaacatttgaaatttgctagttatttgctctgtgatcaaatgcttttcttattattgttgttaatgtctttttttatcttctcgtttatctattttcctatatcttaattttttctcttttttatgttctttttggctttttcctttcaatgtctgtcctatttctcttcctattccttgttattttttttttgcttcttcttcatgttttctcattgtttttttctcttttttccttttttttttttttcttcttgttattcctttttcttcttcttgttttttttttcattgttttttatatattattttttatctttcatttttattatcttccttttctatctgttttgtcactttctttttttttattctttctttttattctatttttctactttcgtctcttcttatttcttttctcttctacttattttctttcttttcttttctttttgtttttcttctttgttctctttcttctcttttttctttatctttttctttttttttacttctctttcttccttttctattttttcttcatatctttttcttcctttttttctatttttttacttccttcttttcttttttctctgtttgtttctttttttttttctttttttttcttttcttttttctttctttcttttattttcttat

SEQ ID NO: 5929 - DNA, 67 bp, Gossypium hirsutum
  Clone ID: uC-gsronu33B004f08b1
gacccggcctgacctccccgacccacccacccgaccttttattctagctaccccacgcccccccacc

SEQ ID NO: 5930 - DNA, 568 bp, Gossypium hirsutum
  Clone ID: uC-gsronu33B004f12b1
ttaattgtgggcatcaacactacatcaaccggctgggttgttgttgatgcttgttgcttcttggttatgctttacaaacttatgtcatattggtttgttgagctcttggtggttcttttctgcataggtggtgtggagggccttcaaacttgctcggttgctttactgtcaagggggttcaagcgtgctggaaaaacatacattaaagtgcctttctttggaactctctcataccttacattggctggttcccctttctgcatagcatttgctggtggttgggctggttaccgcaatgtttcctttgcttggataggtcaagatatactaagaattgctcttataatcacaggtctgccaattggccatggacctaatctcaaggggggaacagttctactcagttgggccttcttgtattgacaatctttgggtatttgtttaaaaaagttgttccataaagcgtgatgattgtgggtgctcctggggatagaagcggagaggatggcatcccaatgctactgaagatcccacgcatgtttgatccatgggcgggtatagcataata

SEQ ID NO: 5931 - DNA, 396 bp, Gossypium hirsutum
  Clone ID: uC-gsronu33B004g02b1
cccatgcgtccgaggagacagttttctttgctctggcttgacttcatatgtccggcgataggatatcccgaggtccattgcgccgtcgttgtggcccatgtgacttaattcttctaatctattttatgtcttccctaattggccatcttatgtctctattctacccatattatttcttcttctttactatattattttattttttttatctttttaatctttactatcttctttttttttaaaaattttactcttctttttattttatttttatttttttatattaatttattcttttatcttttctaatatttttatattttctttctaatttatttttttatataatttatttacttataatcttatttttatatttcttctattttatttact

SEQ ID NO: 5932 - DNA, 506 bp, Gossypium hirsutum
  unsure (1)..(506): unsure at all n locations
  Clone ID: uC-gsronu33B004g05b1
taggttcagttcttgaacatgcttcttaagttgatcggtgccaagaacaccatggagattggtgtctacactggctattctctcttagccactgcccttgctatccctgatgatggaaagatcctagccatggatgttaacagagaaaactacgagctgggtctgcctgtaatccaaaaggctggtgttgcacacaaaattgatttcaaagagggccctgctttgccagttcttgatcaattagtggaagatgaaaagaaccacggatcctttgacttcatctttgtggatgctgataaagacaattacctaaactaccacaagaggctaattgagctggtgaaagtaggcggtttgatcggctacgacaataccctatggaatgggtccggtggtagcaccacctgatgcgcctctangaagtacgttaggtattacagagacttcgtcatggaactcaacaaggctcttgctgttgatcccaggattgagatctgcatgctccc

SEQ ID NO: 5933 - DNA, 67 bp, Gossypium hirsutum
  Clone ID: uC-gsronu33B004g08b1
ccgcctggccgacccggcctgacctccccgacccacccacccgccctttctttcacagagacacgca

SEQ ID NO: 5934 - DNA, 87 bp, Gossypium hirsutum
  Clone ID: uC-gsronu33B004h01b1
gcattactaataaacatcaacaataaatcgcacttgggcagcattaatggctactccaagtgttgagtatacgtctatctcattgga

SEQ ID NO: 5935 - DNA, 323 bp, Gossypium hirsutum
  Clone ID: uC-gsronu33B004h03b1
tggcttttgacatgggggttgggcttgatgtgggtggggtttatttataaatgtgggggggagaattcaaatttttaaaatataaaccaaaaaaaaaattaaattaatgtttggcattggtttattccaaattaatatattctcactattaaacttatccaataaatactctattatgttaatttttataaaaattaaatttttttgacccattaattttaagctattttttataattttttcaaccttaaaccctatatttttctaatggattatcatttattatttgggggcccctttttttagaacccaaaattttacct

SEQ ID NO: 5936 - DNA, 601 bp, Gossypium hirsutum
  Clone ID: uC-gsronu33B004h05b1
ttcctttcgtccgcccacgcgtccgcttgttctctggtttcgtttcagatttcagatctgatcaaagaacaaccaaacaaacaggttgcttagaagtcccaagttagagaacatgggtcgtggagtcagcagtggtgggggacagagttctttgggttaccttttcgggagcggagaagctccacctccaaaaccaaccaacgtcacgagtactggcaccaccagtaatgaagttcctcagaagcagattgaggttgtgaaggaaactgtgcaaaaaccgaccactgcttcaccatcatcgggtgatgccaaggagatccctgcaggtgttccagggagcaaaacgaacaactatttccgagctgatggccagaattgtggcaactttcttacggagcgcaggacaactaaggttcacgcagcgctggcggtgggtcttccttggattacctgtttggtggcagcgagaagtgatatgtgagatataaaatgttggaaccactgtttatggttggtctaaaaggttgggacagaaaatattaagtataaccaattgttgtttccttccatctggacttttggacttcaaatagctttttct

SEQ ID NO: 5937 - DNA, 123 bp, Gossypium hirsutum
  Clone ID: uC-gsronu33B004h08b1
ttgcttttgtcatgggggttggcttgatgttggtagggtagtttatgcttgttgaggggtaaattgcaattatgtaaaatagaaacgaaaaaaaaattaaatctaatgttttgcattggtttt

SEQ ID NO: 5938 - DNA, 122 bp, Gossypium hirsutum
  Clone ID: uC-gsronu33B005a03b1
aaataaaaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5939 - DNA, 367 bp, Gossypium hirsutum
  Clone ID: uC-gsronu33B005a06b1
ccctctcgtccggtaaaaaccaagctatatgcatgcataagccttgcctgcactgctttcagagggtcttagtatgcaccctctttgtatgcattggccacgtggactccggactatcgaccacctctgagcgactgatctacaaactgggtgggattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgactttatcaagaacatgattac

SEQ ID NO: 5940 - DNA, 443 bp, Gossypium hirsutum
  Clone ID: uC-gsronu33B005a12b1
gttccttccttcgccgtctactgcacttgtgacatcgatttcaagtgaatcagaatgggtaaggaaaagagtcacattaacattgtggtcattggccacgtcgattccggaaaatcgaccaccactggccacctgatctacaagcttggtggtattgacaagcgtgtgattgaaaggtttgagaaagaagctgcggagatgaacaagaggtcattcaagtatgcttgggtgcttgacaagctcaaggctgaacgtgagcgtggtatcaccattgatattgccttgtggaaatttgagacgaccaaatactactgcactgtgattgatgcgcctggacaccgtgaccttatcaagaacatgattactggtacctcgcaggcttgatgggctgttttgattattgattccaccactgggggtttgggggctggtttctccaagat

SEQ ID NO: 5941 - DNA, 222 bp, Gossypium hirsutum
  Clone ID: uC-gsronu33B005b05b1
gtctccttgtattgaagaaaaaagatggctcgtacgaagcaaactgctcgcaaatcaaccggagggaaggctcccaggaagcagctcgctaccaaggctgcaaggaaatctgcgccaacgaccggcggagtcaagaagccttaccgctaccgtcctggaaccgtcgctcttcgtgaaatccgtacatatcaaatgagcaccgaacctttttgatccgtaagt

SEQ ID NO: 5942 - DNA, 112 bp, Gossypium hirsutum
  Clone ID: uC-gsronu33B005b10b1
ttcttttgggatccaatcatggatgcaaatttgattgttttaaacttgtttggggtctctatggaaatgtcaatttctgactattgtgaaatgcagttgaagctttatcaat

SEQ ID NO: 5943 - DNA, 555 bp, Gossypium hirsutum
  Clone ID: uC-gsronu33B005b12b1
ccctctcgtccgcccacgcgtccgaaggggaaaggaaacaactctccttccttccgacgataaaaacccttccccttcctcttgctcttcatttcaattcaatcttcctgagtcaaaggactgcgatggggcagcaatcgctgatctacgccttcgtggcacgaggcaccgtcgttttagccgactacactgagttctccggcaacttcacctccattgcttctcagtgcctccagaaacttcctgctttcaacaacaagttcacttacaactgcgacggccatacctttaactatcttgttgataacggctctacttactgtgtggctgctgttgaatccccttcgcgacaggtgcccaattgcctttcttgtgagaatcacggagggctttcccccgagtctttgtcgaggtctcagttttccttttctttcctccatctatcattttttcccttatccccatttcattctttcttttctcccattcactctcccccattgttctcttttttatatattaactctcttgtccatctcttctccttcctttttt

SEQ ID NO: 5944 - DNA, 136 bp, Gossypium hirsutum
  Clone ID: uC-gsronu33B005c04b1
tgctatttttcctaactatagggtctccgatactcaagcacttgtcctacgcatggcagagccctgtactgatgacctgcgacaggacgcggcttattttgctggcattacatccgattttttacaggtgggatat

SEQ ID NO: 5945 - DNA, 235 bp, Gossypium hirsutum
  Clone ID: uC-gsronu33B005c10b1
cctacgcgtccgtccacgcgtccgcccacgcgtgcgccctctcgtccggtgctctgcagaatgcttcttcagttgcaggaatggtccttaccactcaggccattgttgttgagaagcctaagccaaaggcttccgcagctgctgctccatcaggtcttgctgtataatgagttggatatatgcgcttattaggttttctgaagacgaagagctgtattcttgccgttaatcacat

SEQ ID NO: 5946 - DNA, 448 bp, Gossypium hirsutum
  Clone ID: uC-gsronu33B005c12b1
cgttactttatcaagaacatgattaccggtacctgacaggctgactgtgctgttctcattattgactcaaccactggtggttttgaagctggtatctctaaagatggtcagactcgtgagcatgctttgcttgcttttaccctcggtgttaggcagatgatttgctgctgcaacatgatggatgcaacaaccccaaagtactcaaaggcaaggtttgatgaaattgtcaaggaagtctcttcttatcttaagaaagttgggtacaaccctgtgaagatcccgtttgttccaatctccggttttgagggtgacaacatgactgagagatctacaaacctcgattggtacaagggtcctactctgcttgaggctcttgaccagatcacctagcccaagaggccctcagataagccacttcgtcttccacttcaggatgtctacaagattg

SEQ ID NO: 5947 - DNA, 111 bp, Gossypium hirsutum
  Clone ID: uC-gsronu33B005d02b1
gagtcccatagatttgtccaataatttcctcagggggagctttacaacattttgcgcataaacgacaagtctgcagaaggagaagctttcaaacaacccgcaaaagaatca

SEQ ID NO: 5948 - DNA, 567 bp, Gossypium hirsutum
  Clone ID: uC-gsronu33B005d04b1
ccctctcgtccgtctgaatcgcaaaagggaatttgcagttgtaaaagatgggtcgcggagttagcagtggcggtgggcagagctcattaggttatttgtttggtagcggagaagctcctaaaccagggacaaacatctcccaagctgctccagctgaagcaccagctgtctccaaacctggccctgctcctgaaccagtagatatttccaagcaaattcctgctggtattaacagtatttccgcaaacaattacatgcgtgccgatggtcagaatactggcaatttccttacggatcgacccttcaccaaggtttattctgcccctggagggcggttttttttttgacttcccattttgtggaccttgaggtagttaatgagattgtgcccttattaccctttattacatcttttttaagggagaggttttgttgttggttttgtggaaagcgtctatctgtgtgttttgaatttttttctttatttttttttcctcttttttttttccctttccttttttttatttttttttcctcttttttttgtttttttcttttcttttttca

SEQ ID NO: 5949 - DNA, 546 bp, Gossypium hirsutum
  Clone ID: uC-gsronu33B005d05b1
gtctaaatggttgagaattttgagatgggtgtgtgaaataagactcctgagttcatcaagatgaaccctttggggaaggttcctgtgttggaaacacctgagggtcctgtatttgagagcaatgccattgctcgttatgttgctcgcttaaaggttaacaaccctatatgtggttctacattgattgattatggtcatatcgagcaatggattgattttgcagccatggaaattgatgctaatattgcaaaatggttctatccaagacttggttacggtgtttaccttcctccagctgaggaagctgctattgctgcattgaagagagcccttggcgctttgaacactcatcttgcttccaacacatttcttgttggacattttgtcacccttgctgacattatcatgacatgtaacctctacttgggtttctcccagatcatgaccaagagttttacctcggagttccctcatgttgagaggtacttttggaccttgggtaatcagccaaaatcaagaagattcttggtgaagtgaaacaggcag

SEQ ID NO: 5950 - DNA, 264 bp, Gossypium hirsutum
  Clone ID: uC-gsronu33B005d10b1
cgtcttgccctgaaagacacactcaactgggggggacattttacacctcttgtggcgagatgctaccgaccttcgcgagaaattcgaagcctacatgcttgggaacgatcaagtctcaattcccagaacgatcgactcccaagctgctccggttgaaacaccaacgttttttcaatcctttccctgctcctgatcccatataaatttcccagccaaatttcttgcggttataaacataatttccccaaaccaattacatgcctg

SEQ ID NO: 5951 - DNA, 342 bp, Gossypium hirsutum
  Clone ID: uC-gsronu33B005e01b1
ggtctgtctattgaattctttccttcactttctggagaatttaaaaatgtcttcaggttgcaattgcggatctagctgcagctgcggatctggctgcaattgcggtgagaactgctcaatgatccttaaccttggatccttgctgtagtccaccagttctttatccctcttctcttttctttcatcttatttaatgaccttttcgagtttttctttattcctcacttttttaatcctttttttattttctcctctttttctcttttttttctctatcttcctttctttttggctttcttttcttcttttttctctccccacttttttttttctctctttttc

SEQ ID NO: 5952 - DNA, 211 bp, Gossypium hirsutum
  Clone ID: uC-gsronu33B005g01b1
ctctccttctcttcaactccacctgctaaaatgcaccaatttccggtgcttctcagcctcatcgcagtgtctgtactgctgatggtaactccagtcattggataccgtccatggcctcacttaaaacccaacagctccgatttaacgtttggaagctccaagaaattcgagggctcatcagagatcgtccaaatgagttaccatatggaac

SEQ ID NO: 5953 - DNA, 122 bp, Gossypium hirsutum
  Clone ID: uC-gsronu33B005g05b1
ctctcgcgtacgaggacgcgtggtccgacgcggggagttctttaatactctgtgtggttctagaattcatttgtggtctggaagtttaaaacggttcaggcccttggccccttttgcccctt

SEQ ID NO: 5954 - DNA, 566 bp, Gossypium hirsutum
  Clone ID: uC-gsronu33B005h02b1
ttccgtgtcgtcccacgcgtccgttaatcgatcgaccacacaccgttcatgttgtagttgcgccttctataaataaaggaaggtgccaaggaggaagggagatttgttcattaaagctttttctttttatttctttttctattttttttcttctttcctattttttgttttttttttttatcttttcttttttttctttttaattctttctcttttttttttcttttcactctattttttttttccttttttttctttatttttttttttttctatttttttatctcttattttctttttattttttatttttttctttcttttttttttattttctcctatctctcttttttatctatttcttctttttttactcttttctcttctcttcttttctatattttacatctctattttttatctttttttttttatcttcatcttttttcttctttttattattattttacttttccttagtattttcttatctatcccttttttatctatttatattttttattcttttttttatttttcttcttttttactttttctttcttctt

SEQ ID NO: 5955 - DNA, 157 bp, Gossypium hirsutum
  Clone ID: uC-gsronu33B005h08b1
ccctcgcgtccgaaaaaaaaaaaaaaaaaaaaaaagagaaattgaaaaaaaaaaggcgggaaaaaccacaaaaacccaaaaaaaaaaaaaaaaaaggcgtaacccggccgggggccccagttaagcgaacccaacttccccccccatgccacgcaaa

SEQ ID NO: 5956 - DNA, 127 bp, Gossypium hirsutum
  Clone ID: uC-gsronu33B005h11b1
gaactcctattcttgctcttctttcttgggtttttacaagaaaagggcgctctcggaaccagtaggggaaaagggcggtcttgccaaaaattggtgaatgggatgtccacttcctgctctgctgcgg

SEQ ID NO: 5957 - DNA, 273 bp, Gossypium hirsutum
  Clone ID: uC-gsronu33B007a11b1
cccacgcgtccgccttattttagattattgaactgatgttttctatatatataagtcttgggtgctgtggtatttccatggatgggaataaagatcagtcaagaaacattaatattactagcagaagtactgcatgttagtgtttctcttctcttactatgaatagaaagcgaatacaaagtggtctctcattctttaaaaaaaaaaaaccaaaaaaaaaaaaaaaaaaaaaacaacaacacaaaaaaaaaaaaaaaaaaaaaaaaattaaac

SEQ ID NO: 5958 - DNA, 87 bp, Gossypium hirsutum
  Clone ID: uC-gsronu33B007b01b1
aaataaattaaaaaaaaaaaaaaaaaaaaaaaaaaaaagaaaaaaaaaaaaaaaaaaaaaaaaaaaaaaaaaaaaaaaaaaaaaaaa

SEQ ID NO: 5959 - DNA, 552 bp, Gossypium hirsutum
  Clone ID: uC-gsronu33B007b02b1
cggtcgcttgggtgaagttcaaatcagatctgtcaaaggcatttgatgaagccaccacgtttcttaacagtattcaaatgcagctttctcatctctgcaatgggtcatcggaagaagacttaagtggaggtgagatggtaccccatgattatcacaaaaatggagaccctcaactcaaagacaaactcttggagaaatatagtggttatattagtacacttaagcatgaattttcaaaacacaaaaagaaaggcaaactacctagagatgcaaggcaaatattgcttcactggtgggatcttcactatacatggccatatccaacggaagcagacaaggctggtctagctgaagcaacaggactggaccagaaacagataaacaactggtttataaatcaaaggaaacgacattggaaaccttcggagaacatgcaaatcgcaattatggacaatgtatatggaccgttttcctgaatgtataaggtgggattcgcacttgaatatcattcatcctcacctttatgcttatcaaaccgttcaacgttgtttt

SEQ ID NO: 5960 - DNA, 535 bp, Gossypium hirsutum
  Clone ID: uC-gsronu33B007b04b1
caaggctgtctgcagtttgtcatcctgaagcccattttagtcgctgttacactcgtattatacgccaaaggaaaatataaagatgggaattttagtccaagtcaagcatatctctatcttactatcatctatacaatctcttacaccgtggctctgtatgctttggtgttgttttacatggcatgcagagatctccttcagccattcaatccagttccaaagtttatcatcataaaatctgtggttttcttaacctattggcagggtgttctgttttttcttgccgcaaaatctggatttataaaggatgctgacgaagcagctcaatttcagaacttcattatatgtgttgagatgcttcttgctgctctaggtcatctttatgcatttccatataaggagtatgctggagcaaatattggtatgctccgtggttttacacgaagccttgcacatgccttgatgttgaatgacttctatcatgaatctggacaccagatggacctacgtattatgattatgtactgtccgacca

SEQ ID NO: 5961 - DNA, 487 bp, Gossypium hirsutum
  Clone ID: uC-gsronu33B007b05b1
gctctcttaaccctacaagggtattggtgattgtttcaagcgaacgattaaagatgaaggatttgcctctttgtggagaggaaacaccgcaaacgttattcgttatttccccactcaggccttgaactttgctttcaaggactacttcaagaggcttttcaactttaagaaagacagagatggttactggaaatggtttgctggtaacttggcatctggaggagctgctggtgcttcttcccttctgtttgtctactccttggactatgcgcgaacccgtcttgccaatgatgcaaaggctgcaaagaagggaggagagaggcaattcaatggccttgttgatgtctacaggaagactttaaaatctgatggtattgctgggctttaccgtggtttcaatatctcatgtgttggaatcattgtttaccgtggtctatactttggaatgtacgactccctgagccagtggtgctaaactcttggtata

SEQ ID NO: 5962 - DNA, 407 bp, Gossypium hirsutum
  Clone ID: uC-gsronu33B007c03b1
gatgggtatctatacttctatgatgggggatggtgggggggtcgattcatgtggctcgggcataattgaactcggcgtaccatattctgatcctctggctgacgggcccgtaatccaggctgcggctacgcgttctttggcaagaggaaccaacttgaatgcaattcttttccatgttgaaggaggtggctccacagttatcttgcccgattgctttatttgcatattacaacccaattctaaagcgtggggttgagaaacttatgtccgctataagggacttaggcattctatgtctggtggatcccagatgtccctctagaagagaccgaacttttgataagagaagcttttctaaatttattaatcgttctttaattgttacaacaccaactacgcctacagac

SEQ ID NO: 5963 - DNA, 170 bp, Gossypium hirsutum
  Clone ID: uC-gsronu33B007c05b1
cccacgctaccgatgaggaaaatcatgggtgccaaaggtcttttcttctttgcttggctttccttttcagctgtctcggcatatgcacaggatgaggaagaccaaggtcttgctctgaacttctacaaggactcttgcccccattctgacgacactaacaaggaccaagt

SEQ ID NO: 5964 - DNA, 581 bp, Gossypium hirsutum
  Clone ID: uC-gsronu33B007c08b1
cccgacctttcaacaacagcagaggctcttaaggggcttgattcatgtggctcggacataattgaactcggtgtaccatattctgatcctctggctgacggtcccgtaatccaggctgcggctacgcgttctttggcaagaggaaccaacttgaatgcaattctttcgatgttgaaggaggtggctccacagttatcttgcccgattgctttatttgcatattacaacccaattctaaagcgtggggttgagaaatttatgtccgctataagggacgtaggcatacaaggactggtggttccagatgtccctctagaagagaccgaacttttgagaagagaagctctcaaaaataagattgaactggtaatgcttacaacaccaactacgccgacagaccgaatgaaagcgattgtggaagcagcggaaggatttgtgtacctcgtgagctcagtcggagttaccggtgcccgtgcatctgttagcgatcgggttcagactcttttaactgaaattaaagaggtaacaaccaagcctattgtggttggctttggcatatcgaaacccgagcatgtggagca

SEQ ID NO: 5965 - DNA, 429 bp, Gossypium hirsutum
  Clone ID: uC-gsronu33B007c12b1
cccacgcgtccgacttggtctcttgggagaaggaaaatgtctctagtgaagctctggaagctgctcgtattgcttgcaacaagtatatggctaagtatgctggaaaggatgccttccacttgcgagtccgtgttcacccattccatgtcttgcgtatcaacaaaatgctttcatgtgctggagctgataggctccaaactggtatgcgaggtgctactggcaagcctcagggaacatgtgctagagtagccataggtcaggtcctcctttcagttcgttgcaaggacagcaacagtcatcatgctcaagaggccctccgacgtgctaagttcaagttccctggtcgccaaaagattattgtcagcaggaaagtggggcttcacgaagttcacccgaactgattatttgaaatataagtcagagaatcgc

SEQ ID NO: 5966 - DNA, 71 bp, Gossypium hirsutum
  Clone ID: uC-gsronu33B007d04b1
gttgacttggaggtggtggtggtggtgcccccgggaggggttaaaaatgactggggcctaacaaccccccc

SEQ ID NO: 5967 - DNA, 494 bp, Gossypium hirsutum
  unsure (1)..(494): unsure at all n locations
  Clone ID: uC-gsronu33B007d05b1
aattaaatggcggaaagagcaccgatcgaatccgtacaatgcttcggccgcaagaagacggcggtggcccttacccactgacagcgaggccgtggccttatcaagactattggtcttgctatctcgctttgtgtgctcagcagcctacttcacgtggcatccttgcaaccaaaggtattggcgctgaagttttcgacaagcctcaacctaactctcctactgtttatgactngccttttcagcggtgagacccggagcatgtatcaccgttgattatgcggtggctgacggcggcggatggatccaaaaccactagcagaaggttgcagctactgaaggagcaggatttgcatgtaaatatatatatcgtcctttttaaaagttcttcaatgggtcaattaagtagtagtagtaagtaagatgtttaaaagagtaagcggcagcgcagggtggtcgatgaccttatgtcattcaagatcccgcccgtgagcgcg

SEQ ID NO: 5968 - DNA, 386 bp, Gossypium hirsutum
  Clone ID: uC-gsronu33B007e01b1
cttaatttaaagcctagagcttgtgacatgcctgggggactctcgctaaagaggggatatacaatccaccaatattcacatgtactgcataagttgtgccctgacaaagccttggcttcataattatcctgcatatgttgcatgaagttgtgaacattgaagggtattttcaggcaaccttatctgttttgtcttctatatctcggttaaagttttaagactgtttgagatgtttgtctagtactattagatattatgttggggatttgtggtttgatctgtgtaagcagttatcttaacatcctaaatgtttgaaattgaaacttttgttcttcttatatggtctataatatgcgagatagattgtttccttcccaaaaaaaaca

SEQ ID NO: 5969 - DNA, 580 bp, Gossypium hirsutum
  Clone ID: uC-gsronu33B007e03b1
atttcaaagctctctctctctattctctttggcttatctatcgctttgatttcgcatgcttgctgtgcactcgatggcaaatcgatggttgaggcctgaggtgtatccgctgtttgcggccgtaggtgttgctgtcggaatctgcgggtttcagttggtgcgcaatatctgcatcaaccctgaagtcagggtaaccaaggagaacagggctgctggggttttggacaactttgctgagggagaaaaatattctgaacatttcttgagaaaatatgtccgcaacaagacgccagaaatcatgcccagtatcaacagcttcttcactgacccaaagtgaggcttcactcttgctttatgctgaaactaaaaaataaaaaaaatagaagaactaagtcttattcaatcaataccaagttatgccctttctttctgctgactgtgatgcaaatttgtgttggttttgcacttggatgaggtgtgttctttaagagaataaaggtggtgtggattttttgaacttatcatcctttttattctatctcttttattaaatcttcttttttttttctttcattatttt

SEQ ID NO: 5970 - DNA, 401 bp, Gossypium hirsutum
  unsure (1)..(401): unsure at all n locations
  Clone ID: uC-gsronu33B007e05b1
cccacgcttccgtagaaacaatgttaccttttgagaatgacatgagagtcaaaggttacgactacagacagtgcgtcggattaaaaataaaaccacgaaaaggggacggacttcttttctattcactctttttgaatggcacaatagatccgacatctctgtatggaagctgaccatggatcataggagagaaatgggttgctacaccgtgggcctgagaccaagaccacagtgactgactattcagtgtttctgtagaaactatggctcattatcggtgtttatttttgacgctaatcatcatataaactctgttttggatagtataattctttatgaattcactcccactttcaaaaaaaatttcctgtttnngnaattnaatgaaccgggtggacttt

SEQ ID NO: 5971 - DNA, 222 bp, Gossypium hirsutum
  Clone ID: uC-gsronu33B007e12b1
ttatctagtagagcttggacttgccaaggagaatggcacccaagtgagtggggttcatactaccctttactatgaaggacttgaatgccaagccgtgcatattgtgctcagtagacatgctatttgaggatcaagcatgccagactaaactgacttagtcagtgaacctatgtctgtaactggaatcgaaggtgtcatgaacacgttgcttgaggaagaagt

SEQ ID NO: 5972 - DNA, 206 bp, Gossypium hirsutum
  Clone ID: uC-gsronu33B007f03b1
atctttgcggcccccctttttttttttttttttgggggaaatataatatatattgggggaaaaaaaaacagttatttctccctttactgttttatttttttcatctcaatattttttatttataattattcttcctattctttccttatctcttcataatttttatttctttttttatttccactcttttattttttttctttctt

SEQ ID NO: 5973 - DNA, 402 bp, Gossypium hirsutum
  Clone ID: uC-gsronu33B007g04b1
ggaaaaaggaagggaatgtggatgatgctgattatcagggtgccactactactactacgacagccagcagtgatgctggaatggctgctgctgtagcagtgggtgccactacagcacatgcctccgctgtggaatgaagtggttgcgatggttgtcatgcacgtggtggtgttggcggctgatagccggacactatttcaaaaaagctggttcagtttttggcctttggcattcttcatcatattgatttcagaatctttcttgcatcatgcatgaaaggtgcttgcttttttcatctttatatgtaaggcgtgctttcttttgtccccgagtctaagttgggcattgggattactggtttttatttccagttgaacgggtaatcattcttgtttcccgaat

SEQ ID NO: 5974 - DNA, 528 bp, Gossypium hirsutum
  Clone ID: uC-gsronu33B007g06b1
ccacgcacccgcattttcttaccttccgtcgaggtgcatcaacgggggggaggttatcacaggagccggggcccctaacacccggcgtcagcttttggaccggctttttcctcttctcttcctcgggccacggtttttgctaaggttacttcgatggtgaccaatgattatatcaccatgaacgggaacgggtttagcaagagggcagaagagttcatcaagaggtaccacgaactcgaggttaaagaaaatcagtgcagctcttcgctcgttaaacacatcaaagctcctgttcacctggtttggtcattagttaggaagtttgatcaaccgcagaagtacaaaccatttgttagcaggtgtgttgtgcagggggaccttcaggttggaagtgtaggagaagtatatgttaaggtcaggtttgccggcgacaactagccactgaaaggttagagtatctagatgcatgataacacatcttgagcatgacaatttgccgaggagatcacatgctgaaaaactactcat

SEQ ID NO: 5975 - DNA, 333 bp, Gossypium hirsutum
  Clone ID: uC-gsronu33B007g07b1
acccattccaccccatttatcttttcacttcctgttcaaatggtttgaggggaatgattatattgtttggtttttggacaaacattccacttacaaactataagttttgaagccctatagcttatcttatatgttactccagacttacttttgagtgttttacaatctggaatttaaccctggttcttgaagcaattgaattgtgcctacccgtgagtttcgttctcccgttattatgttaatccgaccttagccaaacccaatatattcctttcctttttttccttcaatgaatgaaaaaaccatgtcttatttttcaataaaaaccgtatt

SEQ ID NO: 5976 - DNA, 379 bp, Gossypium hirsutum
  unsure (1)..(379): unsure at all n locations
  Clone ID: uC-gsronu33B007h12b1
cggtttctggaagcatgtgtccaacctcgaccgggtcgagagccgtcgttaccttgagatgttttacgctcttaagtaccgtaagctggccgaatcggtacctttggcagttgaagagtaaattgaagttgccggggaaagaattgggagggatttccgagttcttgagaataatctttgttgttttggcattttgatccaactcttttgttttctctgttcttttatgtgtatttgtctttgttcatgttttgggcattgtttcaacatctgggcgttgagcccatcaattctagtaaagtaaaacatggcaacttttgcttcanaaaaaaaaaaaataaaaaaagagaaaagcaagaaaaccataaagaaggaagag

SEQ ID NO: 5977 - DNA, 549 bp, Gossypium hirsutum
  Clone ID: uC-gsronu33B008a02b1
cccactcgttcgcccacgcgtccgcccacgcgtccgctttctttaagccttcaccagtgtttaggtttaaaatttgcagattttgaactaaaaggattttgattgttccttaaagttttcaccttgtttagatgtaaacaaactgacatgtttttggcaataaaggtccagtctttttagtcccacaaagaagattgctgttctttttaatgttttgttgaagaaaagtaggaaaaaaaaaaggacaaagaaaaagaaaagagctggctttcggactttggggtgttgatagtttggttgaagaaagtgaaaacactgaagcagaaagctttttactttggggaatttttcccttgttgaatttgggtattgaaagttttcaagttatagtacaaggcttgagatttttgcttttagctctttggccaatgcaaactttatgttcttgcagtgaaaacgggatagaggtcagaacgatgatggaaaacaaaaggagcccttgctctgttgatcatagcagtttcactcctttggcgtcgaagcgacaga

SEQ ID NO: 5978 - DNA, 373 bp, Gossypium hirsutum
  Clone ID: uC-gsronu33B008a05b1
atcgttctgttcctcaagaggggtggcaatggccggttcttgaagacagctgcctatggacattttggaagggacgaccccgacttcacctgggaagttgtgaagcccctcaaatgggaaaagcctcaatcttgaagtgcgcccgtccgtactgccccgtgcttttctcatccgcggagctgaataatcccgatgttacgtagctcctaccgcaaatatgtaatctcatacttataatgcccgttggcacaatgacttgctatatcttctttgatcgatgccacgatggatttatgtgtctttttatcagacccggtgttgcaaaactgagtgagaatcttgcttatattgatggcattggaattaaataaaa

SEQ ID NO: 5979 - DNA, 109 bp, Gossypium hirsutum
  Clone ID: uC-gsronu33B008a12b1
ggtgttttactgttttccagtttccatttcttttcatttgccaactagtttctttctctgtaaatttcattgttatttttaagaaattgaataaaatcttgatttattt

SEQ ID NO: 5980 - DNA, 469 bp, Gossypium hirsutum
  unsure (1)..(469): unsure at all n locations
  Clone ID: uC-gsronu33B008b04b1
ggatctacatttgttccattgaaagatggtctgactagagctccatgtgtaaggctcggtaatgcgaaaagggcagctgatttgaagttgtattgggaggaccctgctaatttacagaccttgtctgttgttctcaacagatcaaggagatatggcaggctccagggtatcaaatgtgcaatagctggagagaatctgtgtatcatattgacttgcagtacaggtgacgctatggagatgaacatggtatcgacgggagtgcaaaacgctatggatatcgttcagactgatctcgctgacattgatgtgatcggcatctatgtacactattgttccggcttaaaaccggctgcggtaaattggattgaaggacgaggcaaatctgttgtctgtgaagccaccattaanggtgatgtggttaggcaggtcttgaaaacaagtgtggaatctctcgctgagcttaacatgc

SEQ ID NO: 5981 - DNA, 546 bp, Gossypium hirsutum
  unsure (1)..(546): unsure at all n locations
  Clone ID: uC-gsronu33B008b08b1
tctaagcaaagaaagcaagccactagggttttaagagaagatcaaaatggcttcaaaaaaatcagcttccatggccttctttttagcactcaacattctcttcttttccctagtcagtgcttgtggctcttgctcttcacccacccctaaaccaaggccaaacccaaaccccaacacccccacccctactccatccgcacgaggcaggtgccctagagatgccctcaaattaggtgtatgtgccaatgtgcttaacttggtcaatgtcaccgttggttcacctccagtgatgccatgctgttcccttctcaatggccttgtcgacctcgaagctgctgcttgcctttgcactgctattagagctaacatcttaggcatcaaccttaacatccctgtttctcttagcttgctcctcaacgtttgttcaaggaatgttccaactggtttccaatgctaattaagtcatcacttttccctccattctntctcaacttncttatggtgtttgtgtgtttggttttttataagntatgatgtcatacctca

SEQ ID NO: 5982 - DNA, 613 bp, Gossypium hirsutum
  unsure (1)..(613): unsure at all n locations
  Clone ID: uC-gsronu33B008b10b1
cagtgtttctcagatggaggctgttctccaaggtacctaatcattgatgatggatggcaagatactgtaaacgagttctataaagaaggagaaccactcattgaagggacacagtttgcaactagattagtagatatcaaagaaaacagcaagttcaaaagttcggaatcggaagccgggtgcaacaagctccatgaattcatcaacatgatcaaaggaaaatatgggttaaagtatgtatacgtctggcatgctttaactggcntattggggaggtgtacttccatcatctgaaacaatgaaaaaatacaatccaaagattgtttatccaatccaatcacctggtaatatagggaacttgagagacattatcccggacagcttggagaagtatggtgtggggatcatcgaccctcagaaaatctttgatttctacaatgatctccatagctatctctccagcaatggcgtcgatggagtcaaggtagatgcccagaatttgatagagaccttaggttctggcttcngtgnacgagtttcactgactagacgatatcaacaagcactcgaacaatctacatcaagaaacttcaaagataataaatctgatatg

SEQ ID NO: 5983 - DNA, 249 bp, Gossypium hirsutum
  Clone ID: uC-gsronu33B008b11b1
ttccactcgttcggttgaaccgagtagtgtaagaccaatcacatgaaaagtgaggcatttcaaattttcatgatttatttaggctccaacagtttcactgttaggtgctgctaacttgtttaaaaagaaaaaaaactatacataaaaaaaaaaaaaaccaaagaaaactataaaagaacctcatatggaaaactaacatgcaaatcggtcccctgactagatatataggggccatagactaatcaaacc

SEQ ID NO: 5984 - DNA, 449 bp, Gossypium hirsutum
  unsure (1)..(449): unsure at all n locations
  Clone ID: uC-gsronu33B008b12b1
cccactcgtccggttgagaacatggagccagaaaaggtgatactctacccacaactcttttggggttgtgtggcaatgatgcacacagattttgttcatgtctactgccaggttctggagcttttctcccgtgtgattgaccgtctatcattctgggacagaacaattgagaatgtcctcctttccagcatgcctcgagatgagcttgatagtagtgatattggggaccttcagcgtatggaatttaagggctatgatttgccggtaaccagtggcaatctgcctgcatttgaaggagtgcagcctcttgtgcttaaaggactcatgtccactgttagtcatggtgtagccattgaggtcctttctcgtatcacagtgcactcgtgtgactccatttttggngatcgtgagactaggcttctgatgcacattacaggattactaccctg

SEQ ID NO: 5985 - DNA, 533 bp, Gossypium hirsutum
  Clone ID: uC-gsronu33B008c01b1
gacggtctgtcactcccaatccccagtactctctttcgcttcctcccttttgcttttgctatatcttttcttcctctccatgtctccttgatcacgatccgacggtccacaatgaacgcttatccttttgcttgtttcctctgcttttagtcctgcaaatcctcagatctactttcgcctccctcctaagcttctctgttttctcctttccttttgattttagctctgtaattcctcagatctactctctccgccttcctcatcttcgtttctcggtgagttgtgtttttccaaaaaccaaaagctaatttataccaaaaacaactttccgccggcgagttttgctcgtaattcaaggttgcctttaggtttatcgttggccgtagtgaaatactgaagttgcccacagttcgatggcggttacggttagttacgtcgcgctaacatgcgccggtgaaactctagcttccatgttcttgtcggctcttgtcaataaccaccttgtagctctgaactcctttacattgctggtg

SEQ ID NO: 5986 - DNA, 303 bp, Gossypium hirsutum
  Clone ID: uC-gsronu33B008c03b1
gtgcatttgtccggatacggcgaagagaagctctcgacaggtctcgtcaccggaactgttctttgtgaagcttgccaccgccgccgccgccgccgcgatccacaacctcaacttcgttcatggcctatatcaggggctttggtgtctgttaaatgtgaaactccgtgtaagaccaaatcaagtacaacacgagctacaaccgatgaatacggagatttcatgatcgatcttccgtcccacctgcacggagttgtcgatttgcaaaagatatgccccattaaagtcatgggaattcccgaagag

SEQ ID NO: 5987 - DNA, 365 bp, Gossypium hirsutum
  Clone ID: uC-gsronu33B008c05b1
ggctgttttttgtttaggaactaactgtaaaagtagggaggttgagactaaaaatgcatatacggcacaaatggtatgagttgtgcagtgggcacaatataagaatccaaattacatgtctgattctgaaatgaatgtcagagctgggaaaacaataaaaaaagtgtggttagttagagttcgtagaaccgacactgacatggaggatgagctatagacttcgagctattcaaattgcacagaagcaacaaaggtcttgatggaagagcacggccagcaatgctttttgttgacccgaccactatagagggaaccatggaggcctactctcctttaaataattggattggatgagcatatcacct

SEQ ID NO: 5988 - DNA, 528 bp, Gossypium hirsutum
  unsure (1)..(528): unsure at all n locations
  Clone ID: uC-gsronu33B008c06b1
cggacgcgtttttccaaatgtggtgaagctgagagcttacgattgggcccctgatgaaaagcttctcattagtgatttcatctccaatggcaatttggctaacgccatcagaggcagaaatggtcagccatcaacaagcctctcatggtcagtaaggcggaaaattgtaaagggagcagcccgtggcttggcctatcttcatgaatgcagtccaagaaaatttgttcatggagacgtcaagccatctaacattctccttgacaacgaattccaatcttacatctctgatttcggcctcaacaggctcattaacatcactggaaacaaccccgattcttcatccggcggcttcatcggtggactcccttacaaatcaatccaaacggaacgaaccaacagttatcgagcaccggaggctcgagtccctggcaaccgagcaacacanaaatgggatgtctattcatttggagtcgcattactggagctggtacgggcaagtctncngagctatcaccgaccacatcaact

SEQ ID NO: 5989 - DNA, 383 bp, Gossypium hirsutum
  Clone ID: uC-gsronu33B008c07b1
tttcatattctcggggtggccaacacggacagggggggttattttaaagagttttccaattacctcaaggactaccctgatcaataccggtacgacctatctcttagcatagagcaaaagaacaagagtggatgcaagatgtacgttcaggacaagattgaggaatacagtgacgaaatttccaagctcttggacgatggagcccatatatatttctgcgggctcaggggaatgatgcccgagacccaagaaacattgaagaggattaccaacggttgacggaggctcaaatggaggtcactggaagggcaagctttggtaggacatactgtactctgaagaacgttaacaaacattgtagcctggagtggaagatcaacaac

SEQ ID NO: 5990 - DNA, 443 bp, Gossypium hirsutum
  Clone ID: uC-gsronu33B008c09b1
tcctctcgtacggactactagaaccctaaccaaaaacaagactctttctgaaagaaacgcaggtcttgaatctgcttgcttggggcttgaagagaaggagaagaataggatggcagatgatagaacagctacctgcatagatatcctcttagccatcattttgcctcctctcggtgtcttcctcaagtttggttgccaggtggagttctggatatgtcttgtactcaccctgtttgggtacatccctggtattatttatgctatctatgccatcaccaagtagtcctctaatcccgtccttctcatctgtggagatttggagtaggattctggttttgtttgaatatgtgtcggttatagcattttatttcaattaatattttgtctgttaatttgatggtgacgtaaagcttgttgctatgtcctgatgatgatttatattg

SEQ ID NO: 5991 - DNA, 564 bp, Gossypium hirsutum
  Clone ID: uC-gsronu33B008d04b1
agctgctaatgtcttcaaatcaggaggatttggtgatgtgttgaccttccaagttgtggacaaggcaagattaattgatgatgtaaggcaagcactttatgcatccaagatttgcagttatgctcagggcatgaatctcattcgtgcaaaaagcatcgagaagggttgggacttgaagttgggggaactggctaggatatggaagggaggctgcattatccgcgctattttcctggacagaatcaagaaggcttatgatagaaattctgaccttgcaaaccttcttgtcgacccagaatttgcaaaggaaatcattgacaggcaatctgcttggagaagagttgtttgtcttgctatcaactccggtattagcactccaggcatgtcagccagtcttgcctatttcgacacttataggagggaacgagtaccggctaatttggttcatgctcaacgagattattttggtgcccatacttatgaaagggttgacatggacggatcttttcacactgaattgttcatgatcgccaaaaactaaagattatattattctagcagtac

SEQ ID NO: 5992 - DNA, 109 bp, Gossypium hirsutum
  unsure (1)..(109): unsure at all n locations
  Clone ID: uC-gsronu33B008d06b1
taccggaccaccaggcccgacccacaccacccgtccgacatttggnnagaaacaaacgaaacaacggggggggtttaacaaagacagatcttacaatagacacatggcc

SEQ ID NO: 5993 - DNA, 376 bp, Gossypium hirsutum
  Clone ID: uC-gsronu33B008d07b1
ccttcatttcgtccgacgggaccaacgaaacggggggatttttaaaagaggcgaggaaaaccaacccactgaaactaggaggaactaaagaggctccagggcccatgacaaggatcagaatggaacatatcagcggctgagctgcgccatgtcatgacaaaacccggcgagaagccaacagacgaggaggatgatgaaatgaaccgagaagccgaggcagatggagacgggcagaacaactataaggaggtaggaaagacacgacggccaagcaactttgtaaccaaccacaaagaagaaccaaacattgataccaaagggaacagggcaaacaagtacgcaaagacctatatctccgaataagaacatccacgct

SEQ ID NO: 5994 - DNA, 222 bp, Gossypium hirsutum
  Clone ID: uC-gsronu33B008d09b1
ttcctttcgttcggactactgagaacgccaagggggggaacattgtagcggtatgatacaaaacacaggaatttgcacgcgtggagaaaacaaacaatgcaaagccaaagaaggccgatgatggggcagctacgagcatagatatcctgttagccaagatattggctgcctttgacatgtaacaggaggttgtatggcaggtggaggacaggatatgtgttg

SEQ ID NO: 5995 - DNA, 451 bp, Gossypium hirsutum
  unsure (1)..(451): unsure at all n locations
  Clone ID: uC-gsronu33B008e06b1
tttccatgcgtccggnaagcaacaaaaacngggtggggtttattttaagaaaactcaggttcaagcccccaaattcgaatacgagttcctcttgctggatcggatggtgaatgtggcaattgaaacggcttaaagaatgagcagagcaacatccttgcggaagggtcatgtcccatgcaatatgaatcgacaatgatacgcaagcgcaaagaacatgctaacggaggtcccctctgaagaggttggaaggaattatttaggatacatccactgctgtggcctgcaatatgcatgtgctgttcaagacctctccaaatgtaagggtcttggacttctaaaacaggggctacaacaagaatcaatgaagactctgtgagaactgtgaattatcctactagcactggtgtcgggttgcaagactttaacctcatcgttgcaaatcttttgggca

SEQ ID NO: 5996 - DNA, 238 bp, Gossypium hirsutum
  Clone ID: uC-gsronu33B008e07b1
gcgtttataggacagtgatgctggttctcacgaagagggatttttagaagtatatgtgccaatggagcccgtattgatcgaaagaaacattcccctgaggtcaataacaggataccaggctatagtatatacacgtgagtagaaatcgggtatgactaataacccctaggaacgggaaatcacagaaatttaaaaaacagtaggagttgtcgatatggactcagcttacatacacttg

SEQ ID NO: 5997 - DNA, 443 bp, Gossypium hirsutum
  Clone ID: uC-gsronu33B008e08b1
ttcactcgtccgtgcgaccgcaaacgtacagagggggaattttaaaactgcaatagggtaaagaacccaatttcaacgaatggaacttgcagatacatgcaagaaaatcagggcagatgagacaacagccacgggcaatgaaatcctgatagaaataaaaccgcctcaactaggatatttactaaaatttgaaatgaagaagcaggtatcaataagacttgtgcttaccacaggcggagacatccatagcattatttatgcagagtaaacctccaaacattaatattgtagacatgaactgtttatatacaccgatggaacgtcggaataactgtatactgaattgtggggagatccaagtgaagattgagcattctccacattctaccctgaattggtcaggccaatcatagatccaattgcagaaatatatcaccggatgc

SEQ ID NO: 5998 - DNA, 435 bp, Gossypium hirsutum
  Clone ID: uC-gsronu33B008e09b1
tttctttcgtaggtgctatggcggcgttagacaggaagttgtctaagacattcagggacgaaagggttcaagttgtaaggatggcgatgcggggtacatgcaagaatacatcagaacatgcaaccacgaacacgggtgttgatatgctgattgaaataaagccttttacattagatgcttctcgtaagtcaccaagtcagatgaaagactcaatatatgtcagcataataaagaacgaatccaatctatgtagtatttatgcaaagttagcctctagctattaatagtatagtccggaacctatcatatataacaatttaagctttgacttttctatatacttgataggtgggcggtagtagctctccatctaagatattttgctgccatctgttctaagggaccaggaatgctaatcactatggtcgcattatg

SEQ ID NO: 5999 - DNA, 554 bp, Gossypium hirsutum
  Clone ID: uC-gsronu33B008e10b1
ccctctcgtccgcgagcaagggaatttcaagtcatccgtgacaagcgatgttcgaggattgttggaactttaccaagcttcctatttgagggttcatggggaagatatattggatgaagcaatttctttcaccagcaaccatttaagccttgcagtagcatctttggaccatcctttatccgaagaggtttctcatgctttgaaacaatcaattcgaagaggcttgccaagggttgaggcaagacactatctttcagtataccaagatattgagtcccataataaggttttgttggagtttgctaagatcgatttcaacatggtacaacttttgcatagaaaagagctaagtgagatttctaggtggtggaaggatttagactttaaagaaagttgccatacgcaagagatagagtggttgaaggctatttttggatctcaggagtgtactttgagccccaatattctcttggtagaaagatgttgacaaaagtgatagcaatggcatctattgtagatgatacatatgactcatatgcaacatatgaagagct

SEQ ID NO: 6000 - DNA, 602 bp, Gossypium hirsutum
  Clone ID: uC-gsronu33B008f09b1
attctttactggatcgcccaactcctaggctcaaccgtcgcttgcctgttgcttaagttcgctaccggcgacctggctgtacccgcttttgggttgtcatcaggtgtgggcgtgtctaacgcattggttttcgaaatcgtgatgaccttcggattggtgtacacagtgtacgccacagccgttgatcccaaaaagggaagcttgggaacaatcgcaccattggcaattggtttcatcgtgggggccaacattttggcaggaggtgccttcgatggagcctcaatgaacccagctgtttcatttggaccagccttggttagctggacatgggataaccactggatctactgggtcggaccccttatcggtggtgggctcgctggtctcatctacgagttcatcttcatcagcaacacccacgagcagctcccaaccaccgattattaagcctaatcagggtttaattgatttgtctgtcactttgaaaccggattttctccgatctcatttgagtttcctatctctttccttggtttttgggtttatttgtgccccgcgatctggttactttttttatatcccatcccttatatgatcatatg

SEQ ID NO: 6001 - DNA, 456 bp, Gossypium hirsutum
  unsure (1)..(456): unsure at all n locations
  Clone ID: uC-gsronu33B008f10b1
caaaactgaaaatgtcttgctgttcaggaaaatgtggctgcggcgctgattgcaagtgtggcagtggctgtaacggatgcagtatgttccctgacataatagagaagactacaactgagactattgttcttggtgtggcaactcagaaaatgcactttgagggatctgagatgggagttggggttgagggtggatgcccgtgtggagacaactgcaaatgcaacccttgcacttgcgggaagtgaacaacaaagagaagcagagtggcctttgtcattttaactaaataaattctattactttagtatgtatcagcaaatcttcatgaggatttggttcttaattatgtgtaatgtggcttttctgctatgtcagaatgtattatgatatttaagaaagtttgttttctattnaaaaaaaaaaaaaaaaaaaaaaataaaaaaacaaatccaaaac

SEQ ID NO: 6002 - DNA, 522 bp, Gossypium hirsutum
  unsure (1)..(522): unsure at all n locations
  Clone ID: uC-gsronu33B008g02b1
cccactcgttcgaatcaaggtgccacatcgagaaacattaatccagtcggggatgctggagcagcgctatcctgaatgaagacaaccctcgtcatgctttgatacctttagaaggctgatctagaagtgatgcctctaggcttttaagcaatcgttgggcagctgtcttacatcgctaccatgatacatccattgacttgtctgaaagaccagttctgtactctggaattagtgattcagcctggaggaatttcagacttccccatcagatgatgtccccagcaaacaaaaccgggccttcatctggctcacagatggatttcttagctgagcttcgtcgtgcaattcgaaatgccaataccgacaactaactaatgacatagtgtgataatggcagatgtggacttatgaanctcatgaancttgcactcaaagtacctgctgtatgtgttcattagttactcaaatcaaatgctacttatttgggcgatccgtgtattcagtgtaaagcatggtccaggc

SEQ ID NO: 6003 - DNA, 63 bp, Gossypium hirsutum
  Clone ID: uC-gsronu33B008g05b1
cccacgcgttcgaaaaaaaaaaaaaaaaaaaaaaagaaagaaaaaaaaaaaagaaagaagaaa

SEQ ID NO: 6004 - DNA, 60 bp, Gossypium hirsutum
  Clone ID: uC-gsronu33B008g12b1
ccctctcgtccgcccacgcgtccgaaaaaaaaagggaaaaaataaaaaaaaaaaaagaag

SEQ ID NO: 6005 - DNA, 385 bp, Gossypium hirsutum
  unsure (1)..(385): unsure at all n locations
  Clone ID: uC-gsronu33B008h02b1
cccactcgttcgcccacgcgtccgggccggctttggtcagctggtcctgggacaaccactggatctattggctcggaccgcttatcggtggcggtctggctggtctcatttacgagttcgccttcattaaccaaagccatgaacaactgcctcccaccgattattgaaacctgtttaatttatcatgaaaacgggtttttccttttcttttcctggtgtatgtattttgttgagcttttcttttgtgtttaatttgtgaccgttgatcatgcttactttatcatgatcatcatccaatggcggatgttgtttgcgaatttgtgttaatgctcctctgntctctataattgtatttttaaagtttatatttaatatattgtcaaca

SEQ ID NO: 6006 - DNA, 464 bp, Gossypium hirsutum
  unsure (1)..(464): unsure at all n locations
  Clone ID: uC-gsronu33B008h03b1
cccacgcgttcgcaagcttcttcgtattctagtcctgctgcagcacctgcaccatacccaagccaatcgacaattccttatgcatcaattgctgcaaagaaggatccacaaggaatcccaccaactacccccatgggaatgagcgggtacccatattatattgggaaataataataaagtcccagctcattcatggtgatttgtgaagctccattgacgagtactttcttaatgcaactactagttttatactcacagttcaccaacatgtttggtctttgcagttaggtcacatgatgaccaacatgtttggtcttttgcaattagttgtcatgatcggttgtatcttgaaccaactttgcgagaccaggtgttgcacatcagaacaaaaagatcattgngtttgatgtaggagagcttaatgttagcattccataaatttccctggtttcttgtaaaaaaca

SEQ ID NO: 6007 - DNA, 300 bp, Gossypium hirsutum
  Clone ID: uC-gsronu33B008h04b1
cacgtttactttctctctatctccaagttatcgccattctcctgcttttaggatgcttgttgaaccccaacatggtgtatatatcaaaatacaaaacatctaatactgccacactactggttttgagcctgaatattattagttatgaaatgaagctttttatatatgtaatttattagttcatatgtatcatgaaagaaatagaagcgtacgttgtttcataacatgtaatgccttttggttaacattgatagctcgtcttcttaatggattgagaaatggggcaggcaagtaagactg

SEQ ID NO: 6008 - DNA, 183 bp, Gossypium hirsutum
  Clone ID: uC-gsronu33B008h05b1
cccactcgttctcataggtagcacgaaataggcatgtaggcgttagagttgaaattccgttggagtgaccactcatcgatttcataaaccatgaaataattcaatgagttgacacctaaaaatcaaccaaaaacagctaactagagtgtaggaaaccgtaaactgcagatccagcataaacac

SEQ ID NO: 6009 - DNA, 499 bp, Gossypium hirsutum
  Clone ID: uC-gsronu33B008h07b1
ttcttcttcccaacaaccagctacctttcgggctggctgatcttcgcaacgtcctcttcccaatctgccccagaaccttccacttgacctgcgctgccaaaaagatctcttaccgaaccggacgcttcgatagcaagaaccggaggagcaatctcaccacaaaagaacaagatgaggaacaggagctcaaacggacggcggagattgaagaatcaaacattgctattggagttggattggaggacgttggtgggagttcgtctgagatttcggcctgatggtaagccgttccccgatcttccgggccttcagccggatttatgggaaggtcccaagtgggatgttctcggcttccttgatcagtatttgtgggcttttggcatcgacttcgcgttaattgcatgcgggattgctgtggcgacttacaacgaaggggcaacagattttaaggtgactcctgcatacaaagagtcgatccaatctcaggagctattagaac

SEQ ID NO: 6010 - DNA, 271 bp, Gossypium hirsutum
  Clone ID: uC-gsronu33B009a01b1
aaaaaaaaaaaaaaaaaagacacaataagaaaaaagacgcctttacacacacccaacggggggtcccaaggttccttgctcacgcacgcgaccttacaacttttttattgttctactctattacatatcaccggccgccggccgctatttcacaccctgttaaactcctaaatccccaccattttaacatttttgcagccttgtcccactatcccccttttgccggtttgcctttttaggtccaaaagctcttttcccttcccaccattcc

SEQ ID NO: 6011 - DNA, 233 bp, Gossypium hirsutum
  Clone ID: uC-gsronu33B009a08b1
ccgggaacaccgtgtcctccaccaccacctccggcacaacaaacatgccccatagacactctcaagctaggtgcatgtgtggacgtgttgggtggcttagtacacatcggcataggtagcagcgccaaagacacttgctgccctgtactacaagggctgttggatttagacgctgccatttgactctgatctacaatcaatgttcaacctttttaatatcaataatattactc

SEQ ID NO: 6012 - DNA, 438 bp, Gossypium hirsutum
  Clone ID: uC-gsronu33B009a11b1
ctctcttttccttgtgtctggggtgtatattataaagatgagtgcgctgcatgcaactagagcagaacttgctcttatagttttgtatttgaataaggctgaagcaagggataagatatgcagggctatacaatatggttcgaaattcttaagtaatgggcaacctggcacagcccaaaatgttgacaagtcaaccagcttggctcggaaagttttccgtctttttaagtttgtcaatgacttgcatggtcttattagcccagttccttgaggaactccccttccactagctctgctggggaatgtccaaaaatgcgcctgttgtcaactttcttgttgctggatcaaattgactggctcggcagaacaagatctataagatcataggaagaactgagctgattggacgagtatctcttttctggtgcatgggttttt

SEQ ID NO: 6013 - DNA, 332 bp, Gossypium hirsutum
  Clone ID: uC-gsronu33B009a12b1
gctcctcttagtttccctttgtggcccttgtttatttgatactcccccctcatggctgccgctgatgtcgagttccggtgcttcgtcggagggctcgcatgggccaccgacgaccgggcccttgaagaagccttcagtgcgtttggtgaaatcgtcgaatcgaagatcattaatgatcgtgagactggaagatcccgaggctttggattcgttactttccgtgacgagaaagctatgagggtcgcgatcgaaggaatgaacggtcaaaatcttgatggaaggaacataactgtcaacgaagcccaatcgcgcataagtggaggcggtggccg

SEQ ID NO: 6014 - DNA, 336 bp, Gossypium hirsutum
  Clone ID: uC-gsronu33B009b01b1
aaaaaaagaagaaaaagagaacccatacagcagaaaaaaaaaaaaaaactaaaaagggggggccccttttaagggacccaagtttccgcccccgggcttgcaacgcattagtttttttttggggcccccaaatttaatttcctgggccgggtttttacaacgccgggccgggaaaaccccgggggttccccaacttattcgctttggaaaaaatcccctttttcccaggtgggaaaaaaacaaaagggccccccccaatcgcccttccaaaaatgtgcccaccctaatggggaaatggacccccccctttatgggcccttttaagccggggttttt

SEQ ID NO: 6015 - DNA, 106 bp, Gossypium hirsutum
  unsure (1)..(106): unsure at all n locations
  Clone ID: uC-gsronu33B009b02b1
aaaaaaatttgaaaaaatgaggaaaaaaccgctttaaatacccccgaagggagggaaaaaagaanccctttaaataaatattaacaaataacattaaatggggggc

SEQ ID NO: 6016 - DNA, 402 bp, Gossypium hirsutum
  unsure (1)..(402): unsure at all n locations
  Clone ID: uC-gsronu33B009b03b1
ccaaatggcttcatcagccgccagaatagtgtggatcaccgccgagcaccacgncgaatccggtaatccaagatgcccgattcaacgacgagcagccggtgctacctccactaacatccccagcaacctcctcaaggggaggatgcgtgagggtgaaattcgggcagatgccagctgctgtacgaatcgagggatttgattgcctcaccagagatggccgccatcgcagcatctccgccgtggcttaaaaaaaaccaagatatgagaacaaaaatgtgagaggagagagggatgatgataaaattaagcaacaacttggaatagtgtgggtaggtgttgtatctttatctaaatttcttctatctctctttcatatttgtttcctattcaatttttcttatt

SEQ ID NO: 6017 - DNA, 161 bp, Gossypium hirsutum
  unsure (1)..(161): unsure at all n locations
  Clone ID: uC-gsronu33B009b06b1
acatttctcaccctttagaacccattgagtaaaaccccgttttatctaccgaggggaaaanncacaatggccgccgccactcgcgaagaaaatgtctacatggcgaaactcgccgagcaagccgaacgctacgaggtaatggtcgactttatggagaaagt

SEQ ID NO: 6018 - DNA, 141 bp, Gossypium hirsutum
  Clone ID: uC-gsronu33B009b10b1
gaccttgccggtcgtgatcttacggattccttgatgaagatcttaaccgagagagggtactcttttacgacgactgcagaacgggaaattgttcgtgacatgaatgagaagctcgcatacgtagctcttgattactagcta

SEQ ID NO: 6019 - DNA, 306 bp, Gossypium hirsutum
  Clone ID: uC-gsronu33B009c02b1
ctaaaaacccacctgagggggggacgtcttaaaagacacgacggcaaagacgagggctgagaaggaaagactcacggaggatgaggccgctgatgaagagctcaagaagattaacaaagaggcaaaaaagaaaggttcctctaccactactacttcaaaggctactgctgccaaaggtgcagtaaccaagaagaaaagcaaacattctgatgaggatcactccccaactcacagccaggctgatgagacgatagagtggatgatgactgattatgctcatgcgcacggatcatctagatctgcact

SEQ ID NO: 6020 - DNA, 68 bp, Gossypium hirsutum
  Clone ID: uC-gsronu33B009c03b1
cccaagcaaacaggagggtaaatgaatttgtggcgcggaagctacccaaacaggacaatagcatgtag

SEQ ID NO: 6021 - DNA, 269 bp, Gossypium hirsutum
  Clone ID: uC-gsronu33B009c09b1
acttcctggtgactgatagaaggtcagatgcacgctgtggatagatcaagacgagcaaagatgttgcctagctcaaggtccgctgctgcatgtgcttgtacacactttgcgcgtcggatgctgacaagggtgacaagttgtagcagccccttcctgcaggtttgagggttcaagacctgtgaaaatatggcagcctcaggattgtcacctgatttattggtgaggaaagctagattttagttttgctagcactgcttcttgggccattt

SEQ ID NO: 6022 - DNA, 371 bp, Gossypium hirsutum
  Clone ID: uC-gsronu33B009d03b1
agctcaaacacaagtagtggtgcttttctataacaagcttcttacccatcacatcaggaataacaatcttaggatgagaaggctggaaattcaggctgacaaatctcttagtagagtatccatgtttcttttctgctgcatcattctttgtcttctcttgttttgagaagtactgaatttgagcttgtatagttgcaaacaaaatttgtgaggaaaccaaatgtctaggtttctcttaacgatatttgtatgtatatagtactctcattttttaagaactgggactctaaatcctccatagaaacctgcttagcagcaaatcaagtctcaaactcttattaaggggttttgccttgggaatgttatgcttt

SEQ ID NO: 6023 - DNA, 348 bp, Gossypium hirsutum
  Clone ID: uC-gsronu33B009d07b1
aagagggggcttttattcccaaccaaaatgtgtcagatggaaaccaggagtcaggagccatgaattctcagataactcaggcggtgtttgagaaggagatgggtgaataccagaccagagtagtgaaacagattctgtgggtgaatgggaggaggtatgagctgcaagaaatatatgggatcggaaattcagttgacattgatgttgatccatatgatagtggaaaagaatgcgttttttgcctttcagaacctctggacactactgttctttcttgcaggcacatgtgcatgtgccgcttttgtgcataggttttgagatgccagacaaattcggttgcctatctgt

SEQ ID NO: 6024 - DNA, 57 bp, Gossypium hirsutum
  Clone ID: uC-gsronu33B009d11b1
acaggggggcaagaaaggttccagagtccaggcgctgcaactcatagaggggcagat

SEQ ID NO: 6025 - DNA, 323 bp, Gossypium hirsutum
  Clone ID: uC-gsronu33B009e12b1
gaaatcgataataaaagcggccacggcggtagagacgaagacttagaagactaagagagtctgctggacgggggaagctatcccaccatgctatgtgattaaccctcctttctcaccaatcgctcgtgtctaaggccgaaacaatgccttgttgaatcgaaactggcctattgatccttctccaggcattctgccatgttctgactaagaacagcattgatccacggttaatacaaaatgtcttatcttgcacgaatcgatgtgtagatcactcaagcaagaacttcactgcactaccaactcgttctatgttagaaacacct

SEQ ID NO: 6026 - DNA, 286 bp, Gossypium hirsutum
  Clone ID: uC-gsronu33B009f12b1
ccaggaagtttatgatcataccagtcaggattcttgtgaagcgcgatgagctcaccctcgaaggtattaagcagttttatgtcaacgttgtcaaggaggagtggatgctcgactcgctttgtgatctccttgtttctttatctttttcttcagagcgggatctttgtttatctctattactcttatcttttttgtcttcccttttctcactctttatttttaaatctctctatatttactttattattctttatcatgtctatttctctttttttttttctctttt

SEQ ID NO: 6027 - DNA, 100 bp, Gossypium hirsutum
  Clone ID: uC-gsronu33B009g02b1
accccccacacgagcagagcacaaaggttatctatggacgacagagcggagccagcgacagaactgaacttgactgcggagtggttcacatccccggggg

SEQ ID NO: 6028 - DNA, 172 bp, Gossypium hirsutum
  Clone ID: uC-gsronu33B009g03b1
aaaaacaaaagccccttaacacccccaagaggagtaaaggaagggtcaccaaaaggcgccaaaatcgcctgctcttgaaagctttacatggctagggtatagttcgcttcttcactaccctgagtaacaaagtcttatttttatatagtctgataaacccgaacgagatgca

SEQ ID NO: 6029 - DNA, 386 bp, Gossypium hirsutum
  unsure (1)..(386): unsure at all n locations
  Clone ID: uC-gsronu33B009h02b1
ctctatgaacgatgctggaagngtgaacaacggggcggggatacgacgangaaatgggacacctctactggcctaagaaggagcgtcagtcggtaaccgagaccccgaggtcgtcaccgggatccaaaaacaagcctaaaccacccatttttgtgacaagggatagccctaacgcgctcgagtatgtatggaagtncaagtggaccgatgtagccgagagtatagccaattgctcgataagacacgttagtttgcgtgcttagcggcagggctcggtcccaacgttaccctaagacaccggcagaccggcgcgggggtcgcccttatggaaggtgagaattttggctttgccggggcttttctccccggaccgcttcaccgggatc

SEQ ID NO: 6030 - DNA, 238 bp, Gossypium hirsutum
  Clone ID: uC-gsronu33B009h03b1
cttaggcttcacattcggtttacatcgattggggaggggggtaaaaaccgaaacttagataactttcccattactggacctgctagttcgcatgtatgcttgttaaagctgttgtcgttgttgctgtaatgcgcgagacagtctataactgattgctattaataatgtcttggaatgtcgctcccgatctatataaaagacacattggtcctttccatttgaacacttctaggaactg

SEQ ID NO: 6031 - DNA, 181 bp, Gossypium hirsutum
  unsure (1)..(181): unsure at all n locations
  Clone ID: uC-gsronu33B009h08b1
ttaaaaaaaaaaaccatttntgaccccctagagaaaaaagcgcgcgtaacacaccaccaagagancagaacaccatatttgaggggaggaaatgatgactgtcacctcaaaagcctatcctgctgagcttcctattggggggacaaatcttcctttttcactcggttcttctaccaatgac

SEQ ID NO: 6032 - DNA, 425 bp, Gossypium hirsutum
  Clone ID: uC-gsronu33B011b06b1
tgtcctttcgtccgataggacattctttgctgacatggattccctcatcaaccgtggcgacagatagagggctgtcattttacaaagggaaagaaatggatgtaggatctgcaggaaccggctgctgttgctgttggtggtgtcggtgggggtgatcagcggaatcgggcatttgtgagctccacagttttttgtagaattctttaacctaactctgtatgaaataacctaaacaaccaaaggctcgcctcttgtaatagttgataggcactactgacacgacattctacccagagttctcttttccacacttggaaaactaatgcgcactccctggtggggagtctgcagacaccctagcccacttggtctggaacatgatctttccacaaactcaggcatgattccaaatggagatactatcc

SEQ ID NO: 6033 - DNA, 427 bp, Gossypium hirsutum
  unsure (1)..(427): unsure at all n locations
  Clone ID: uC-gsronu33B011b10b1
gcgttctctcgtccgcccacgcgtccggatataataagcacctccccgtaagcataccacaaaggaaagcttggagagagacccaaaaacaatgtctaaggaagttagtgaagaaggacagggtcgtgaggactatgtggaccctccaccggcacctctgattgacatggctgaactcaagtcatggtctttttacagagccctcatagctgagttcatagccactctcctcttcctctatgtcactgttgctactgtaattggtcacaagaaacaacaagatgcatgtgatggtngttggtctcttgggtattgcatgggctttcggtggcatgatctttatccttgtttactgcactgccggtatcttaggtggacacattacacctgcggtgacttttgggtttgtttttggcccgtagagtgt

SEQ ID NO: 6034 - DNA, 257 bp, Gossypium hirsutum
  Clone ID: uC-gsronu33B011d01b1
aggggggacttcccaggacccccattaacccttcatggggagatcaaaaactacaattgaaaggggccaaaggcttgctcccagttggtgtatggggacaaatgttatggggaagaaaatggcatgcgccctagtttgattatcgacggtggcctagccaaagcacacgctccaatttgagtaccctgcttgaataagaccagaaggacctcaattgaagaatgtgaccgaagtttttctacaattgtctgaatata

SEQ ID NO: 6035 - DNA, 486 bp, Gossypium hirsutum
  Clone ID: uC-gsronu33B011d04b1
tattggagttgaactatcaacagataatgtcattgctgaatatttctttgacaggttcgatctcaaactccacacagccggaattattgctgctacctttggtatggcaaacattgttgctcgacccttcggtggttatgcttcggacaaagcagcccagttgtttgggatgagaggcaggctgtgggtcctatggatcctgcaaacatgggaggtgtcttctgcatctggctaggccgtgccaatacacttcccgttgctgtcttggcaatgatcctcttctccattggagctcaagctgcgtgcggagccacttttgggatcatcccattcatttcacgacgatctttgggaatcatttcaagtctaacaggtgcaggtggaaacttcgggtccggactgacgcagctaatattcttctcaacctcaagattgtgcacagcggcaggtcttacttggatgggagccatgatcgtggcttgcact

SEQ ID NO: 6036 - DNA, 516 bp, Gossypium hirsutum
  Clone ID: uC-gsronu33B011d10b1
tggttgagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatgggtgatcaagctgctgacatactgggtcgatttcttgaaaaagtgtaagaaagatccatctcactgggataaagatctcccaaggaggctggaaacgtatcgaggagaagtatacatggaagatttactcggagagactattgacccttaccgagtgtatggattctggagcatgtttccaaccttgaacgccggagagtcgtcgttacttgagatgtttatgct

SEQ ID NO: 6037 - DNA, 443 bp, Gossypium hirsutum
  Clone ID: uC-gsronu33B011e04b1
agaaaaatcccaacctctccagctggtggtgtgtattacaaatggcccaaggtagcatgctgaaggctgggcgatagcctgaacaaatggcaatactaaccgcagcctcggcgcaggcacgggaggcgccgagaccgactgcagacgctggagctggattctcagtcagaggcactaccgccgccatagacttcattttgatcgtaccccttcttgctctcttcaagcattaaattgaagggcctgggtggctctcctatgtgagtggctttctggtatatatatatacatggatgcatgcatggatccctgataccatactgtctatgttgaatttagtgcaacgaacttgatttattgaataagatgcttacgatctgatacatgtttttacagctgatcgccctaagtgaagaagtgagtggcaaaacccttgtgaaaac

SEQ ID NO: 6038 - DNA, 607 bp, Gossypium hirsutum
  unsure (1)..(607): unsure at all n locations
  Clone ID: uC-gsronu33B011e07b1
gcgccctctcgtccggtttataagagaaggttatcagtttgactacatctttgattggaccgtattaaagtacccacagctcggtggcagctaccgagtgcggcattccagtggaagagcaggtttagctgcagaagcagccattgaaaaacccgaaagaatctcagtgggaagagagattcgggatagattctccggtgcggttgaagcattttctaagagaaatggttcaagtcctagtcctcgtcgtgatcattctagacacaagactgctgagggtgtaaccttgtcaaagcatacgcacccagattcagataaaagatacagttcttctcgatatggtagcacttcaaggaaagctgtagtaacaagcaggcctggttcatccagtgaactcaatgacattccgcaaaaccgacaggtttcaagtagcagtcgcatgtctaccacacagagactccttgccttcgagtcgaaaacatccaaccgttcggccactgtaaaggtagccgtgacaatcaccctcttcgagttttgggctcctctcgttaggaaatgatggagaagatatcagttgcaagctgatcttntaataactgacatctca

SEQ ID NO: 6039 - DNA, 468 bp, Gossypium hirsutum
  Clone ID: uC-gsronu33B011e10b1
ttcgttctgatgacataaatacatgtgcttatgagaagttgtagtactatcactatgggctataatcccatggtgctctttgacatgacgatcggtggtcagcccgctggtcggattgtgatggagcttttcgcagattgcactcctcgcactgcggagaacttccgtgccctctgtactggcgagaaaggcgtctgccgcagcggtgagcccctccactacaaaagctcttgtttccatcgtgtgatccctaactgtatgtgccaaggaggtgacttcaccgacggacacggtaccggacgagaatacatctacggatcaaagttcgctgacgagaacttgatcaagaagcacactggtcccggtattctgtcaatggctaacgctggaccgggaactgacggatctgagctcttcatgtgcacggctaagactgagtggctcgacggagagcacgttgtgtttgga

SEQ ID NO: 6040 - DNA, 492 bp, Gossypium hirsutum
  Clone ID: uC-gsronu33B011e11b1
ttaagctgtagaaagggaatgtcctggagttgtttcttgtgctgatatccttgttctgtctgctagagaaggcatcgtttcgttgggaggcccttacattcctctcaaaactggaagaagagacggtagaaggagcagagcagatgttgtggaggagtatcttccggaccacaatgagaccatctctggcgttctcgacaggtttgccgccatgggtattgacacccctggagtcgttgccctcctaggagctcacagtgtcggcagaactcactgtgtgaagctggtgcatcggttgtacccagaggttgaccctgccctgagccccgaccatgttgcacacatgctccataaatgccctgatcaaatcccagaccccaaggccgtccagtatgtgagaaaggatcgtgggacacccatggttttggacaacaactgctacaggagcatactggacaacaagggtttgtgatgtggatcaccactgcttac

SEQ ID NO: 6041 - DNA, 443 bp, Gossypium hirsutum
  Clone ID: uC-gsronu33B011e12b1
ttctcgcgtccgattcttcagtcttcatcttgatgcaacaactgattccgacagtttgcatggaagttgcccagtgataaagggtgagaaatggtctgcaacaaaatggatccatgtcaggtcattcgatacggcaaagtggcagtctgtaaatagagattgtgttgatgagaatgagaattgtgctacctgggcttcagcgggtgagtgtgaaaagaaccctagttacatgattggttctgaagactattacggatattgtaggaagagttgtaaggtatgctcctcgtagaaagtcgtttcctggctgtttccaaagacaatggtaaagctttaatagctgtatataccacacatttttgagttatgctcgatgcaccatatttttgggacttgattgtgaagtttatatattatttaggatgttattggtattataaaaa

SEQ ID NO: 6042 - DNA, 606 bp, Gossypium hirsutum
  Clone ID: uC-gsronu33B011f02b1
ttggacgcctgccggaccggcccggaactgtgactggctcgagctccacccacgcggcctatctttctgtcttgcagttacaggagatgcaagaacacttctgctggtaattctgcggcagatgaagaggatgaagcaggaaatgaggatgagtcaattgtacatcattgtgctagtgttggtgatgttgagggtctgaaaactgcactatcctctggtgctgacaaggatgaagaagattcagagggaaggacagcattacattttgcatgtgggtatggcgaggtgaaatgcactcaaatccttcttgaagctggggcaaaagtggatgctctggacaagaataagaacactgccctccattatgcagctggctatggaaggaaagactgtgtggcccttctactcgagaatggtgctgctgtcactctccaaaacatggacggcaagactcccatcgaagttgccaagctcaacaaccagcacgaggtactaaaattactggagaacgatgcgttccttgaagcgtgaagtggtggggatgcgaatgcgatgtgtatgtttgggtcttagcatgtatgctataggcatctgattgtataccca

SEQ ID NO: 6043 - DNA, 556 bp, Gossypium hirsutum
  unsure (1)..(556): unsure at all n locations
  Clone ID: uC-gsronu33B011f03b1
acgcggggtaatttacctgatgagcctgaagctgtcacgatgcataagcgaccaccttgccctgttgcatcagtacgcaacctaaccccacatgcgacgcatcagatgtatacagtaaagtacttaccagacaccggttgaatcaacactggcgcttcggtcaatacctttgtcaaccgatcaaaagctttttgctgtttctcggtccagacaaatggtactcctttccttatgagttttgtcaagggtgccgccatcaccgagaaaccctccacaaaccttctgtagtaacctgctaaccctagaaaactctgaatttccgataccgacctaggtggcttccattccagaattgcatcaattttacgaggatccaccttaatcccttcggcagagaccacatgccctaggaaggttacctgcttcaaccagaattcacacttggtgaatatcgcatagagcttcttttcccttaacactcgcagcacaatacggagatgctcatcatgcttcgcctnncgttagagtatacctgtgatagcccaaaattgacact

SEQ ID NO: 6044 - DNA, 562 bp, Gossypium hirsutum
  unsure (1)..(562): unsure at all n locations
  Clone ID: uC-gsronu33B011f04b1
gaaaacttcatcaaacaagaaaaaaacttgaagtaaaacaattgagagaagatgtcgtggcaagcgtatgtcgatgatcacttgatgtgtgatatcgagggcaaccatctctctgccgccgctatcattggccaagacggcagcgtttgggcccagagctccaatttccctcagttcaagccagaagaaatcactggcatcatgaatgactttgctgaacctggatcgcttgctccgactggattgtaccttggtggcacaaaatacatnggtgatccaaggtgaacccggagctgttattcgagggaaaaagggccccggaggtgttactgttaaaaagaccaacctggccttgatcattgggatctatgacgagccaatgactgcaggccagtgcanacatgattgtggaaaggcttggtgattatctcatagaccagggtctttgatcactgtggtgtaaccttaattgttgcaattcttcctggcttcttctatacaaaagtgcatctaccaccacctcttgtatggttggctgcattaaatatagtatactagtatt

SEQ ID NO: 6045 - DNA, 556 bp, Gossypium hirsutum
  Clone ID: uC-gsronu33B011f06b1
ggaaggcttcttgatacacgcccccatttattttattgttcaaacaaattttcccttcaattttcgtataatttcctaggaaaagaaatatgagagagtgcatttcagttcacatcggtcaggccggtattcaggtcggaaatgcttgctgggaactttactgtctcgagcatggcattcagcctgatggccaaatgccaagtgataagactgttggtggaggagacgatgctttcaacacctttttcagcgaaactggtgccgggaagcacgtccctcgcgccatctttggttgatctggagcctactgctatcgatgaaagggggaccgtgtacgtcccgccagttatttccaccttgagcacttatcagtggcaaagaagatgctgcccacaatttggctcgtggccatatacaattggcaagagatgttggactctgttggatcgtatccaaaggctgctgtaactgtactgggctcaaggctcttggtttcatgctgtggtggggactggtctggactgactctctctggagcgctcttgtgactatgaag

SEQ ID NO: 6046 - DNA, 473 bp, Gossypium hirsutum
  Clone ID: uC-gsronu33B011f11b1
ttgtattatgggtcttgtctattgtgggaagttggtgcaacttcttgacgctgttctatatagtcttcgtagtacttcacactgtacctgtgctgtacgagaagtatgaggacaaggtggatccctttgccgagaaagcaatgcatgagattaagaagcagtatgcagtgtttgatgcaaaagttctaagtaagattcctaggggaccgttaaagcaaaagaagaaggattagtttaccggtcaggatgttgatgctgctaggttcagaggactgtattcatgaagttgttgagttttatccagtatcagttagaatcctgcttttatccttttcttttgtagtaactgggttcaaaatgatgatgaatatggaaactttttttttcttaacatctttggttctgctgtcatacatgggagctgtccatggatttatatgctatgtgagacatatgttattgtatgcatgttg

SEQ ID NO: 6047 - DNA, 543 bp, Gossypium hirsutum
  Clone ID: uC-gsronu33B011f12b1
ttctttgttaagatcattgctgctattaaagaagctgggaatgtcaagagatttttcccatcggaatttggaatggacgtggacaagaacaatgcggttgagccagcaaaatcgacattcgcaatcaaggctcaaatccgtcatgctgttgaggctgaagggatcccttacacttatgtgcctgctaactgctttgcaggctattttcttcctacattgtcgcagccaggagccacctctcccccaagagacaaggttggttattctaggtgatggaaatcctgaagctgttttcaaccatgaagctgacatcggaacctacaccatcaaagctgttgatgaccccagaacagcgaacaagactctattcatcaggcctgccaagaacacctactcatttaacgagctcatcgccctgtggagaagttgattggaaaacccttgagaaacatatgttcctgggaccaacttctcaacagatccagagtctgcaatccatcatatatgtgggcatagtactcatctttgcatgtgatgcaccac

SEQ ID NO: 6048 - DNA, 128 bp, Gossypium hirsutum
  Clone ID: uC-gsronu33B011g01b1
cccacgcgtttcgatcagcaaatcttcatgaggattggggtcttaattatgtgtaatgtggcttttctgctatgtcagaatgtattatgatgtttaagaaaaaagagagctacaataagcttgaatag

SEQ ID NO: 6049 - DNA, 517 bp, Gossypium hirsutum
  unsure (1)..(517): unsure at all n locations
  Clone ID: uC-gsronu33B011g02b1
tcgtcattgaaactggcatgcctcacggggaggaattaaagaggttggagaaagagaagggaattataatgcgatttgtcataggacacagtgcaaccccgggtggtattttggatcgagggattgaagctgaagaggagcaatacaaggattttctgcgcctgaatcacatagaaggttaccatgaattatcatcgaaaacccaaatatacttttccacagctgatgctaagtgggatgcagacttttatattaaagctgacgatgatgtacatgtaaatctgggtatggctgggttctacattggcccgtcacagatcaaaaccccgtgtttatatcggttgcatgaaatctggacctgttctagcacagaaaggggtcaaataccatgagccagaatattggaaatttggtgaggaggggaacaaatactttaagcatgcaacccgacaaatatacgcagtgtccaaagacttggcaacctacatctacntcaatcggcacatacttcatagat

SEQ ID NO: 6050 - DNA, 534 bp, Gossypium hirsutum
  Clone ID: uC-gsronu33B011g04b1
aaaatggttttccaaaccctacaaaaatggcggagaaagtggctcctgaaaaacgacacagttttctccacaacggtgaaaaggtatttgaatgggatcaaaccttggaagaggtgaatatttacataaacttaccgccgaatgttcactccaaacagttttactgtaagattcagtccaaacatgtcgaagttggcatcaaaggcaaccctccttatctcaatcatgatttgttctccccagtgaagacggattcatctttttggacgctagaggatgatataatgcacataactttgcaaaaaagggacaagggtcagacatgggtcgtcaccgatactaggtgagggtcagctggaccccgatgccacttgatctcgagcagaagcgggtcatgcttcagagggttctgggagagaaccccggtttcgatttctcccagctcagttcagggaagctgtcctgatccagggactttatgggcgcatcagttcggattgcagtcatcatatataatgctgtttgatcactaca

SEQ ID NO: 6051 - DNA, 405 bp, Gossypium hirsutum
  Clone ID: uC-gsronu33B011g05b1
acccacgcgtccgtcctctcttccgcttcaataatttcttccggggagctttgtatagaaattaggtgggggatttttcattatgggaaagatcaagatcggaatcaatggatttggaaggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtctcagttttccgtatcagaaacccttaagacatcccatgtgctgaggctgcacctgactatgatggtgagtctactggtgtttttactgacaagga

SEQ ID NO: 6052 - DNA, 513 bp, Gossypium hirsutum
  Clone ID: uC-gsronu33B011g06b1
gcatctttgacgcagctgctatttcttttttgtggtttgtcagcagcagcttgtatttggaagaatggtgagggtgagcgttttgaatgatgcactcaagagcatgtacaatgcagagaagaggggcaaacgacaggtcatgatccgaccgtcctcgaaggtgatcattaagttccttttggtcatgcagaaacatggttatattggggagtttgagtatgttgatgatcatagatctggtaaaattgtggttgaattgaatgggaggctgaacaagtgtggggtgatcagtcctcgttttgatgtcggtgttaaggagattgaggtgttggactgctcggttgcttccttaagacagttgggttatattgtgctcacaacatcagctggaattatggaccatgaagaagccagaaaaagaatgttgtgggaaagtacttggcttcttcactgagaaatttgccttttcattttgaatcgactatattataagatgcatcttttgtagtcagc

SEQ ID NO: 6053 - DNA, 304 bp, Gossypium hirsutum
  Clone ID: uC-gsronu33B011g07b1
taagtagctcccaaacaagaggatgagaaacaaccgtgaagtctctaatcttcatggtagtgttttacttctctggttgtttttgtatggagaagtcgcgtggtcctactatcgtcttcaattacttgtttttagtagatcaggcctcaatttatgaaccttggaagtactcctaagaatttcttagtgtttcactggttattgtttttgagtttgaagccttctagcttttgtaatggcagtgaagttatgtgcacactttcttaattgttttcatgacaataatggagctgatggttgagat

SEQ ID NO: 6054 - DNA, 60 bp, Gossypium hirsutum
  Clone ID: uC-gsronu33B011g10b1
taattaaaaaaaaaaaaaaaaaaaaaaaaaagaggggaaaaaaaaaaaaaaaaagggggg

SEQ ID NO: 6055 - DNA, 414 bp, Gossypium hirsutum
  Clone ID: uC-gsronu33B011g11b1
tttctctcgtccgcttcaataatttcttccggtgatctttgttagagattagcttgttaatttttcattatgggaaagatcaagatcggaatcaatggatttggacggatcgggcgtttggttgcgagagttgctctccaaagcgatgatattgagctcgttgctgttaacgatcctttcatcaccactgaatacatgacgtacatgtttaagtacgacagtgttcacggtcaatggaagcatcatgagcttaaggtgaaggactcaaagacccttctctttggtgaaaagcctgtcacagttttcggtatcagaaaccctgaggaaatcccatgggctgaggctggagctgagtatgttgttgagttactggtgtttttactgccaggacaaggctgctgctcactgaagggt

SEQ ID NO: 6056 - DNA, 488 bp, Gossypium hirsutum
  Clone ID: uC-gsronu33B011h03b1
gccacgcgtccgctctgttgctttctctccctccctcgagtatcttctcttcgcaggcgaacaaacagagctcaatttcttttcttattccgagtcttggttatcagattgcatgttgcactggagtgattgacatagcaaaagttcgctaggaagaatcaatgaaaccttggttagcatgtctggattaattgaaggtcttcccgatgctgttgcccttaggtgcctagcacgggttcccttctacctatatcctaagttggagattgtttctcattcctggagagctgccattcgtagccccgagctgtttaaagctcgacaggaacttggctcaacagaggaacttctatgcgtgtgcgcctttgatccggagaatttatggcagatgtatgatctttacgtgatctttggattactcttgctgtccttgcctaaaggtcaggcaccttgctcatttggtgtggtctctactggtgggaaagctg

SEQ ID NO: 6057 - DNA, 528 bp, Gossypium hirsutum
  unsure (1)..(528): unsure at all n locations
  Clone ID: uC-gsronu33B011h04b1
gcgtccacgcttgcggactgactaagatttcaactgtctgtcactctcctgttttgctgcctttaccaagagagaatgaaaccaaaatttctgtttctcttgcttgtattatgcagtctcactatagacaacgttttagcaacctcacttggaactcatggcaaaattcccgacaatgaaacaatataccgagtctccaagcaancggtgttgggtgttgtattggagagtcactagagttcctattcactcacaatttggtgagggcaaccaaatgggagccactcttgttttgggatttccagcttgagaaatatgcccgatggtgggcacttcaaaggaaagcagactgcatgctacagcattcgtttccagagggagatttcaagctgggagagaacatatactagagcagtggctcggcgtggatgcccagtgatgcagtgagtgcctggtccgaggaagaaaaatattacgactatgcaaccaactcgtgccaggaggcacagatgtgcggtcactacaccc

SEQ ID NO: 6058 - DNA, 569 bp, Gossypium hirsutum
  unsure (1)..(569): unsure at all n locations
  Clone ID: uC-gsronu33B011h06b1
gctgttcgtattggtgatttggagcttttcagatctggggctgagaagttctcaactactttcagttcagaccggacccataacttgattgtcaggctgcggcataatgtcattcggactgggctacgcaacataagtatctcatattctcgcatcgcactggccgatgttgcgaagaagcttagattggactctgttgctgatgctgagagcatagtagccaaggcaatcagagatggagctatcgatgcgacattggatcattcaaatggatgtatgctgtccaaggagacgggtgacatctactctacaactgagcctcaaacggcattcaactctaggattgctttctgcctcaatatgcataacgatgctgtgcgtgcctttcggttgccaccaaactcccacaggagangtaaagtgctgagaagaggagagaaagacaacaacaggagcaagagcttgcatagcacattgcagaggaagatgacgacgaatttagagattgacattcganagttactttatccaccatatgatggtttgatcaagtgtgcattttcttttta

SEQ ID NO: 6059 - DNA, 430 bp, Gossypium hirsutum
  Clone ID: uC-gsronu33B011h08b1
tgccattcgtccgactagccttaaacgtatcatcagcatctctgtctcgctctctctctggagaataaatgtggctgtcatcttgaagcacaagaataatgcctgagaaaataacaccagaggacttatacaacaatctagtagagaccattgcagagggtgtctctaagcacaaatccgtgtcctcttttgaggaagagaaatcaaactcagttgtctctggctaaaagcggcttcatggacagctgaggccggcccaccatattttggggtgtggaaaacctgctgaagtttggttatggaggaacaagaagacctcagcctgctaatagctagtgcaacgttcatacggtctctatgagcctggcttacgtacccttgcctgcctcttctatgctttgctatggtgctaggcatgcttgcatagact

SEQ ID NO: 6060 - DNA, 546 bp, Gossypium hirsutum
  Clone ID: uC-gsronu33B012a03b1
ctgcttcgttaacggttgtgatgggtcggtacttttggacgataactcgacgtttataggtgagaaaaccgcggttccgaacaataactcggcgagagggttcaacgtcgtcgacaacatcaaagctcggctggagaaagcgtgtcctggagttgtatcctgcgctgatattctcgccattgctgctcgtgattcggttgttcggttagggggtccgtcatggaaagtaaggttgggaagaagggattcgacaagcgctagcagaagtgccgcaaatacctctattccaccgcccacctctaatctaagcgctcttatttcaagcttctcagctcaaggcctctcaataaaaaaccttgtagcactttctggttcacacaccattggcctcgcccgctgcacatcatttcggtcacacatttacaacgactccaatatagacccctcctttgccaactcgttgcgacggatttgcccgagaagcggcaacgatagtgtgctcgccccttcgaccgtaaacaccaacttgtttgataactatactac

SEQ ID NO: 6061 - DNA, 223 bp, Gossypium hirsutum
  Clone ID: uC-gsronu33B012a09b1
ttcacgcgtccgtatgatgccacttgcctgatcaaaaaattccataatgtatcagctaccattttgattgatcagggggaggatgacaaatttttacatgaccaacttctggcgcaaaagtttgaggaggcatgtaggagtgtgaatgtgccgttgttattgcggttgcagcctggatatgatcactcatatttcttcattttcacctttatcgatgatcaca

SEQ ID NO: 6062 - DNA, 451 bp, Gossypium hirsutum
  Clone ID: uC-gsronu33B012a10b1
gtagttcgtgctgggacggtggtgaactatgcagtatagaacggtatcacgcagccactgcttttaaacacggaaccgaaacaaggtgaaaatggagaccaagaatacgatgatggtgaggaagaatcttgtgagaaaactcgtaaacccgtcacttctatcctatcagcatataggttactcacaccatcagtgaaggtataacaaaattttagctcacatgaaacatctatcctctgaactaactcagcgcttatcattctacaggtacaactattggtttattttatgcttaaatacgcaatggagatattactcgctgaagcaagtgtcatcacggcatattacttcatatggtcaaccaacagtgtagccatctttcttgcatgtctcgggttaaccgtactttccgtaaacatcatcgtcggtacttacatcagaaacatgttcg

SEQ ID NO: 6063 - DNA, 565 bp, Gossypium hirsutum
  Clone ID: uC-gsronu33B012b01b1
taaattttcaatcctaaatactcgatccaattgaaactcaattttgattttttaatcattattcttattatttattcgatgtgatcatgcccgcgacggattatcaaggaacttcgtcaccgttgacaaatatcggccgttcgttattaccagtgaggagggatcaagtacacgccatggaatcgccgatcggtggatcggcgtctaacgaggcggagatcgagtcctttcaaaggcaagtagctgacagatttcacgatttagcttctgtcccttccgatgaattgctttctctgccgtgggttcggaagttgctcgacgttttcctctgttgtcaagaggaatttcgggtcatgctttttaacaacatagctctagtgaagaagccgcccatggaccgtttgatcgccgatttttacgagcgtactgtcaaggcgcttgatgtttgcaatgcgattcgcgacgggattgaacagatcaggcaatggcagaagcttctagaaatcgttctttgcgctttgggtgatagtaatgttggttatcagagaagtctaggagaagggca

SEQ ID NO: 6064 - DNA, 534 bp, Gossypium hirsutum
  unsure (1)..(534): unsure at all n locations
  Clone ID: uC-gsronu33B012b03b1
taaaaaacaaaaatttcatggctcggaaattctttgtcggtggcaactggaaatgcaatgggacaactgaggaggttaaaaagatcattacaacattgaatgaagctgaagttccttctgaggatgttgtggaggttgttgtgagccctccatttgttttccttacctttgtgaaaagtctgttgcggtctgatttccatgttgctgctcagaactgttgggttcgcaaaggtggtgcttttaccggagaaattagtgctgagatgcttgttaatctgagcattccatgggttatcatcggtcactctgaaagaagggctctcttgaatgagtccaatgagtttgttggagacaaagtagcgtatgcactttctcaaggcttgaaggttattgcctgcattggggagactcttgaagagcgagaatctggctctacatggctgttgttgctgcacataccaaagcaattgctggaaaagtaacaaattgngacaatgttgttttggcttatgaacctgtttgggccattggtac

SEQ ID NO: 6065 - DNA, 512 bp, Gossypium hirsutum
  Clone ID: uC-gsronu33B012b08b1
tgagtttaatccaagttccatcccacattctattttaaagagacatattcacgatcaataccacgagtggttacatccttcgagtaagctaactgctggtaatggtgatatcccgcacaagttcaataccatttcacactcgtatttcggtttctatgcggaccagttttggccaaagggtcaacccgtgatcccaaagctaatacaccggtggctgtctccgattgtacttgcatactggtatatgtacgggggctacagaacatcagccggggatatccttttgaaactgaaagggagcagcgaaggcgtcaagaaagtggtgaaagcattgaaatcaaaatccttgaattgccgagtgaagcgaaaagggagagtgttttggatcggatttctaggacagattcatgtggttctggaactggtggaaccatacgtcttagatgacttgaaagattttctaaagcaggcagcgaaaccgctgatgaatgtgcggtcgaatctcgagacat

SEQ ID NO: 6066 - DNA, 568 bp, Gossypium hirsutum
  Clone ID: uC-gsronu33B012b09b1
tccacgcgtccgcccacgcgtccgcccacgcgtccgtttttgatgagtataagcctccacttcattgtacttgtagccaatcgagtatgccaacacatgtttctctcgttgaaccacaacaaaaaatgaaaaggcgaatgtaggctttgtttaaaaaccatgagttggaaaatggtggtaaggataaaacatctgagttggataaatatctagctgaggctaatgaggaatttgttgaagattttgatattttgtggtggaaagtgaacaaccctagatttcccactctttcaaaaatggccaaagatgtgttagctataccagtttctaccgttgcttcagagtctgcatttagcaccaggggacgtgtgcttgataaatataggagttctttaactcctaaaattgtacaagctcttgggtggactcaagattggattcggaaatcattattgcaaggaagacatcaaaaagattggaggaacaaattcaagagcttgacaaggattgaaatgatataattattgctttattttaataggttcaattttttaccatatcactctta

SEQ ID NO: 6067 - DNA, 440 bp, Gossypium hirsutum
  Clone ID: uC-gsronu33B012b11b1
tccacgcgtccgcccacgcgtccgcacacgcgtgcggccacgcgtacggattttgatagtttgttaatttgttacaaaattaaaatgtcaaaagagttctaatgttcttaaagagttgtaataattcaaaaaagtaaataaaaaaagagaaaataatttagaaaataataaagccatttacaacaaggtaacaaggtgttaaaaaatgacaaaaatttcaatgcatgattaggagaaaattcaaagtaaacaaaagtcattaaaattaacaaagtataaaaaatacattttttaaaaagatatttattataaaaattacattttttaaaaagatatttattctttcctctcactttcccccaaattggtgtattaagaaaatgagggaaaacatgggaaagtgagggattctcagctcccttcaaattttcctaccatgt

SEQ ID NO: 6068 - DNA, 592 bp, Gossypium hirsutum
  unsure (1)..(592): unsure at all n locations
  Clone ID: uC-gsronu33B012c02b1
ggtcatccagggcataactgaatcgttaggaatatgaaaggaaatcacagctagcttagctcttagttcagaccatatctcaacaacttaaatcagtactttcaggcattagatgaggttgggggatgttttacttgagcagttccttgtatggttgaatcatgtaggtatctttgttggtggaagcaaggtggttcattttagacctgaacgtaacttggattctagcactgagccatcttctgatctatacaatcctatatctcctcgatcaacttgtccgacttttcccgattgtggcttccggcagccgaacagtggggtagtactctcatgcctggattgctttcttcgaaacggattgctctactgctctgagtatggggtgaccccatctgttttccttgccatagtgcgtggcggcacatgcaccacagcaatgtctgaccctcctgaaacagttatccacagggcaatgtaccttcttaaaatggatttggaaatatgacatattccagaataactgtgaggacttgcactgtatgcaaaactgtcttcgattatgaaagcaggngctcgaagagcgtcagct

SEQ ID NO: 6069 - DNA, 552 bp, Gossypium hirsutum
  unsure (1)..(552): unsure at all n locations
  Clone ID: uC-gsronu33B012c04b1
tcccacgcgttcggttaagtttgagaatttggcttctattcactcattgaaaattaaatacgagcagtgcttggagaattgtggaactaagatggatgttaatgcaccagacccatgaaaacgaattgatgagcgtgctttggagaaagaggaggaagattatttcaacgaggaccgtgatgaagatgatacaacctcggcatctcatcctaggaaagttcagcctcagcctgtttcatccaatggattgaggccaaccgctcatcattaagcccgagatctggtggactggttgactatgaggacgatgaagatgatgaagactataagccaccgcctccgaggaagcagactgaaacctcggaggaagatgagggaacgtttggagtccattaggtcaaagcggaagctgaatcccaaggaaaaggagcatgagctatccaagaagcaacgtttggggaaaagccctaaatcgagagatagtgtatttgcagctttatgttcaacgttaagccaagcagtcttgcctagntagataaccgaaacaccata

SEQ ID NO: 6070 - DNA, 607 bp, Gossypium hirsutum
  Clone ID: uC-gsronu33B012c07b1
tccacgcgtccgagctgcaaggctgtgagtggcagctaatgagaaggcagaggctgagaaaattttgcaaatcaaacgagctgaaggtgaggctgagtccaaatatttgtcagggctgggtatcgctcgccaacgacaagcaattgttgatggtttgcgagatagcgtgcttggattctccgttaatgtcccggggactactgcaaaggatgttatggatatggtcctggttacccagtactttgacaccatgaaagaaattggtgctgcttgtaagtcctcagctgtgtttatccctcatggtcctggagctgttcgtgatgtcgctactcacattcgtgatggactcctccaggccacacaccagtaactatatgattttttcttaagacaagacaagacaagcattagtagttttttaaggataatacctggttttaacgtttacctgtttagttctggatgtcatttttacattatgagcatctgttgtacatatggtgtgggcataacggtttgtgaacgcataagatatttatactctatagatgtgagtgatcttatatggatattctggttctatgtcggcatgatgaggatgacaatc

SEQ ID NO: 6071 - DNA, 610 bp, Gossypium hirsutum
  unsure (1)..(610): unsure at all n locations
  Clone ID: uC-gsronu33B012c10b1
ttacggcgtccgtgacttcttcagagaatacctgacagagtccaagaagctctggttccttgctggccccgccatcttcacatctctttgccgatactccctcggcgctatcactcaagtctttgccggccaagttggcactctagctcttgccgccgtctccgtggagaattcattcatcgccgggttctccttcggcgtcatgcttgggatgggaagtgcactcgaaactttatgcggccaagcatttggagcagggcaggttggtatgttaggggcgtacatgcaaagaacatgggtcatcctcaactcaacggctttgatgttaagcttgttatacatattcgcgtcaaaatttttgagggtaataggccaaacagaaagcatatcgaaggcggccggaatgttcgcaatgtggatgttgcctcaactgtttgcttacgcgttcaactgtccgatggcgaagttcttacaggcgcagagcangatcatggtgatggcggtgatagcangagtggtgttggttctgcacactgtattaagctggctcttgatgctaaagctgggatggggccctacggtgcagccgtgttttaatatgtcgtggatt

SEQ ID NO: 6072 - DNA, 500 bp, Gossypium hirsutum
  Clone ID: uC-gsronu33B012c12b1
accacgcgttcgattttagatcacagcaagtggggtgtggcaggagaatgagtcagaatacctttaggaggttttatagttgaaaagttattctggatcaacgaggatattgatgactgtactttgaggttatccttgttgatgttgcacacaatgggatccgcaacgacccgagaattaactggatctgcaatcccgttcacaagcacagggaacttggaggactcacatctgcaggtaagaaaaacaggggtctgcatggaaagggtcacttgcaccacaagaatcggccgtctcgaagggctacctggaagagaaacaacaccctttcccttcgtcgttaccgttgagtttagtaggatactttcagacgtattaattgcttctatctttgtgggattttggaattccttttactgagtctgaaatttttgcaagttatttgtgtttgagttttatttaatttcgatgaaaagaaaagtcgagtctatttcagtctg

SEQ ID NO: 6073 - DNA, 612 bp, Gossypium hirsutum
  unsure (1)..(612): unsure at all n locations
  Clone ID: uC-gsronu33B012d03b1
taaggatacagattctcaagatttcgcaagctaaattgaaggaattcatttcattttgtgaagcaatggaacttgtaccacaggaagagttggaagcttctgtgcaaggagcttcaaattcttttgctgaccgaagagctttgaagattgcttgttttagacgccaaagggctgcagaggcaaaacttacagaaataaaggagcggaaggagcggcgtggacgttcaacaaaagcagctaccttatccactcctgtggaggttggagaggactgatctgcttgatgatgatggggcaggaggaacgagaggcttggcttactactatctcattggctatttgtaaggcttttgatctgcttgaaatgctgaagaaggaagaggaaatgctttctgcgataaaggagaaacagctcaaggatggggaaaaggaattttctcaggctatccttgatgatcgcaccagaaagcagaggcatggcatcgtgatgctgcagctcgtgcacggtatactcaacctgcagcacctattacttgtgctacatttgctcaaaatggtatngaaggagggcaaatgtatcgcagcacatgaccacaacaccagccatgatct

SEQ ID NO: 6074 - DNA, 590 bp, Gossypium hirsutum
  Clone ID: uC-gsronu33B012d07b1
gttctttgtttaagaataaggatcttttaagatacgccggatccgctaaaatacgccgatccccgtccgtcttccgatcatatggggctgcttgaccagttgtgggatgataccgttgctggtccccgacccgataatggccttggcaagctccgaaagcactccactttcactttccggcctaactctgccaaggaatctgatggcgggagtgtaagatcgtacggtgatgaagcgccggaggaagcgacgagagtgacacgtagtattatgatcgtaaagccgcctggttaccagagcggatcgcctccggtttcgccggccggatcgacccctccggtatctcctttttccggaggcagagaatcatatcggtttcggagaaggtccacatcggatgcatacgagaaggctaacgaggttggaccaaggagcccttgtcctcctcctacgacgtgtgagatatgagtcctctcccatatttggcgacaaatcaatgggttttggtactgtttgcatgcttaggtctttcaaatgtgtaacttaatagtgtagtatggggtgatgtatgcaagaatgtagtctggtac

SEQ ID NO: 6075 - DNA, 560 bp, Gossypium hirsutum
  Clone ID: uC-gsronu33B012d08b1
tatttataaggtgttttatatcccagtatgtctgtagtattataataattgttgttcagtttatactgtgtggaagtcctaacatgtatatggtcataggatttgatgaagctaaatatttgacttgcaaacaaagtttgagcaaatagtttctcgattctgtttaaaacttcgagggttgaagttttgcagagtttcttgtaattgcttgattgcgctagaaacaatgatagaattaaatattcaatgatagattatgtttgctgtcatcctggtgtttcgaagcattagtgtgattgttcttacactggtttaagtttgcagtcatagatattgtgttctcctgaataaatgactggttctgcaggatatccttcccattttgtagttatttggtcctcagcatgcatcatggtttggtccttgggagaatttgagatgtcattcatttgttaaagtaaacatttttgtgatgtgtctgtgtgcggtgaagtttgacatggaacatcttaggatcctgttttagctagtataataccatgtctaacccaacatgacac

SEQ ID NO: 6076 - DNA, 424 bp, Gossypium hirsutum
  Clone ID: uC-gsronu33B012d10b1
ttcacgcgtccgtaaaaacaggagcaaaaagttcattagaccaataagttcaagtaaaagcacattagcacttgctgttgcaatgagtggttcagagactgatagtttttcaagcgctggtgaggattcttcttcaacttccagtcctaggttattactacctccattacacccacaaacgaaaatggtttctttgtataataatagtattagtattaccccttcttcatcaccgtcgagtggtggccggaatttctctaactggcggtctttttcattggctgatgtacgtgaatataactgactgttatagttttacatggagtttgatatattttttaaaaaaaaaaaaaaaaaaataaaaaaaaaaaaaaaaattaataattaaataaaataaaatataaatttaaaaaaaaaaataaaa

SEQ ID NO: 6077 - DNA, 512 bp, Gossypium hirsutum
  Clone ID: uC-gsronu33B012d12b1
tttcgtccgtttaaaaccgaacaaggccgtgatcgtcctccaaggccgatacgccggccgcaaagccgtgatcgttagatccttcgacgaaggcacacgcgaccgcccttacggtcattgtttggtcgccgggacaaagaagtacccgagcaaagtcattcgcaaggacttggccaagaaaacggcgaagaaatcgcgtgtgaaatgcttcgtcaagctagtgaattaccagcacctgatgcccacgcgctacacccttgacgtggatttgaaagacgtggtcaccgccgatgctctccagaccaaggacaagaaagtggcggcttgtaaggccactaaagagaggtttcaggagaggttcaagacggggaagaacaggtggttctttactaaacttaggttttgaatgatttattctaatggtgttaaaagctttttatgtagtttctttaacattttggatttgaattttgagtctgttgtgcaatgagatattttctgggtttcttatt

SEQ ID NO: 6078 - DNA, 474 bp, Gossypium hirsutum
  Clone ID: uC-gsronu33B012e01b1
tgaagatattgtgggcaaagacaagcttgtggtgtctacctcctgctcgcttctccacactgccgttgatctagttaacgagactaagctagatgatgaaatcaaatcctggctcgcattcgctgcccagaaagttgttgaagtcaatgcacttgccaaggcattggctggtcagaaggatgaggccttcttcgctgccaatgctgccgctcaggcttctaggaaatcctccccgagagtgaccaatgaggctgttcaaaaggctgctgctgctttgaagggctctgaccaccgccgtgcaacaaatgttagtgctagactcgatgcccagcagaaaaagcttaacttaccggtccttcccaccacaaccattggatccttccctcaaaccttggaactcaggagagttcgtcgtgaattcaaggctaacaagatctctgaggacatttacattaaagccattaggaggaaatt

SEQ ID NO: 6079 - DNA, 543 bp, Gossypium hirsutum
  Clone ID: uC-gsronu33B012e05b1
ttaatacctctcgagtatacgtgacagttagtgtttaccttggactggtaatcctgttatatgatatgtgactcgagagtgtgttccttgattaagtgccttaataggtactcttgaatatgaattgatggattattaaatcgtacaccttgagtgtactacttgagtattcatcgaaatttcaatgattcaatggccataaaacttttgacatggcatgagaattatgagatgaaatgataatgtcttgaatgataaatgcatgatgagctcatctattcttactcgatgtatatgtaaactttgtgactaacatgtttgattggatgcatgtgtttagatggatgaaaaacttgttattgtatgcttagatttacgaaacggaattgcttagtttagttttcattatacgaacttactaagcatgtaatgcttactccgtttatttttcccctgtttatagtgtttggaagctcgcgacggtggagatcactagagcattgttacactatcactagtcatttgagtatacttagaaaatca

SEQ ID NO: 6080 - DNA, 493 bp, Gossypium hirsutum
  unsure (1)..(493): unsure at all n locations
  Clone ID: uC-gsronu33B012e06b1
aactatggcttcaaatcccaaggttttcttcgacatgacgatcggaggtcaaccggccggccggatcgtgatggagcttttcgcagacgtcactcctcgtactgccgagaacttccgggcactctgtaccggtgagaaaggcgtcggtcgttccggtaaaccactccactacaaaggctctaagttccaccgcgtgatccctgatttcatgtgccaaggaggtgatttcacagccggaaacggaaccggaggtgaatcgatatacggatctaagttcgccgacgagaacttcatcaagaagcacaccggacccggcatactatccatggcgaacgccggtcccggaacgaatggatctcagttctttatttgtaccgctaagaccgagtggcttgatgggatgcatgtggtgtttggtcaagttgttgaaggtatggatgtggttaaaggcatgaaaaagttnggtctagcagtggaagaactgctagcctgt

SEQ ID NO: 6081 - DNA, 472 bp, Gossypium hirsutum
  Clone ID: uC-gsronu33B012e07b1
ctctcctttgttttcccttttgtctctctctctctttttccaaccctaaccctacctcaccaaccaggattcaacatgaagggaggaaaatccaagtcagatactaagagtgccaagctatccgtgaaatccaaagctggaaagaaatcggggaaggctgccaaggatccaaacaagccaaagaggcctgctagtgccttctttgttttcatggaggagttccgtgagcaatacaagaaggatcaccctaaaaacaaatccgttgcggctgtcggcaaagctggtggagataaatggaagagcttgtctgaagctgaaaaggcaccttatgtagctaaggcagaaaagcggaaggttgagtatgaaaagaacatgaaggcctacaataagagacaggctgagggtcccaaagacgaagatgttgagtctgacaaatcagtgtctgaggtgaatgatgaggatgatgatgaag

SEQ ID NO: 6082 - DNA, 316 bp, Gossypium hirsutum
  Clone ID: uC-gsronu33B012e08b1
ttcacgcgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaattaaaaaaaaaaaaataaaaaaataaaaaggaaaaaaataattaaaagtggcgtaattggaaaactctttttttttcaaaaaattattgttttagaaatatatactagtttttaaaaaatgggctattatttaaaaaggtgcttaaaaaaataaagagttttaaaaatgaaagatttt

SEQ ID NO: 6083 - DNA, 435 bp, Gossypium hirsutum
  Clone ID: uC-gsronu33B012e09b1
taaagttggcaatggatgaaatccatgatattcatggactacgagtcattgttgaaaatgaggaagactgttatgaggctttgagagtagttcaccagttatggtctgaagtgcccggaaagctgaaggactatataagtcgccctaaatttaatgggtatcagtccttgcacacggtggtgacgagtgaaggtacagttccacttgaagttcaaattcgaacaaaggagatgcatctgcaagctgagtttggctttgcagctcactggagatacaaggagggtgactgtaagtactcttcatttgtacttcagatggttgagtgggctcgatgggttgtgacttggcactgtgaaacaatgagcaaggaccaatcatcaatatgctacactgattctgtcaagccaccctgcaccttccctactcattcggatg

SEQ ID NO: 6084 - DNA, 536 bp, Gossypium hirsutum
  Clone ID: uC-gsronu33B012f04b1
tccacgcgtccgtttggccttcacaataccaaatctaattttggcatctttaattcccatgttctttctagggttttgaattccccctccctggttatccctaattattcatcaagttccaattttcattgtctgggtacttttagatctccttttttttaaaaaaaaaatttcggatccttttttgttatcgtaaaaaaaaaaattcaatgtcacaaggtttctcaattgagctttacttcgatccagcacttgagaaccaggtcttaaaagcttggaatgttttggctcgtcgtcaaatcagcactcagttaattgaaatcgaatcaaggcctcacattactctcttttcaagcccttttctcgatcctgcaaagcttgaatccgttataaagtcctttgcttcaaagcaagaacctttacctatttctttttcttcaattggggctctcccaaatgaaaacaatgttctcttcctttcaccagctccaacaatgacgctcctacaattccaggctcaggtatgtgaggcaatt

SEQ ID NO: 6085 - DNA, 493 bp, Gossypium hirsutum
  unsure (1)..(493): unsure at all n locations
  Clone ID: uC-gsronu33B012f07b1
tacttattcttttttctgtcaaaattttagatccgaatctaattccacgattttctttagagttttaaatttgatcttctcttccaaaatcaaatccaaaaagagagaaaatcccaccaaaaaaatggcgatttctaatgacaacaacaacgacgagcaccatgaatcgagtcctcttttgagcaaacaagtggcagaccaagatttgaaggagaaaccaagtggtaaaaaggcaaaagaagctgccgccgaggtgccagctcatccggtagttgctaccggagatgggtttgggtggacagctgatgggttgccgttggtccaccggagtgtcgtcggagaacccttgngtcgatctcaatggaactcatctctccttgcttgtcttggccgtaacgatgaattttgcagcagcgacattgaaggttgtctccttggaaagctggtccattgtgtgctatatggaaccaatgtcgaaagacttggatctgat

SEQ ID NO: 6086 - DNA, 504 bp, Gossypium hirsutum
  unsure (1)..(504): unsure at all n locations
  Clone ID: uC-gsronu33B012f12b1
taaaaaaaaaatgtcgtcaaatggaactgacaactcaacttctaagaagcctccaagtccttctcctttgagattttccaagttttttcagtccaacatgagaattcttgttactggtggagctggattcattggctcccatttagtggataaattgatggagaatgaaaagaatgaggttattgtcgtcgataactactttaccggcacataggacaatctcaagaaatggatcggacatccgagatttgagctcattcgtcatgatgtcactgagccgttgctattgaggttgatcagatctaccatcttgcttgcccggcttcgccaatcttttacaaatacaatcctgttaagacactaaagacgaatggtgatcggtacattgaacatgnttgggtctgcaaagcgtgtcggagcaaggattatacttacctcagcttcagaggttttgggagatcccttggaacatccccagactgagagctattngggaaatgttaa

SEQ ID NO: 6087 - DNA, 218 bp, Gossypium hirsutum
  Clone ID: uC-gsronu33B012g06b1
gacggaatgaattttatatagtgtcacctgggctggaacgttatatgacgcatccaatgtacacacgatcgcgtagtgtgcaaacacccatgagcgtttacctatacttaatacgctattagttaaacatcctggctgtcggcagatgacgtatagctggaggaccctagcgatcgccatttcaaacagttgggcagactgaatggttaatggaactg

SEQ ID NO: 6088 - DNA, 58 bp, Gossypium hirsutum
  Clone ID: uC-gsronu33B012h03b1
ctcactcttttttctgccttaaaagacgagacctcaaattgcaggcttctgttttttt

SEQ ID NO: 6089 - DNA, 303 bp, Gossypium hirsutum
  Clone ID: uC-gsronu33B012h05b1
tccacgcgttcggaaaattcaaatgatataaacaaaactgaaggtaatagttctgtgtactgtgctgaggaaagacatgcttttggcgatgcaattagtggttccataaatggttttcctaaggaatcaggggctttgattcctgagtcaaatgagtctgggtctgagtccgtaattttaagtcggatacatcattctcctgaaaatacacattgagacaatttctatatccatgttctttttataatgcgcccaaaaaaaaaaataaagtatgaggatgctagaatgaagaaaccttaaaag

SEQ ID NO: 6090 - DNA, 468 bp, Gossypium hirsutum
  unsure (1)..(468): unsure at all n locations
  Clone ID: uC-gsronu33B012h07b1
ttcacgcgtccggtgctttctgcactggttctaggagagttgccaactctttgggtagttgcttcccttgtaccaattgttggaggagttgcacttgcatccgtcactgaggcctctttcaattgggctggattctggactgcaatggcttcgaatttgacaaaccagtctcgtaatgttctcagcaaaaaagtcatggttaataaagaggagtcaatggacaacattaccctcttctcaataataacagttatgtctcttatcttgctagcccctgtggctatcttcacagagggtgtcaagtttacccctgcctatttgcaatctgctggcttgaatgttaaagaagttgttgtaagatctctacttgctgctctttgcttccatgcctatcagcaggtttcgatatgatattgcanagggtatcccctgttactcattccgtaggcatctgtgtgaaagggtggg

SEQ ID NO: 6091 - DNA, 500 bp, Gossypium hirsutum
  Clone ID: uC-gsronu33B014a01b1
atgggtaaggagaaggttgacttcatctcttgttgtcatcggccatgtccactctggcaagtcgaccactactggtcatttgatctacaagctaggtggtattgacaagcgtgtgattgagaggttcgagaaggaggctgctgaaatgaacaaaaggtcattcaagtatgcttgggtgcttgacaagcttaaggctgagcgtgaacgtggtatcaccattgatattgccctgtggaagtttgagaccaccaaatactattgcaccgttattgatgcacctggacaccgtgactttatcaagaacatgattaccggtacctcacaggctgactgtgctgttctcattattgactcaacactggtggttttgaagctggtatctctaaagatggtcagactcgtgagcatgctttgcttgcttttaccttggtgtaggcagatgatttgctgctgcacaagatggatgcaacaaccccaaagtactcaaagcagggttgatg

SEQ ID NO: 6092 - DNA, 358 bp, Gossypium hirsutum
  Clone ID: uC-gsronu33B014a11b1
acaatcaatcaaccgttggagataaggctgaagacgaagaagtccaaccagagaaagaaggaaccgctgctgctcctcgcaagaggaggcgcgacacttaaatctgaggcagagtggcagattagtcgtgctttggggacgacataccaatgagagtgagcagaaactgcaaagatttgggagtgaggtttccattcaaccaaccaatgaagatatactccagcttatggaacgccgatgactgggccacaaggggtggtctcgaaaagaccgactggtccaaagccccattcattgccacatacaagagctttcacatcgacggctgcgagtcgttggtggaagccaagttctgcgc

SEQ ID NO: 6093 - DNA, 112 bp, Gossypium hirsutum
  unsure (1)..(112): unsure at all n locations
  Clone ID: uC-gsronu33B014b04b1
caatcctcttcctnaaggaaacgtaaggatggaaccgatcggttcttaccaagggaagagggagaagaaaaacttggcctgatggatagcacagtttacctgcgtagatatt

(The sequence listing continues in the following parts.)

We claim

1. A substantially purified nucleic acid molecule comprising a nucleic acid sequence, wherein said nucleic acid sequence:
   (a) hybridizes under stringent conditions to the nucleic acid sequence of SEQ ID NO: 8615, or the complement thereof, or
   (b) exhibits a 90% or greater identity to the nucleic acid sequence of SEQ ID NO: 8615, or the complement thereof.

2. The substantially purified nucleic acid molecule of claim 1, wherein said nucleic acid molecule encodes a cotton protein.

3. A substantially purified nucleic acid molecule comprising a nucleic acid sequence that shares between 100% and 90% sequence identity with the nucleic acid sequence of SEQ ID NO: 8615, or the complement thereof 4. The substantially purified nucleic acid molecule of claim 3, wherein said nucleic acid sequence shares between 100% and 95% sequence identity with the nucleic acid sequence of SEQ ID NO 8615, or the complement thereof.

5. The substantially purified nucleic acid molecule of claim 4, wherein said nucleic acid sequence shares between 100% and 98% sequence identity with the nucleic acid sequence of SEQ ID NO: 8615, or the complement thereof.

6. The substantially purified nucleic acid molecule of claim 5, wherein said nucleic acid sequence shares between 100% and 99% sequence identity with the nucleic acid sequence of SEQ ID NO: 8615, or the complement thereof.

7. The substantially purified nucleic acid molecule of claim 6, wherein said nucleic acid sequence shares 100% sequence identity with the nucleic acid sequence of SEQ ID NO: 8615, or the complement thereof.

8. A transformed plant having a nucleic acid molecule which comprises:
   (a) an exogenous promoter region which functions in a plant cell to cause the production of an mRNA molecule, which is linked to;
   (b) a structural nucleic acid molecule, wherein said structural nucleic acid molecule comprises a nucleic acid sequence, wherein said nucleic acid sequence
      (i) hybridizes under stringent conditions to the nucleic acid sequence of SEQ ID NO: 8615, a complement thereof or a fragment of either; or
      (ii) exhibits a 90% or greater identity to a the nucleic acid sequence of SEQ ID NO: 8615, a complement thereof or a fragment of either, which is linked to
   (c) a 3' non-translated sequence that functions in said plant cell to cause the termination of transcription and the addition of polyadenylated ribonucleotides to said 3' end of said mRNA molecule.

9. The transformed plant according to claim 8, wherein said nucleic acid sequence is a complement of the nucleic acid sequence of SEQ ID NO: 8615, or a fragment thereof.

10. The transformed plant according to claim 9, wherein said plant is selected from the group consisting of soybean, maize, cotton and wheat.

11. A transformed seed comprising a transformed plant cell comprising a nucleic acid molecule which comprises:
   (a) an exogenous promoter region which functions in said plant cell to cause the production of an mRNA molecule, which is linked to;
   (b) a structural nucleic acid molecule, wherein said structural nucleic acid molecule comprises a nucleic acid sequence, wherein said nucleic acid sequence
      (i) hybridizes under stringent conditions to the nucleic acid sequence of SEQ ID NO: 8615, a complement thereof or a fragment of either; or
      (ii) exhibits a 90% or greater identity to the nucleic acid sequence of SEQ ID NO: 8615, a complement thereof or a fragment of either, which is linked to
   (c) a 3' non-translated sequence that functions in said plant cell to cause the termination of transcription and the addition of polyadenylated ribonucleotides to said 3' end of said mRNA molecule.

12. The transformed seed according to claim 11, wherein said nucleic acid sequence is a complement of the nucleic acid sequence of SEQ ID NO: 8615, or a fragment thereof.

13. The transformed seed according to claim 11, wherein said seed is selected from the group consisting of soybean, maize, cotton and wheat seed.

14. The transformed seed according to claim 11, wherein said exogenous promoter region functions in a seed cell.

15. The transformed seed according to claim 11, wherein said exogenous promoter region functions in a leaf cell.

16. A method of producing a genetically transformed plant, comprising the steps of:
   (a) inserting into the genome of a plant cell a recombinant, double-stranded DNA molecule comprising
      (i) a promoter which functions in plant cells to cause the production of an RNA sequence,
      (ii) a structural nucleic acid molecule, wherein said structural nucleic acid molecule comprises a nucleic acid sequence, wherein said nucleic acid sequence (A) hybridizes under stringent conditions to the nucleic acid sequence of SEQ ID NO: 8615, a complement thereof or a fragment of either; or
(B) exhibits a 90% or greater identity to the nucleic acid sequence of SEQ ID NO: 8615, a complement thereof or a fragment of either, which is linked to
(iii) a 3' non-translated sequence which functions in plant cells to cause the addition of polyadenylated nucleotides to the 3' end of RNA sequence,
(b) obtaining a transformed plant cell with said structural nucleic acid molecule that encodes one or more proteins, wherein said structural nucleic acid molecule is transcribed and results in expression of said protein(s); and
(c) regenerating from said transformed plant cell a genetically transformed plant.

17. A method for reducing expression of a protein in a plant cell comprising growing a transformed plant cell containing a nucleic acid molecule wherein the non-transcribed strand of said nucleic acid molecule encodes a protein or fragment thereof, and wherein the transcribed strand of said nucleic acid molecule is complementary to a nucleic acid molecule comprising the nucleic acid sequence of SEQ ID NO: 8615, a complement thereof or a fragment of either, and whereby said transcribed strand reduces or depresses expression of said protein.

18. A method for increasing expression of a protein in a plant cell comprising growing a transformed plant cell containing a nucleic acid molecule that encodes a protein or fragment thereof, wherein said nucleic acid molecule comprises the nucleic acid sequence of SEQ ID NO: 8615, a complement thereof or a fragment of either, and whereby said nucleic acid molecule increases expression of said protein.

19. A method of producing a plant containing reduced levels of a protein comprising:
(a) transforming a plant cell with a nucleic acid molecule comprising the nucleic acid sequence of SEQ ID NO: 8615, a complement thereof or a fragment of either, wherein said nucleic acid molecule is transcribed and results in co-suppression of endogenous protein synthesis activity, and
(b) regenerating said plant comprising said plant cell and producing subsequent progeny from said plant.

20. A method of growing a transgenic plant comprising
(a) planting a transformed seed comprising the nucleic acid sequence of SEQ ID NO: 8615, a complement thereof or a fragment of either, and
(b) growing a plant from said seed.

* * * * *